United States Patent 6,812,339 (POLYMORPHISMS IN KNOWN GENES ASSOCIATED WITH HUMAN DISEASE, METHODS OF DETECTION AND USES THEREOF) - sequence listing, part 34

SEQ ID NO: 13525 - DNA, 109690 bp, Human
aagggagaagagaggcccagagggaaaaagtaagagcaccaaaggaacccagggctaatgctgtctcctctttaacttcaggacagattcgcagcctccccacctgtttccaacctccaaaatgagagctgtgaaatctccttgagatctctgcttctgctgatctattcagcaactatttcccgagcacttgtgttccagtgcataagaaggctgtcaaatgtgctgtcttcaagcatctagaaagccagtgggggagaaagacaagaaagtgactgtgagcagcaacaggcccccgggagggtgcagaggtgagcagggctgaaggaagatgcagggggtgggaggcgctgtcagggtccgggaagcctccttcccggaatggaaaatgtgtaatgcctgagacccagatgccttggggagcttttggggaagcagaggtctgattaagcactgcctggaattccctcattcatgagcattctttcagcacctaccctgcgcccgggagaaacggtcttgaacacagcagacaagctcgctacccccatagaatgtaaagaaacggggcacaaattagcatacaaaaagacacaagtgtgacctacggaaactgcacagaggaggtgcaacgaacggagccctgggttaggaccgggaggcgctgcccaccatcaacagaaatactcctccttttgccaactacacacgcgagaggctggatttccttcacagacgtccaccaaagccacacatcgcgacacacggaggcagaaagcagcggtctcctaagaagttagacacgaggaatctcgggcagcgaggtgcctgcaagcccgggggcgggcgggagcagcctgcacgcgtggggaagggcacgcgggagcgggtggcgccttccgggccgggtcggccgggaggttccaaggcaggaaaggggcgcagaaggccgggacggcgccgggtacaaagcctcgcagggacgcccgaaggccgcagagccaccgcggggaactgacagccggagccggagctggagccggggggcggggaggaggggcggaggggcgcggccaggcggggtccgcggactccggcctgggaaggatgcgcgcggactagggcgcggggagccaaggcccagaacatcggtaccgcgctcccttcagccgaggggctgcagagaggccagggggcagggggcagggggcagggggcagggggcaaagggcaagggcagaaaggaacccacgtagccaaacggcacccagcggccccgaccccaagtgtcccgacgaggggggacgcctgcgactaacgcggggacagcccccgccgcgcgccaccgccgcaccccaggcaccgggcccccacgcagggacggcgtggaccaccctacccccgaaccccgaggctctggccaacactgaggccccctgtgcctcgaggccgcgtccaacctcccccgcggcgccggcccacatggttccgcccgccgcgggccgcgttacctaggagaccgacccgccgcggccgcgccggaggccacggagcccacgcttttcagagagtctccactcgacggacccagaggcccggcggccggtgctcaacggagccacaagcctgaggaccgaggactggccgaggggcgcgccccgtccgctgccacccgcgggaggagcctcggaaggcggcgcaccgcgccgcacactcagtccaagaacccgcctcgcgtcactgtcgccgtcagggccgcggagccaatcagagcccaagtcgagggctacgctttgcgagcgccagccaatcggtgcggcggcgggcccatcctgatttgcatgtccgacgacccctcaaccaatggtaatgtgactggcgtgaacaatagccaatcagaagctggaagaggcgtggccccgggcgtcccacgaggtgaagatgctgctggcggaacctgcaggagctagcgggattcgggggcgctaaagtcgcaggggcagggcgggaaggaagatccggcgcggggcacaggatccggagctggagcccccaggtgagtaccggggagaccccggcggggcgcgctttccaccaagctgctccgggacggcggcggcgggtatccgcgaggcccgcgctgcggcaggcgccgcggtcccgtctccatctcttcttccccggccctgcgtccctgcctccgccgctgtctcacctcctctccagcctcctcacctccttctccatcgtctcccttcccccatccctttctgtctttccttccctgtcctcccgcccgcccgacccttcagctcgcatccctgacccctgcccctgccgccgtccctcttcccggtgcacctcttccccatctctgcccgctccggtcctagcagcctcgccctcccctttcctccatcctcctctcatcccctctcccggcctctgcgcagccccaccggggcgctgctgttcccggtcctccccatctctcctcctgatcgcttctcaaggctcatccgtcgttctcgctgcctgtccctgtgtcgctccggtccctttccccaccctcccattctgcccccagcccctccgacctctccccgcgggcacgctctcaccaccttaccctgctccccaagactgtgaccctgcttcctgcaccagttcctcgggctgtttacagcacacacaccgccacttctgaccctgagcccctactcctatcttaagcttctccctcctgccaggccttggcacaaagcacttccgcacctccctacctgctgctgctcccaggatgcaaagaccccactgctgcaccgcgtcctgcggcattagcagcagccggggtacctgcccaccttcccaccccgccaaccagccgcatcctggtgtccctcctcctggcatttgtcctgggggctcttacagggactgtgctttgcccgcagcatcccggggtgctccaggtggaaagccccttagcacctttcctccctggccaccgtctccttccctccccacccccactttcctgctcagcctcactttgtgattcagcatttttggggttggtaactttcttgcttcctgtcgtgatagggacctggctacggagctgaaggcaggggtcttgaccctgcggttagcagggccaccttaggaaccagacctgagctgcctggttgggagggggctgaggagctggggaccgccactgggggttgtcttttcctccctttcatttgtctgccctgtgttgaactgtgtccaaggggagatgacataagtaatagctcttggggaagtgggctattagcatttatggaaattaatacatccacatccgaggagcaagaacaccaagttcaggccacagctgtcccactgtctgtcgtttcaggattttttctttctctgcaacttctcctccccgacaaaaaccccagcctcacccctcccctttcccccagtgccaagagtaagctcctgctctgctaaggaagccgcattcaggccccgcgttgcaggttgcagggtttggggacctacgtgtggagagtcacatctgcccacctgattctcgcctggcggccgtgtctgctgcagagccctgtgcagctcctggccctgtgctctcgcagtgtggggccctaagagtgcacttggtcctccaggtcctgtcattgtctccacggccacactcggcctcagtggcactgacagtgttcgggccgcagcacatccctcgagagcagcatggtaggggcttccctgttgacacccagggccattttttttttccctgcgccagtcagcaaatgctttgtaggtgctagtcaacacctgggggctgagccaggcactggagttggggggtgtcgtgaaaaagtgtgaaacccttttcgtgtgtttcttggttgagaaccgtcttgggtctggatttggagcctggatgggaagcagtgtgcacagaagccattgcacccgggaggtgggacgtgggccatggcgctagagagctggaaaggccgagggtgccatgggctggccagctagagaaggcttcctcgctttcatttttcagtcatcttctaagacccaaatggttcaggaggaagcgagtgccacacagttttgatttggcagtttccggcctgggcttggagggaggggcctcccctagaccttcctgtgtgttggtgctctgccgtggtaactgggaacacatcatctgtgtggaaggagagcctgctccctcgcgagaaccaggggaccgtgcttctgtttccagggactctggccaggtgcggtatgtgtctggtcctcggctaagttctcagtgatattcacgccgccagaggtcccagagtgaatgttttcctggcgtccctgaataaggaggcaggacagtgggcagctcggggcggcaattcgagaaggattgatgccagaggtgtctagggccatagaccccatgttcccgccagtccccctcccaccaccaggaggacttgggtcttggcacccagcagccggtcatccttgctctcagaggactaaacggaaggacaggcttctccagggtcaacagaggcagtgacggagctgggttggaccccctacttcctacttatttgagcccagttcatgccttggctgtccgagctgggggaagccagcaccccgaggacatgaccggctgtcccttcagaaggccacttggaggcattgctgacattcatgggcgcagccagtgcccttgggtgtgtccaggtcactggaggggcttttgggactgggaggtgccactaccatggagatttctcagcgactcagtcctgcctggcatgcaggccctggtgcaagggtactgttgttcgtggccttcaaagagatggccccatagttagagaagagtgagggcaccaggtccgtggtgggatgaaggaaaggagggaccctccccacactggaactacactcatgacctcagttcgcctccggcacttgtaaacaaccctgtgagggaggctggatagggaaactgaggcacagagcagcagtgaaactgatcctggcctcccagctagtgaggaaaccttgattctgttcctgccctgccagaactctgtgagaggtgccccctccgccatcacctgagctccatcgaatgcctgaaatcctcacctctgcaggagtgagtctcccaagaggccctggaggcccaggcccagaccctgggggatatggaagcactcctttgtcgtggcgtgggaagccccacactgctctttccttggtgacgggtgacccgccatgttcaggcccctcctggtctatcttcgggtgagtctattaagggatacaccatctccgctcagccagtcccgaggaggcaaagggaacaggaccctcttccccaggagagagcacactgggggagatggggtggcacacctgggcttcgtcctgtcactgcccactggctcgaggctttcctgcctgcctgggcttggcagatgcgtgagactccctgtctcatgggcctgagcagatgctgggccctcttgtcctctgccacatcctggggaactcagatgaaggccagcctccctcttcctgcacacccaccatgggatgagccctgggctcaggcccctccctgcctgagggtgccctgccactgccacacccaggtttccactcagacccctgctggccagcgtctcaggaggctactccctgctctgcgcagtgaccacatggttagccccagagacccaggttctgcgtgtcttcagtgacagagcaaccccatgcccaccctgccggcttccccggcacctgtctccttgcaggcagcctcctccacttctccagcacacaggtacccacagagctaactgctttgacgccatgctggttgtagacaaaacaggattgggaaaaggggaaaagtggagaaatggtggggaccaccttcctggccgtccgcctttacctggacccagtgagaaggctttcctggctgtgatcttgagccctgactgccgagcagccgagatctatcatccaactccatggctgggagctgggcacaggtttcttctcagaccccgcaccagattcaacccattccacgtgggccagttttctggagcaacttcctgggtcctgtagacccctgaggtctggtccgcaggggtcctgagtcaccagcctgggctgtttccctgccagagacttagctctctgagtctctggctctctggcctgctaagccacacggatcattcgtgtctccctctatctgaatgggtgaactggtgcctcaatggtaggagcctggggcttccctggcacacagtgggtgctggataactgtcagttccccctcttccagtcggacgaggcgccccagccaccatcctgcctggagctcaggtggttcctgggcagcccaacggagcccccaggaaaaccggagcagaggaacctggctttccttctgcgtggtttcctgggacctcttggcagtctctcagctggagagccctgctgagtgatttcacagtggagaaggatggagggaaggaaggggaagagagggcaggaggggagagcccgttgccctggtctgcagggaatagcctccctctgagggagggacactccttgccctattctccctgaccttgggcctcgtggagggcctgcaagcctgccagacccccactgcacacctgcccacctgtctgtctgattccagcagcccctgggcaccgagtgggttgcagagccatgctctgagcatgctccccctccttcaccatgaatgtgttttcattttccacccccgggcagcttcatgatctttcattgcaatctcaggccctggtatccacaggctctcaatgcagcctaggacagaagactctagaattctgcctcggagccctgtgatcccaaacactcagccgtggcaggggctctctgaaagtgatattcttgccacccctcccagatgcaggagggtaaggaataactagaatgcatgggcaaggagattcagctcgatctattcattataaaacaaatttaaatttaaaacattgcttaaaacctatacatgccagtgaagggcgaaggtcttagcagcagacatttgaaggaccaagaatgagcaagacccacctccctcctctagggctgagacccaggaaagggatgcagtgaccacatgcctggaatggtcagagaaaaccctgctgatagggaaggagagacgggggcagtggggacatttgacctggaccttgaaagacaggcaggttgtgataggcagagctaggaaaggatggtctggaaaagggctctgcatgggcaaggtcacagagggaggaccaggcaggctggatgatggccagaggcccagtgcggtcacaggctagggcatgaatatgggtgaataggataactaggggagggcatcagggccaaggccaccatgggctggacagtgatggggagggagggaagaggagagccctggagccccccaagcttttctggctgggtccacctgggctgcacagactgaaagaggcagagccagaatcggggcctctggatggggaggactgggctcggttgaccttgggtttcgaggtctgtgtcttggacagcagtgcccactgacattgagaaggtagggctggggttcacaggagaggtgggacctggaggtgactgccacctacctactggtcacagccctgacagtgtcacctgggggtagtgccaagggtcgccaagggtacgggtttgagagggaagatgaaggtcaagacagacagtagggaaccctggattcttccagagcccggggaggagaggaaaatagaggatgaggcaggtatctgctgcatccggtgggccagctgctgccaaggaggcagcctctgttgagaggggaagcagagctgggctcccaggagcagcgagggggcgcaggaccccagattcagcaccaccagcttccaagcactcgccaaccaacttatacccatctgactgaggcagaaacactgaaagtcaaagtggcttccctaaggcctccaagctactaggcgcaggagccaggaccccaagccagagtcccaccctggtgacctttggactttgccgccaatggctctggagagatttgaccgtgaaaggaggaaaaggaaggtgagggcacagggtggctccggggctggcgggcgtagacgaagccgctttgctgcttaaccgcaactgccagcagcaccctctttcgtccgcccctttagagacgatttcaacggcgcattcttccatttcctgccttaatggggggcatttctggggacacccgtgaactgcgggctggggcttagccttgttggtggccctgcataggttggctgcgtagtgctttacgttctgtgtaagaattgtggagtcttggggcctgggtgggccgagggtcctgagatatcggtgtgcccagcaggcttgtagggtgtggcacctgcccagccctcaggggtcctggtgcagcttagcaagctccttggccaccagtccctggtgactcagatcaggggttccaagaacatgctttgagaaacactccctagccctagccgtttcagtctgtcagtgaacctgcccacctctacttcttaaggaagcacacgaggaagctgtttgtgatggttgaaagctccggcgagaagggctttgcgggggtttctgtaattcttgggaacatgtgaagcccacattctactggaatgacctgctgcacttttgtgagcttcaaatctgagatgtgctttcatcctcccgtgtgtggcagggcgccttgttagtgtccaggcctcttggaatgtggtttggttcaggggtactgatggcccgagtgcttgcccacggcagaggaggccaggggtcagtacaggagccagtcctcgccaccctgttcctgaccatacagagtctgtcacctgcctgtgccctgattgtaccccatctgcaccgtgtctgcaccctgcctgcgccctgtctgtaccccatgtgcgccccatccgtaccctgcctgcgccatctgcgccctctccgcaccctgtctgtgtcgtctgtgccctgtctgtgccccgtccgcatcccgcctgcgccctgtctgtgccccgtccgcaccctgcctgcaccccatccatatcctgctctgctgtctgcaccctctctgcaccctgtctgcgccgtccgtgccccgtctgcaccttgtctgtgccccgtccacaccctgcctgcactctgtctgtgccccatctgggccctctgcacgccctacctgtgccctgtctgtctagatagatcctgcagcgcctcccgcctctgctcagccagccccccgcaccccctagagggtattgcctttccatggaaatgagtagcaggtatttttagtcacccagaccaggaggtattcaggtgtcacagacacaaggcccggagccatgttgtccctttgctcctacaaaggaaacaggatgcccaaaacaggacttgtaaatcccaactcaaaacctccccgttccgcagggacacagggtgctttgctccttgaaggagtagtggatgcctccttatttacatccttcgtgcttacaaggcagtgggggtgtccaggggacatcagccaccctgtgctggggcacttcagaggctccggggagctgccatgctctctctccatcccaaaagatgggtctggggaggccactggggcaggcgagcccgctcctgtgaggagtgaaccccaccccccgccgctctgctggtgtgagtgacagttatcaacagaccctgaatgggggcttcccagaaaagaaaaaaaaaaaaaaagaaaacagtgatatccctgggagaaaggggcctgtttacatgaagcctataggccgttggaatctgaagtagcacctgggggtcctggtgacgccagcacagacagccctctccagggcagtgctacagtgagaccagggtctggggaatgtcacttgctcctcattaactcatgaatcgggagccaggataaggtcgctgccctcagggccaacatcagagcgggaggaggtgtatggtccagggcaccaaggcgtcactcaggccaccaccaaagcatcacaccaaagcattgacagcgtccatctcacatcgtcaggaaagggggaagcactggatggctgtggcctcacaggcagggagagtggggtccaaaggcgcagagacagcatggggtgtcagggcactgcagggagagggacaagggcaggtaaggagggaccttggaggccggaacatctttcacggaggcctcctgcttcctctgtgctgctgagctgggccattcatctggcctgggtggagggaagctgaacagggtccctctgcgacctggaggccccaggccctaccctgagcccttggtgctcttggagccctgagctgctccagctgcatgtgatcaccacacacacacacacacacacacacacacactctcccaacacacacacagacacacagagcctgtgccaccagccctcattctctgcctcacccagggccggaaggttctggctaagcctccgggggtgccactgggagggatgcctaggagagggtctccccaaccctctagcaacctgataatcatgatcaccggttgttggagtggcctggccacctgctgggctgtatgggtgctgagggcctggctgagccccgtgatacacccatgggggtgggtctctgaagagcagtctgtgtgagcagcaggagaggtggcacctcaggtcaggggacgcttccccccaggctctggaggggacaggataacacctgtccccaggcttggcggaattcctggtctctaacgcagcccggaacacacagagaaatgatccagtgtggggcagtgttgctcacatggtggtaggactgggtcctaggctcctggagccagcggcctcagaaagcccctctaggttctctgagtctttgacactgtgcagcccagactcctcattttatagacagggaaactgaggccagatgactcatccttgacagagccgggatcatggtgcagctctctgactgagccccctcgatgtcctgtagtctctccaagcatgccctgcagtggtcatgactgctgacatctgtccctgcctagactgtgggcctcgtgaggacagaacatgcctgctgtccccatcacctctgtcccccagctcagcctgactggtaatgccccggccatgtcatgaggccttggaaccaagcctaagcttcctacaggccagcaaacatcgtccccagcactggctccctgatttcatctcccctggccgtggcaggcagagagaagccttcagaaccagggaggaccagagggctcctggcccaacggaggccaactgtgacaccaagggatcctccccaaggggtcttccccgccagatacaatcctgctctgagcaccctgaacaacaggcagtgcccaagggaggccagagacagccgtggcctctggggcctggcactcagccagagctggcaggaggcggggatgcacctcctgcagctgaggttgagacaaagccaggtgcctgccacggcagctgtggcctgagctggcatcggtggctgatggccacagactccctgatgcctgtcatctgtactgagggctctgtcccagcccctgaaccgtacgtgatgcccacaccaccgatgaggacacagcttgtgtttttacaaacgaggcacttaattatgtggaggtaaatcctttgaactgcagaaaccatcccagcacgtccccatcaggtgttcccaggtggcaggcagagaaggccaaggtcccttgagtggatttccaggggagctgaagggctacggccctgccaggactgggaggtactgggaggggctggacagctgagagcggctgcccccctgcaggaagaggaggcaggcgcttcacccgactctggacgacgctgacagcagtgtcaaggactctgccgtcactgttgtcctttgagttggcagctgccctgtgttgcagatttgctctggctctggccccctgcttcgtcccctccacacatttgttcttagtcctcagctcctcccgtctctgtgtcccgggtgagaacaggtcctagaccttgtctcaggtcacacagctaccagaggacagagctagaacatgaccgcagcagacgcctgatcctgcgccccaggcgacccgttcacggggcgggcgctcgcccttggcctcgctcctgagccacagtcaccagggtgccaggtaaagggaaaccacatgggggcgaggccagcgcacagccccagcagcctggcccctgctggctgcaggggctccagagcctgtgctacaagcccgggtggccggagcctcctgcgggattccccatcccacccctggaacttgctttccctgcttcccacacacagatcctccccaccagagcagggtcatggggtcagaggcagggtccgtgtggtgtggagcaggggttcctccccactcgctcgctcggctgccttcagcccctgcagacacgcaggcaccgtccaccttctccactcttagcgcgagccctgccccagccaggagcactcactgagtggccacattataccctcccgtttgtctatagttcacttaaacattatttcctgggagatccggcagctcttcactcttccgaatcaggctgtgggaaacgtttgtgtgcatctcgctttatttcctctcttgaactattaggataaagtcacagaggtaggattcctggaccccaagctctggacctctactacccaatttcaaaaaggtcgtagtatatagctcatgtcccagaaccagccacgtctcctcgtcgtcgtttcaccgcaacctcgccagcaatgagtattttcatttaaaaatgtttttgtctgctggctatgtgattgcagaggcatggctggccccagcttgcagcggtcgcttctgcatctctttttattcagcggggcctttaatggatgtggtggagtaaagctgcctttcaaattgctgccgcagcgctgcctggcaagatgttaatcgttcatgccctgtcacgtggtcatgggacggtaatcctctttgaagccatttgttatttattcttacagtcccccggagagcagggaggagcccccagtgcctggatcacaaacgcaaatacagagagggctgcagacatttcagcctcgaggttggagcagaagcagggctggggcccaccagggtccagacccctagtaaagaggtcacttcccacaaaagaaggttgtttgtctgcttctcatagaacctgctctggttagagggtttttttttttttttaagagacacgatcttgctgtgttaccgagtctggtctgaaactcctgggctcaagtgatcctcccgccttggcctcccaagtagctgggactgcagatgggcattgctgcacccagcttggttagagggtttttaagcctagggggtgcatttgtttcctagtaccacaagcagggtggcttgaaacagcattatttattctctcatggatcaggaagccagaaggcaaggtgtgggcagggttggttccctctggagaccgaggtagcatgtgttccaggcctcgctcctggttcctggtggctgcccgtagtgttccttggcttgtagaaacacccccccgagattctgcccccatcgccacatggccttttctgtgtctgtctcctctttttatatggacacttgtcattggatttagggcccatcctaatccaggatggcctcatcgcaggatttccaccttaattacatctgcaaaaacccttttgccaaataattccacatcgacaggtaactgggattatgacttgggtggatctttcagggaacacagtccaccccacacaataggtttctacccccgagtcccacctccagccccgtctccctccagagtctggctgcttcttcctcatcagacagttccttccctctgtagggattgcatacaagtgttgctggctgaggggtgagggtggagtggggggatgtgggagctgagctgagggatgagggtgcaggcagagatctgggagctgagctaaggggtgagggtggagtagggggacgcgggggctgagctgaggggtgagggtagagtgggggacatggaagctgagctgaggggtgagggtagagtggggggatgtgggagctgagctgaggggtgagggtgcagtggggggacgtgggagctgagctgaggggtgagggtagagtggggggatgtgggagctgagctgaggggtgagggtggagtagggggacgtgtgagctgagctgaggggtgggggtggagttgggggatgtgggatctgagctgaggggtgagggtagagtgggggacatggaagctgagctgaggggtgagggtagagtggggggatgtgggagctgagctgaggagtgagggtgaactgggggatgtgggagctgagctgaggggtgggggtggagttgtgggttgtgtgagctgagctgaggggtgagggtggaggcggggacgtggcagcccagctgagggccttggagcacacctggtaggaagccagcctgtggacctggagccgactgagggtcccccctaccccccatgagtaggagtgggatccaacctgggtcccctctctcccctcctgctggtgtatttgtagttggaaggcagcacaccctcctggctcagagagatgggtttagtggcccggggaggcacggaagcccaggtctgtcttttcccagcggtcactgtgaggatgcagggcccccacgtggggagacagggcacagcctcccattggggcagatgggggtctccctgcccaggatgccggccggagtttcccctggcagggaccacgggtgctgtgactggagggaggtcccagggctggcaccctggggctctgttctgatgttctgatccattccaccctcacccctcagctcagctcccacatccccccactccaccctcacccctcagctcagctcctacatttcccactccaccctcacccctcagctcagctcctacatttcccactccaccctcacccctcagctcagctcccacatccccccactccaccctcacccctcagctcagctcctacatttcccactccaccctcacccctcagctcagctcccacgtccccccactccaccctcacccctcagctcagctcccacatccccccactccaccctcacccctcagctcagctcctacatttcccactccaccctcacccctcagctcagctcctacatttcccactccaccctcacccctcagctcagctcccacatccccccactccaccctcacccctcagctcagctcctacatttcccactccaccctcacccctcagctcagctcccacgtccccccactccacccccacccctcagctcagctcccacatccccccactccaccctcacccctcaattcagctcctacatttcccactccaccctcacccctcagctcagctcccacgtccccccactgcaccctcacccctcagccccactccactcccacccctcagctcagctcccacatcacccactcctcccctacccctcagctcagctcccacatccccccacttcaccctcacccctcagctcagctcccacatccccccactccaccctcacccctcagctcaggtcccacatcccccacttcaccctccacccctcagctcagctcccacatcccccacttcaccctcactcctcagctcagctcccacattcccctactccaccctcacccctcagtgctctgtcagaagcgctacctgaccacatccctcctctgggctctgagttcccctgtgcaagtggaaccaatctttcccctcaacttcttccaagggccgtgattgaaacccacctaaaatacaatgataagagctgttgtcgagggatcagacagcagcctgtgtaagatgagcactgggttctggggaaggacggtaaacagttcgccttattctgtgctgggcactgtgcttaagcccagcagcgggccctggctggactcagtgtccagagtgtctctgctcagggctggccgagagtcagcgctttctgtccctgtggcggacagtccgacctctccgaggctgccatagagactcatatcagccaggcgagctgggagcgccaccactccccagatagttactgcccgggcctccctgcccagtcactgcatgggggggggctcagctcctgggtgtgagtttgtgccaggctccagagaggtggggaccccagccacacccagggacagggccaagtggccaagagaccacttaaatgccagcgtggccaccccatgtaaagcaatgatctctctgaaattgctcatctggtatacaccaggacactggcctcttcttccttctcccatcctgggatttaagaagttaaaacccaccccctctgcccaggaagccgaggcagcagcttggagccagagccggaggcagagcggctccatccgtggggagccgcgccacctctgcgcctcctccgcgcctcctctgcgccccgcgccgtgctgagtcaggctctgaaacgcagtcatcatcgggaagtggttcttgctgtggccccatccccctgtgtgattttcctaccttggctcacttaaaatttcaatctggctctgagaggagactcagcatttcctttatctccttttactgtggatgcttggaaaggagtgggagaagctgggcgccgcagtgtgtgcgcgtcactgttgcccttacccccgaaggaggggatggccaagagaacctggaacctcccctcccgtccctgtgcccgccgcttcccttggccctcactgatgagcccaacagatgcagaggctccttctctccctggcactgcagccaggtagaggcagctgcagccgcagccctgagaggggctggagacgctgaggcaggggcagtggtggggtctggctcccctcagttcaaagtggcctgcagatgctgcctggagctgtctggtttgacatggctccctctgagggagctgatgagtgagggccaggagcactacttcatcaggcatcccctcacctgcaccaatggggaggcgaacctggagctgggccattaagacccacagattgttttctccatgttgcgaagggcagggcttggatttcacgaggcagatggtgagccaagtccggttccgctgcgctgggtcccccatggcagaaaggacccgcccccccatcaccctgacagtggcttgcatgcccaagagcagccagcacccaggacaggcttccctcgttcctctgttcatcctctttaagaatcactcagagccaggcacggtggttcacgcctgtaatcccagcactttggtaggccaaggtgggcggatcacctgaggtcaggagttcgagaccagcctggccaacacggtgaaaccccgtctctactaaaaatacaaaaattacccaggcatgatggcgtgcacctgtaatcccagctactcgggaggctgaagcaagagaattgcttgaacccgggtggcgtggtggaagttgcaatgaaccaagattgcaccgctgcactccagcctggagacggagcgagactgtctcaaaaaaaaaaaaaaaaggatcactcaggacaccaacatgggctgagaaatgctcctggtatcaacagaactgcagcagatgatgaaaacaaggctgtgatcagggaagtggctgagggagtgaggcccccgaaccaccaccccagagctctgtcccaggcccctggggtctcatgctgtgacctcctgcgccacatggggagaggtcacctgggggacttgtttccgtgggaacctcaggccttgggcctgagtgaggagatgtctgaagcctctggcctgggccgagagtgagaccccagagcagccctgcccattcctctgggagcagcctcagtgaaagctgtaaagcagggaaattggacacgtccaggccagaaagagcaaagcaaaagtgcccctgggtgcactgcaccccacagtccaacccttctcccccaggagctgcaggccacgctctgagcctctgtttgaagtggtccctgactggacattctcatctcgggacatgagctagggtcacccagcaccactatgcagctctccaagtccccctggccaccccgccctctgtaggggtgctgggccttgctctgcacctatcccttggagtatctgctttccagagcggcaggaggcccgcctggtatgcccatgggggcatccacctgtgcagagtgtggcctctccccagcagatcgctgggtacatgagcaggcagcagaccataagcaggctggctaacgggtggagggggcccggtggtgtccgtgtgcgtgtatgtgtgcacacgtgtgcatatgtgtatgcacacacctgcacacacaccttcagatgcacgtcccctgtctagaccccatcaaagcctcttgccaggactggcctggaacacactgtccagcctgattctgttctctccctggcttctcttgatcaacttcctgtaatgggaggaactctgacacacttcacaaaagggtgtcaaattagttttaaagggaaaaagaactgcagcatgatctggaattcgctttctgccctgcggttccactgtgaaggcaacacgccttcgaggagttgggggatgaggcagtggggccctgtgaggccctgcggtttctatcggagtgctctctgacccccggtgttccctctctgtctctctatgtctttagcaggtgtttcccacactttagtcattggcctttcatctcatgatttgggtcatctgtgctatttcttttctttttttctttttttttttttttccgacagggtctcactctgccgcccaggctggaatgcagtggcgcaatcttatctcactgcaacctccaactcccaggctcaggcgattctcctgcctcggcctctggtgtagctgggattacaggcacacatcaccacacccagctaatttttgtatttttagtagagaaggggtttcggtttcaccacgttggccaggctggtctcaaactcctggccccaagtgatccacccgcctcagcctcccaaagtgctggcattacaggtgtgagccaccgtgtccagtcatatgtgccatttcttagcttgcatttcctttttagttagttaaacttatttcttaaataagcttattttaaactgaaacttgatgtccctgcaataaagaaccagcattacttgtcatcaataaaaggtaactggaggcaggcatggtggctcacacctgtagtcccatctgctttcgaggctgaggcaggaggatctcttgaacccgagagttcaagttcaacctgggcaacatagcaagacctccggcccttaaaaaaataaaaagtaactggaaaaataagtggatcaatattaacttcaaggcctgtctcaagtgtggccaaggctgtctcaaggcagcacaggccttgctctgaacagccctggatgagccacagctgtgtctggggattgaagagagtgcccctggcccctccctgctccggtcacccccagttcctttagttcacagccctccatgttgtcaagggctgaggagtccctcctcgtccctgctcaggtgaacacaggaaatggggaagcccagggtggggtgggccgccccatcttccccttagctgatgggcaggctggatgggcagggagggtctttcctgggaaggtagtggcccgggagctgggctggccctcgagtgttgaagatttaacttgaaagccatgagggcgctcttccccagaaatcatcgtggaagcggcgaatgagtggcaggaggtgcatggagagtcctggctctgcaggcgagcagcctgccccagctctttcctccttagaattgtgtgactttagccacatcatttagaagacacagatgatagaggtggtagaaatggaaagtgcaactctctacctgctgttgcccaccaccaggacgaccactgcaaatagtgtgggtgacccgttcagacctgggactcagccacacattggcccctgaggcagatgaagtccccagcagatggggagatgcagcattgctctgagggagcagcaggagtgaggacaggagctgccacgtgcacaggagcaggagggaaacaggcaggcagctgtgcccagggccaagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctgtgcccagggccaggtgtgcgggaggcgaggcaggcagctgtgcccagggccaggtgtgtgggagagaggcaggcacgtgtgcccagggccaggtgtgcaggaggagaggcaggcagatgtgcaggggcagagggggttgaaggatggaaaggtagacaggagaggctgtgaatggctctggatgccgagctgaggcacttggacgtcatgctgacagccctggacctccacgaagggcttttgagaaaagcatggcatgaaaagatctgctgttgagaaatagaaacggggctctggtggcaggttgacaaccatggtccaggcaggagcttccaaggcaagtggtggaggtgggcgagagggagagttccagggatatccgcgtggatggagccaacacctggagcccagggcaggggggtgggctgaaggggcacctgtggggcccttgcctgtggaggtgagaactgcagcttggagagcagcagaattgccccccggaaggttgctaggggaagattcccagagaagctgaaagcagtagtgctcagaggacaatgagctggcctaggatggtggaggtggaggtgatgaaggcagagggggcagaggccatggtggtggtagaggtggaggtgatggaggtgaaggtggaggtggtgggtggaggtaatgaaggtggaggtgatgaaggtggaggtgatgaaagtagagatgatgggtggaggtgatgaaggtggaggtgacgggtggaagtggaggtgatgaaggtggaggtggtgggtggaggtggagatggaggtaatggtggaggtgatgaaggcggaggtgatgggtggaggtggaggtgatgaaggcggaggtggtgggtggaggtggagatggaggcagtggtggaggtgatgaaggcggaggtggtgggtggaggtggagatggaggtagtggtggaggtgatgaaggcggaggtggtgggtggaggtggagatggaggtagtggtggaggtgatgaaggcggaggtggaggtgatgaaggcggaggtggtgggtggaggtggagatggaggtagtggtggaggtgatgaaggcggaggtggaggtgatgaaggcggaggtggtgggtggaggtggagatggaggttgtggtggaggtgatgaaggtggaggtggagatggaggtagtggtggaggtgatgaaggtggagagggtagaggtcatggtggaggtgatgggggaggaggaggtgatggtgacagagatagagatgattgagatggaggggcagagatcatggtagaggtggaggtgacagcagtggtggtcgtgagctgtgtgtgtgtttctgtgcaggtgctcacccatgcacgcatgcccatgagatgcctggctctccacacacgccctgtgagccaggcatcctctcggtcagggatataagcctgggcctgtgcaggctgccctctcccactgtggatccccttggaggagactgctgcagctgcagggcaccctctgtcgccctaagaggagcagcagaacatgacctcccatcgctccacttcccactgctctgcttggcttcagcctcatgctggcatctgtgttatctataagcagaaagctgcttgttcagagcgggctgagacaccttcgtgcgttcatcaaaagcgtgctgggcaccaatgaggtgtcagttcctgttccgggcatgagggattcagcaggaaacgagacagacccaccccctgccctcagtgtcccgctggggccagtcaggtgaacagtcacacaggctggggtaggcgcttggcagaagacacacttgtgacgctcagagctctctggagcagcctctccgaagagatgaaatttgagcaggaaccccaaggaacagcatcccaggtagagggatctgagtctgcaaaggccctgggcacaaaagaaacaaccacccaatccagggctggggaggagccctgtcagaggacagcaccagcctccccacgtggatgcccgaccagcatctgaggccagacacagccgccactggctccagggctcccccacaccactgcacccacaactcccctgtttcagaaactgaccactcacctctggaaacccaggagccacctgcacccctgtcttccccctacaccccgcatctgtccgaagaccctgcggtctcagcctcttggattgccagccactggtcacctctgtctccccgcccttgcccaggtggccccagctcacacctgcattgcctcggagactcctgacgacacccaccccctgctgctgcccgggcccccccagcagtcggttctcagtgatcttgagaagcaccactcagctcaccctacgaggaggcctttggctgttcccgtatttgtctctggacttctctgctggccatagaacaagactgtgctttagagggtggactcccagaactgccactcaccaggtgaccaaggcaggccagctttacctctccaagcctcagttttctcagctgtcatttgtgcctaaaacatagtactaacctcataggattatggggcaaaaattacgctgaatgaacgcacgggaaagcccttatcccgaggcctcattcagactgcactgggtcgccagcagctctgacatcgctgcccacacattaatacagcccagggctgctgctcagatgggtgtccttctcctgcacccactgtactgggagggcacttcctggatgtccctggacccccgccatccaatgtccagcttcagcgtaggacttggtgtccgcaagaatgaggcccacatccaggagcaggccagtttcacgtgaagcccagggctgaagccagaggccacgcagcaccacgtcggacagtgtttatctgtgctaatcatgaagtaacacaagtgaggtttaaaaatactacgcttatttcatttcagtgcaggagggagaaagaacacacagtctgtatgagcaactcaaatcaaaaataaatgaggcaaaagagtcaccaaaaatagtgtggcattagagacagcagcctgcgtggctcggccagctgtcctcggctctctgccggcaagcagcaccacagagagggctgcgaggatgccttgatggtgtttactccagagaagatgaacctgatgcctgcgatctgatgagaagtcacagttaccagcagggaaggtagcactgaggggacacacagggcacccaaaggtctctggcatcctctcctcctcccgtcaccctcgccaggcagtgaggtcagaggctaggctcgcaggcagcatgggaaccacttggccagaagtttcctctttgacctgaaggagttcccccttccagactcagagtgtccccacagaagggcagggctgtggcttggacccatgtggggctccagcccccagaggagcaggacagcatgtgctgtacacagcaagaggatttgcacttttgccttaattttattacagacggggtcaccttccttttttttttttttttttttttttttgttttttgagatggagtctcactctgtcacccaggctggagtgcagtggcgggatctcagctcaccacaacttccacctcccaggttcaagtgattctcctgcctcagcctaccaagtagccaggactacaggtgcccgccaccatgcccagctactttttgtatttttagtagagacggtttcatcatgttggccaggctgatttcgaactcttgacctccggtgatccacccacctcggcctcccaaagtgctcagattacaggcgtgagcccctgtgcctggcctcaccttccttttttaatgtgtcagaggtctgcaaattatggcccaggggccagatcaggcccaccgtttgtttttgtaaataaggttttattggaacacagccacgcccttcatttacatatttgctgcttttgcacccagagttgagtaatcgtaatcgagatggactggcccgaaatgcctaaaatatttactgtctgtcccattgctgcaaaagtttgcccttccctgccatagctgcgtaagcaccctggggaagcgtcctgtccgctgaagacagctccagtgtcgatggggcttgggtcagtgttgggtttgctatgctaatattgatttggagctttagagatttttggttgattggttggttggttggtttttgggggttttttgagacaggatctcgatctgtcacccaggttggagtgcagtgtcgcagtcatggcccagtgcagcctccacctccccgggctcaagtgatcctcccactcagcctcccaagtagctgggaccacaggcatgcgccaccacacctggctaatttttgtatttttttgtagagacggggttttaccatgttgcccagactggtctggaactcctgggctcaatctgcccacctcggcctcccaaagtgttaggattacaggtgtgagccatcacacccagcccctagagatgtttttatttaaaaaagaaaggagattctgcaataatgaggtttctctgatgcaaggaacatcttttgtccagagacatttagtcactcgatgggcctcaaaccccaccgtaaaggaagcactacattccagccaccagcacccacctgctgcctgctgcctgctgacagcttcagctttcagagcgaaggaggcttcccacggactcccaggggccaagcagggtcccccagaccaccctgctgggccaccctccaacatctccgagtgaggggtgggtgggactccacaggccagggctcagggaggacctcgctcctggcgggtcctttcctgggatgcactgacgtcccttggctcttccccagcttccatgagtcacaatggagctatttaaacctggggctgtgagaacatgtcaatgtgtccacccccttgagaccacagggctttcaagacagagcatcctttcaatagaccgtggagccaagtactgaatttgatgaggcgttttcacgaggcctgtgtgaaacacttaaaaattgtgcataacatgtgactggacaggcgtctaccagaaaacagtgcaaggagcttttaagccatgaggtttgcatctgtaggaaggctttggggtgctgctcacacgcggtgtgactcgggcggggcaggcagtagacggcagcggtgacactgcagtgacgctatggagcatggacactaatacgtcccactggacttctgcgtgagccccagacaggagcttgaccagcgtcaactggacctgctgcatctgatcctctcccagagtgaggttttgaacagagatgggcagaacaccactaatcacaccgctgctgaaataggtctgccttctgggtaccggttatgaaagcggatttgtgtgtcacatccccaggagaggaggttatggtctcacaagaggaaaacccagcagaatcccagagttggctggaaagtcaacaaaccgcctaaaactcacccacaaaataccgtgaccaggagtatgcatggagacagtgccgagctccgtacaggccgtctgacttcagtgagaccccctccccaccaagacagaggaaaagtcctagactcaggcccacaaggatgggcaaatagggctggggacgcagggtgcgtagagcagaggtgtagattctgcaagggtgtgtgcaaagcagataggggagcacaggtgtctgcaggggaagcatggccttcttattgagctttttttgagatgaggtctcacactgtcacccaggatggagtgcagtggcacgatcttagctcactgcaacctgaggctcaggccatcctcccatctcggcctcccaggttgctgggaccacaggtgcacatcaccatacctggctgtgtgtgtgtgtgtgtgtgtgtgtgtgtgtatttttagtagagatgggttttcagtatgttgctgggctggtctagaattccagggctcaagagatttacccaccaggcatgggtggctcacatctgtaatcccagcactttgggaggccgaggcaggcagatcacttgaggtcaggagttcgagaccatcttggccaacatagtgaaaccccattgtaaaaaatacaaaaattagccgggcatggtggcaggtgcctgcaatcccagctactcgagaggctgaggcaggagaattgcttgaacctgggaggcggaggttgcagtgagccaagatagcgcctctgcactgcagcctgggcgtcagagcaagactgtctcaaaaaaaaaaaaaaacttggcctcccaaagtgctgggattacaggcataagccaccacacccagccaggcgtggcctaaaaggctgtgttcctggaggagatgttgtcctggaacagggttcagcaaaaaaaaatttttttttagacaagatctcactcagttgcctaggcgggaatgcaatagtgtgatcataggcgactgcagccttgacctgccaggctcaagcagtcttcccacctgagccttgcaagtagttggtactacaggcacacacctgtaatcccatagctgtaaaccacacccaactaattttttttgtaattttgtagaaaaggtgtctcactgtgttgcccaggctggttttgaactcagctcaagcaatcctcccaccacagcctcccaatcccaaagtgctgggattacaagcatgagccactgcgcccagccaggcaaatgttttcatagaggaccagatagtcgatgttttcagcttgcaggaaattcagtctctattgcaactactcaggtctgccatagtagcgtgaaagcagccccgggcaatatgtaaataggtgctgtgtactgaatgtttctgtcccccaagattgatagccctaatcctcaatgtgatggtattaagaggtggggctctgggggtgataaggtttagataagctcaggtcttgctctgttgcccaggctggagtgcagtggagtgatcatggctcactgcagcctgggcctcctgggatcgctcaagcgatcctccaacctcagcatcccaagtagctgggaccacaggtatgcaccacgacgcccagctaattttttttattttgggatagaggcctcacgacaggactagtgccttggtaagaagaggaaaaggccagagctccctccctaccctgtgtggacccagcaggaaggaattctgtctgcaagagagagccctcacctggaaccaaatcagccaggaccctgatgttggatttaccagcctccagcaccgtgagacagaaacgtctgctgtttcagccacccaggttgtggtatttcattatggcattcccaagctcactaagataacaagatagcttggctacctggcaataaaactttatttatggatgctgagattgggaactttatataaattttgtgtgttatgaaatgttattcttcttttggttttctttcgtttaaaactgtaaaaattggactgggcacagtggttcacacctgtaagcccagcactatgggaggctgaggcaagaggacagtgtaaggccaagagtctgagaccagcctgggcaacataacaagattctgtctctataaaaaattataaaattagccgggggtggtggcacacacatgtagttccagctacttgggaggctgaggcagacggatcacttgagcccaggagttcaaggctgcagtgagctgtgatcatgccactgtactccagcctgggcaacagagtaagttcccttctcctaaaaaaaattaaatgaaataaataaaactgtaaaaactattcttagctcgagggctgcacaaacacaggtgacaggctggcgcagcagttttccaacccctgtcctacagcaaggagggaagccgtcacactgcactctctgctggccagccggtgtgcagtgttgctcaggttctgggtgcctctgtcatttaggaaggaatcagcaccattaaaagagagtggcagggtgctgatgttccagagagaaactgtgccgaatgatggctaattaaggctctggagttgggcactggagcaccggactccctgctctccaaagcccagcttgccagcctcgacctgagcgtcttcactgatacagcaccaacccgaggctggcctgtaaggtttggcgagggtccagtgtcacagcccacgtgcagcacgtgctgcacagtgtcggccaaaattatattcatggcttaagtcagaaaccttgtgtggaaggagggaaagaagcaaggtttgctctcaagaacaaagggcccggttgtagatggggtgagctatggcaggtgtcctcagatgctccagggattgtcctagacagagggactcacttcgttgtcaatctccggagggcggagcaggcccagcaggtgaaagttatgaggaagctggtttccaatcagcatgcaaaggaccatgttgtcatttcagttgtccccagtgggatgatctgcctagagtttcccacaggtggaggtcttgcggaggggggtcatgcatcccccggagccctgtacctggggtcccgtctctgcatgctcggaggcttcacgacatgtaaacctagttatcttggtaacacttgggggatgtgccccctccccacagtcctggcccagaggaatgaagttacatcaaagcaaattgattcggtcgttgatccttatgttgtagaaatagctagaagctataaggagaaccactgtgaggtccccattaaaggagaagaattttggtggtccccagacagggctggctcgggatctcgttctgtggtcaggaccacctgctgcagtacagcctcccacctcagcctctcagactgccaccttctgcccccaatccagcctgagatgcccccagcaccacccctgctgaaaacagaagcagaacctgatactcagcctcttccatgacaagaacacaccaggatcgcgtccctttccaagcagaattttcccgaagccccaccctcctggactcgggttatggaccgccacaggccaccccagctggaagaaaattcaggaaatataggggtcatgggtgacaggtgggccagccagcaaccgtatctaccacatttttaaaatttctatttttattatttatttatttttgagacggagtctcgctctgtcacccaggctggagtgcaatagtgcgatctcggctcgctgcaacctctgcctcctggattcaagtgattctcttgcttcagcctcctgagtagctgggattacaagtgcccaccaccatgcctggctaatttttgtgtagagatggggtttcaccatgttggccaggctggtctcgaactcctgacctcaggtgatctgcccgcctcggcctcccaaagtgttgggattacaggcatgtaatcccacctgtaaacctgtaaggccaccacacccagcctaaaatttttattttcatatatattttttgagacaaagttttgttctgtcacccagctgaagtacagtggcacaatcacagctcactgcagcctcgaccttccaggctcaagccatcctcctgcctcagcctcccaagtagcctggactgcaggtgcacatcaccatgcccagctaatttttttattttattttttgtagagacagggtttctccatgttgcccaggctggtcttaagttcctgggctcaagcgatccacccaccacgggctcccaaagtgctgagattacagagatttcaggcacgagccaccatgtgccatgtttattgagccagcttaaatatttggcttaaacacatacacccaaatgtggagctgctgttgactccatgatgcagaagtttctttttctttttcttttttcccagttttttctattgtggtaaaggtacatataaaatgtgccatcttaaccacttttaagtgtacagtttagtggtattaagtataaaattcaatagtattaagtgtatagttcagtggtattaagtgtacagttcagtggtattgagtatacagttcagtggtattgagggtaaagtgcagtggtattgagggtatggttcagtggtattgagtatacagttcagtggtattgagtatacagttcagtggtattgagggtaaagtgcagtggtattgagggtatggttcagtggtactgagtgtgtagttcagtggtatgagtgtgtagttcggtggtattgagtgtacagttcaatggtattgagtgtacagttcagtggtattgagtgtacagttcagtggtattgagggtaaagtgcagtggtattgagggtaaagtgcagtggtattgagggtatggttcagtggtattgagtgtacagttcagtggtattgagggtaaagtgcagtggtattgagggtaaagtgcagtagcattgagggtatggttcagtggtactgagtgtgtagttcagtggtacgagtgtatagttcggtggtattgagtgtacagttcagtggtattgagggcacagttcagtggtattgagtgtgtcattcagtggcattgagtgtacagttcagtggtattaggtgtatagttcagtggtatcgagtgtgtagttcagtggtattgagtgtacagttcagtggtattgagtgtctagttcagtggtattgagtgcgtaaattcagtggtattgagtgtacagttcagtggtatccagtgggtagttcagtggtattgagtgtatagttcagtggtattgagtgtacagttcagtggtactgagtgtatggctcagtggtattgagtgtacagttcattggtattgagtgtacagttcggtggtattaaggatacagctagttggtattgagggtacagctcagtggtattgagtgtataattcagtggtatcgagtgtgtaattcagtggcattgagtgtacagttcagtggtattgagtgtgtagttcagtggtattgagtgtacagttcagtggtattgagtgtacagttcagcggtattaagtacattcataatatatgcactaccatcaccaccatccatctccagaacctttttattctcccaaactgaaattctgtccccattaaactggaacttcccattccccctcccctgcccctgagggccaccattctgctttctgtctctaggcacgtgactactctagggacctcagatcattggaattgtacagtatttgtcattttgtgactggcttatttcacctagcagaatgttctcgagactcatccgtgttgtaccatatgtcagcatttccttcctttgtatgactgagggatgttcccttgcatgtgtgtgccacattttgcttatctttttttttttttttttttttttgagacagggtctcgctgtcacccaggctggagggcagtggcgcgatcttggctcactgcaacccctgcctcctgggttcaagtgattctcatgcctcagcctcctgagcagctgggattacaggtgcctgccatgacacccagctaattttgtatttttagtagagacggggtttcgccatgttggccaggctggtcttgaactcctgacctcaagtgatctgcctgccttggcctcccaaagtgctgggattacagacatgagccaccatgttcagcctttgcgtatctttttatccatcagtgaacctgggttgtttccatgttttagctattgcaaatcatgctactgtgaacacacgggtacaaatatccctttgagaccctgtttgcaattatttagggtatatccccagaagtggaattgctagatcatatagtaattcgacttttagttttcaaagaaccaccatactgttttccatagtggctgtaccattttacattcccaccaacagtgcacagggtccccatttctccacatcttgccaacccttattattctgggcttttttatagcggccatcctaatggctgcgaggtagtatctcactgtggttttgatttgcatttccctaatggttactgacgttgagcaccttttaatgtgtttattagccatttgtgtcttgtctttggagaagtatctattcaagtcctttgccgtttttgtaattgggctgtttggttttctgttgaattttagttctctatgtattctggatattaattccttatcagatatgggatttgcaagtattttcactcactctgggttgccttattactgttgatagtgccttctatttttctttacctatttatttatagaggtgggtcttcttatgttgcccaggctggagtccagtggcatgatcataactcactgtagcctcaaactcctgggttcaagggatcctcccacctcagcctcctaaatagctgggaccactggcatgcaccaccatgaatgactaatttttttttttttttcgagatggaaagtttcactcttgtctcccaggctggagtgcaatggcacaatctaggctcactgcgacctccgcctcctgggttcaagcaattctcctgcctcagccttccgagtagctgggattacaggcgcccaccaccatgtccagctaatttttgtatttttagtagagacggggtttcaccatgttggtcaggctggtctcgaactcctgacctcaggtgatccacccatctcggcctcccaaagttctgggattacaggcgtgagacaccatgcccagctgccaggctaatttttaaattttttgttagagattgggtctcactatgttgcccagactggtctcgaactcctggcctcaagcaatcctcccaccctggcctccaaagtgctgggttacaggtgtgagccaccgcacccagccagtagtgtcttttaaatgaagtatctctaattttgccactcagcatttaccagtcacctgccttcctggtccaaagaaactttttaaaaaaagagttggcaaatatctgaaaatacaatttatttttaagagccaggaatgaagctgaggtttgagggctggttcagtgtgtctgaaactgcgaagcagccagtgaggttactttcgcatcccctagcttttacctctgctcgtgagattcagcatctgcagctgtggtctgtgatagccgtgaatacagtctgtgtttggagacccacagagtcagggcaacatctccgtgctgggggccaagaggataacggctgttctctggctctgggaggcagcagaggtcacctgtccagagccagagttccatggggggctccagggcaggaggtcaaggtatgtgtgaggaaagaaccccaatttcgagctggacacacctaggctctggttccagctttgccactaatttcaccaagcgaccttggatgttatttaatattcttgggcctcaatttccccatctgtaaaaagcatgtcatagtcagggttgggagcaaggcccagagctggctcaacatgggttgctgtcccccagctctccgtcatggcgcctcgctctttctttttcattttcccattcgttcgccttcctccttctcccttctccctcctgtttgtctctcgacacctctactttcctagtgagcacccagactattttattttcccttccttttcctctttctacctcccctaaccactgtctttatctttatcctgccgggaacacacagcagcacccctggtgtaggcttcagagctgtgtacctatgccaggagagggggtgccagcctccctcctggaatcacacacacgggggtggcctgggaccagggactcaacacggtgcaggtggccggcaccatgggagatggaatgttccacccgagtcctccctttgcctggtaccccaaagagcttgggctgtgcccagagtgagtcaccagagagcctggccccaggctcagcagctggcgtaggagggaggaggggcctccccaagaaggaatgaggggcctccccaagaaggaatggcagagcagggagaggccgcggggagggagaaaaaccccgcagagggtgctcttacctctggcccgtcctccccagggccacctgtcccctcaaggcggctgccccctctgtgtcctggcacaaagttgggagatggagtggcagagcctgccctgggcttctcagcagtgcacagctcagagcacactttagagtcagccagccctgagtccagggctctctgacccttcgtgttgtcacctgtagcatgggggggcagcagtaccccttcccagggcagcagggaagataagatgagggagcgcaggtaaaaggtgggcagcccaccccagcacacagccgatcccggcacacagccgatcccggcacacagccgatcccggcacacagccgatcccggcacacagccgatcccggcacacagccgatcccggcacacagccgatcccggcacactgctggcagcagtgaggggagctcttcaacatcaccagaaccctctgccctgagaaaggggctcctgggccgacagggaaggtctgcctcctactctggaggggccgcttggggacaggcccgggctgtctcctcacagccacctgcttcctgtcctctgcctgtctcctgccccatctggccgctgctcatccaggaaggtcggagatgtcgggccctcccacctgggtcacgcgctaggcatgcctgagagcaaaggccacgccccgacaccccacggggccctggcgcgccaggcttctcagccctgcggcggcagtgcatagctctggcacgcgctgcaccaacttcctgttgggtgctgtggtcccaaggcgcgtgctttgcagcagatgtgtgacctggcgttcccctgagtgctcggaaaatggccttgtctccggtcgttcccgttcaggagcaggtacctggggtgctccggggatcccgttgtctaggatgggttttctgtctgacgggtgggcagcctcagctccctgagcagggcttaggtcccccgtaatgtccagggttaattgtgccagcctgaacccctgagccccgcatgcccgcctagggattggcctcagcctggggtgagctgaccccaaagacaccctgcccaacgcagcccggcccttcactgcttcctgttgctgctgctggacagagtgggcctggcacccagcagagatgtctgacggccgcacattctcccctggcttctgccttcatccctgggatgatgttgagggagacgccggaagatggagagccatgtggggccacctctgtccctctgcagggggcagggctggcagctcctggggagagccctgcccatcttgtctgctgtctctcgggaggccctggcctggggattcccatctctgagtggaaggcgcgaaggcccctgccttgaacatggatggcgtgggtccccagtccctcctctctcccctcccccttggggctgagcacagggcagtggtgggggataaagacccctcagaacacttccccaccctgcaaccccttgcacagccctgagtcactgtcccagaggggagggcaaggggctccctggtgatggcttcctgcgtcccctctcacttgcctcctccatttcccctgggcaggatatgggtgcagggtgtggtcttggagggaggaggctgtaagcctcctgggggacacagtgtgtgtgtgtgtgtgtgtgtgtgtgtgtgtggacggctgaagggaggaggccgggggcctgggtgtgcggctatggggactgaactgtcgagggctcctgctgcctccgcaggggacaggccctgccagctactgagtgagcagcctgcggcagccctgactcactgcgggtcgtgccgtctgtgcagcactggggtacccaccacccagtgccaggtgagcggccctgcacggcaccgtagtttccacctgtggtcactgagaggcaggatggagctagggcaggcatgggaattttttggctgtggtctattttttgttcattgcagcattgattacatgtgaatgtggactgttcttgcaaaagtctagacctgtcgtatttgtaatcagggaacaggcattgaacgttgctttgaagagattgaaatttctagcttgtgatcttcttgaaaattgttaatgaggcgttgatgtgatgtaccatcaaatgctccgttcggcagtcatgaccttgggcaccgtggttaggtcccaatgcttctgctgttgactgaaccatgtgacatctgtcgccgtgccactggtcccctcggctcaggcctcaggagattggaggagagactgaggtttctctgtgacaaacacagggaatcctgactgggatctccaatctctagtaaggtttgcacagttcttctcctcgcatttctttggctgcatctgagccaaagtctggatggagctgtcggggaactgggttatgttgacctcccaacccctgcccaccctctggggtgtccttctgacaaatgggcctttcttccagatccccatcatgacccaccaggccaacggccccctagggtcttgaccccagtgcactcagagtcagcacctgccttcgttgcagcattgaccctctgccatcagatcccacccagggaaggaatgggctcctgtgtgggcgcctggcttctgggtgagaggggaagtgtgtgttgtgtaagtgcccttctgtgtcatgcggttttgagcagttatacctcttcctgtctccgctggaagcacagtcactgccatggctcctctaggctctggcacgcagaacaagcagaccatggttttgtgttatacagtagtcacggcagatacttcgggggcttggcaggggggacctccggggttccagaagcaacatgcaaaataacatcagttcaacaagcaggtgctggagtcctcgccccgaggccttccggaagacacccaggacgtcacacctagcccagaacagcccccctctctccatcccttctgcgatgttcactaggcattaccacatgctggtggccgctctgggtgcgggggtacatccgtgaaggaaagagatgaagctccctgcccagaggagctgacctcccagcagtcttacaggatatggttacagaggtgaatctgggggagagtccatcgttggtgttgctccactgacctccaggatggcctccagggaccccgcctcctggtggccactgtccccatcgtattagagttggccttttgaaagctgtgagtccaagttgcctggcaaatagataaggaatacaaggtgatcattcttaagacctcggggatctgcaaaccagccttctggaacctttgagcttccaggatgattcggaatttggatgcagccacagaaagcctaagcgccacaagtcccgccatgacgccctgaggcgtgggttcacacttgggtgtggctggtcacgtctataaaaatgagccttcactttgggaggcccaggcgagtggatcacaaggtcaggagatcaagaccatcctggccaacatggtgaaaccctgtctctactaaaaaatacaaaaaaattagccaggcatggcagcgtgtgcctgtagtcccagctactcagaaggctgaggcaggagacttgcttgaacccaggaggcagaggctgcagtgagccgagatcgcgccattgcactccagcccgggcgactgaagagactccatctcaaaaaaaaaaaaaaaaaaaagatgagccttttctgggaaagtggaaaagacagagaagcctcctgacagccaaggagaccagcagccagtagagcaggtgttgtaacaaggccgaggaccctcagacaccaattttgctggtaagaccgctgcccaggatgcaccgtacaagagcagcttcacctgccttcatgcagatggcacagatgtccaggaagcagctgtggtcagtgactccccaggagtcacacccagacctggggccagagccatccctgcacctctgcctgatgtgacaccagggcggggcacaggctagtcccagctcctgcagcccccgctgcacacccctacctgttagcacactgagtcctccctcattatcatcccattttacagatggagaaactgacacagggaaggctgagagaattgcccaaggtcatagaccagcacatggcagagccagtgccaactccaaagcccagatccgaaccactgagtgggcctaacctccttcccaggaacccagactgatcgcctcaggtcacccaaaggggatggaatagtgtcatcaaccagctcccaaagaagatcagagcatgtgcagtcagcactggcaagatttcagcttagagagagatcctctccagcctcaaagtaccgactttggatcaagacttctcactaaaggaaggttccggccagctcaaattttttgtactccagaatctgcaataaagagacagataatgtcttttgcagaaactggaagtaggtttccaggtacccactggacttataattcaatgtttataagtatgaccctggagattaaatcaaagcagaacttgctccctggagccctggggttaagcgctaagatgaattctgtataatgatgctgctggtagctacagcgagcatttatttatcatgcactcatggagcagctggttccatgtcacagagaagctggggttgcctggtccaggtggggtggctcttgcatatgtagcagggtggactggggcgtgcctgtcccatgatcatggcagaggttcaggggcaagtctcctgtgactgagacatctgatcaccttccggtggccaaagcaagtcacatggttgcacaggagcgcaaggctaggaattcacccctccaacgtgtgtgtgtgtgtgtgtgtgtatgtgcatatgtacgtgtgtctgtgcattgtgtatatgtgttatgtatgtatgtgtgtatgtgtgtgtgtgtacatatgtgtgtatgtgtgtatgtctatgtgtgtatgtgtgtaggtatgtttgtatgtgtatgtatctgtatgtgtgtaggtatgtgtgtatgtgtgtgtaggtatgtgtatatgtatgtacgtgtataggggtgtgtgtatgtgtgtttgtgtgtatgtgtgtgtgtatgtgtgtaggtatgtgtatgtttatgtgtgtttatgtgtgtatatgtgtgtatgtgtacgtgtgtgtagatatgtgtgtgtatgtgtgtaggtgtgtaggtgtgtgtgtatatgtgtgtatgtgtaagtatatgtgtgtaggtatgtgtgtgtatgtatgtgtaggtgtgtgtatgtatgtgtaggtgtgtgtatgtgaataggtatgtttgtatgtgtaggggtgtgtgtgtgtgtgtgtgtgttgggagaggcagcaaagtcacacagcaaaggacatggatgctgggagaagtgaggcattgggtgtcagtaactccacctcccatacccttatgccctccctatgcaaatcaggtgccagctccatcaaccagaacatgtgggtaaccataacaggttgtccccacaccaggtcaaatcagaaagtgtcttctattattttgtgtctctgtccttgactcctgggctcagtcctgacctttccttgtggtttcttggcttaagccattcatttatttccttctctcacctgggtgcactgacttcttcccatctcatgcaagcagctcaggtggctccgacagggtacagattccctttgatgctgaggttgaaggaatcagagacagtgcccccaaagctcctactcagacctcccagggcacatttgcgcccaatataatagtcatttaccattaactccaacagagaaattgtggtcccaggccccccattctgcagatgagaaaactgaggctccaagagaggccctcgccttggttggctgtgcccccgggagttttgctccatttatccatttagtctggggctgctcttccttgtgtgtccttgcctagaattatgtatgggtccaccttttccaaaaatctgccagccctggccgggtgcagtggctcacgcctgtaatcccaaccctttgggagactgaggcaggaggatggcttgagcccaggagtttgagaccagcctgggctgcagagtaaggcctcatctctattaaaaaaaaaaaaaaatagccaggctgggtggcacacatctctgatcccagctaattgggaggctgaggtggaaggatcccttgagccccataggtcagggctgcagtgagccgtgatcatgccactgcactccagcctggggaacaaagcaagaccctgtctcaaaaaaagaaagaaagagagaggggcatggggcagcgtggagaggaaactgccagccctaaatctcatgacttaggcttgccccaggagccagagtcccataaaggggcactatgggccttccatcagtccctgaaagagtctcaccagcaatgccttcctggggctatggctttgatgacagttcaagacccccaggatccctttctgtgtttaaacaaacttggcttcctgtcctctcaccaactcttgcattcagagctcaaactggcaacatacttggcctttctagaaaaactgcagttgagaaaacacctccactgaggggtcataggggaaccgaatattcacacagccttcaagaacctcccctgtgattcctggttaatcatgaaaaaaagaaagagcagtggccggttgcggtggctcacacctgtaatcccagcactttgggaggccaaggcaggcagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagccaagatcatgccactgcagtccagcctggcaacagactgagactctgttaaaaaaaaaaaagagagagagagagaaagcaagcaagaaagaaagagaaagaaagaaaaggaaggaaagaaggaaggaaaaagaaaagaaaagaaagagctatgccctggcagacaccaccttaaccaaatggccagacctggtcttgccctcgatgggcaaacttgcttgttcgcccctgcctggacgcatgaaaaggaaaagacctccccaaaaaggttcagctaaattgaatcctgaagctacaatcagacaaatccaaagcaagggactgtcagcaggacagatgacctaaacgtttcaaaaaaggtcaatgtcataaaaaacaaaaatgaaaaatatggggggttgcttctagattgagagagatgagagagaaataaccaatgccatttgtgagccttgaatggatcccagatttttgtaaagctgtaggagttatttttggaataattgggaacacctaatagaggatcaggcgatattgaactaagtatcttaggtacaatgctggtgctgtggttaagacaaaattctcagatgagtgctgaggtattgaggggtggagctcaggggattgctacgcactttcaaacagttcagagaaaagtgtgtgtgtgcatgtgcgtgtgtgtgcatgtgggtgtgtgcgcatgtgtgcatgtgggtgtgcgtgtatgtgtgtgtgtgcctgtgtgcatgtgcgtgtgtgggcatgtgggtgtgcatatgtgtgtgtgcattgcatgtgtgcctgtattgtgcatgtgtgtgtgtgcgtgtgggtgtgtgtgcatatgtgtgcgtgtatgtgtgcattgcatgtgtgcctgtatgtgtgcatgtctgtgcatgtggatgtggtgtgcgtgtgtgtgcctgtgcatatgtaggtgtgtgcctgtgcatgtatgcatgtgtatgtgtgtacatatgtgtgtggagagaggaaaaggggaagagaggagcgggaatgcatacaagtgagacaagaggtaaacaattggtgtatgattgcgatcaagagtatatgggtatttattgctattctaattatttccacttttatgaggtttgaaagttttcaaagtagtgagttggtaggaagaaagaaaatgcccaaagagggagcctaccgaccttcctgggtcccctgtccttgtcagccaaccacgtaaagggaaagagctaggatttaatgaccggattccttcctgggctccaagcattttcacatcttgcttctcattgctccgtgagaagttgggcaggcctttctaaatgctccatgcttcagtttctccaaatctaaatccggaagatttgctccaggtcacacgcagaccaagtggaagtggagctgatgggagggacctagcctgtgggctccctgcttggaccctgggccctgcaccccgtcagctgctaggctcccctcttgggtctggtgtgttggtttctgaagcctgttctcccaagtcccggaggtgtcagggatcccggggccacccagcttagctgtgcctgcctccctctgcgctaaaggagccactgtgccagcctggaactcacggcatcccctttaggatgttggctccacagggattggctccttggcagatgcagtcgctcctgattggacagtggtgtctgcagctcgacaaggtggactctgggccagtcggctctgcctgtgtgtcttgcgtcctgaaatgcaaagcaggggctgtggggaaatctcaccaacccctcctcccctgggaggtggcaaaggtggtggactgggctgctgggaccctggggaggaatgaaacagaggctgtgttgatggcctgcagttccttgtaatgtggtcatcaaacggtgtacagttcccgtctgtggctgcaggctggagagctgactgctggcacagatacagcctgacctcgggtcaacacttctcggagtccagaggggtggggagtgggacaggtggcctcccagggacgcctccctgagtggccagtggtgccgcttgtccctgcacctgtagctgccctgagcacccccactggacacagtgggcattgcaccctccggagaaagctgcccttgttccacgtgcgagccctgtccccagcgccatgggctgtgctacctgcagtaacgcagactgcgagccccggctgcctctccagtgctctctctcctctggccttcagcaggctgggtcacagaggtatccatccactcattcattcactcaacaaatatctgttccatgtctactaggtgccaggcacagctgggaaccagcagacaaaactccctgctttcccggagccggcatcttggtgggcagacagcataagcgagacgagtaggtggaggagaaggcgtgtgagcaggtgacaggcgctggggagaaacagcccaggggagggaccagggagtgtgggggagacggggactgcgatgaaagggaggcgtccagggaagacctccatgagaaggtgaccttggcataaagaggcaaacgtgggagcatgctcaggcagaccacggtggtcagaagttgaattcaggccggaggaggaggagtgcatgaagccctgaggtgggagtgagtctgtctgctgggttcacagaccccccagggagccagtgtggcaggggccagtgtgtgaggggctcagcgggggatgtggctagaaaggttgtggacccactgttgagattggactttggctctgaatggaatggaagccattggaaggtttggagtgaagcagtgacataatctgacttatgttctgggaggatcaccctggccgcgtagagtctgccggcgggggtggaggtgggcgcagggaatgctgtgaggagcagcatgagagccggtggcagctgggcaggagaggagacagggagaggcacggggcccctggcccagggatggattggatgtgggaggcgggacgtgggaggaagggaggagtcggggtgactcccgggagtgggactgacacctgggagggtggggagctcgttactcatctggggccaccctgggaagaactgggctgggggtgagggcagtcgggagctcagtgtctgacccaggaatccgaggcacacgttccccaccctcatagctgagccacacaggcaggaaataaacagctctggggttcaggggagtggtagagggggtggggtctgcagcatggggacggggttcagagccacgagatgggtggaaatctgaggggctttgtggggatggaaaagaatatattcaagagctgagcaagggcagccactggaggacagcgatgagcaggaagaagcccaggagactgagaaggagtggctggagggatgagaggggagcgtggagtcctgggagctggggaagccgcaggcagcacctctgtcaccccgatacgatgggcaccgctggacctagcaacgaagaggtcaccgcaaccttggcaagtgcagtttccacggagtggtgagggcagaggctgattggagttggtttataagccggaagaagaagaggaatcgcagataagtgaaggaaaactttttgaggaattttctcaaatggaaggcgagaaacagtggagaagaaagtgggtctaagaaactgcttttttaggccgagtgaggtggctcacatctgtaatcccagcatttagggaggccgaggcgggcggatcacttgaggccgggagttggagaccagcctggccaacatggtgaaactccgtctctactaaaaatacaaaacttagccaggcatggtggtgcatgtctgtaatcccagctatttgggaggctggggcatgagaatcgcttgaacccaggaggcggaggttgcagtgagctgagattgtgccactgtactccagcctgggtgacagagtgagactctgtctcaaaaaaagaaaaaagaaactgtgttttttgttttctttggagatgagagaaataataacttattgggtgcagctggcagtgcgtcctgaagaaggaggaatgggcttgggatgcccttgagtgggtgtggggctggggacagccacgtgaccatggacactgtggggccggttcactgggtagccacaggagggaaggcaggtggctttgagcacagatcgtgtcgctgtgtgtggaaggtggcttctgattgcttgtgttttctcaggggtctgggaagcagcagtggcagctgagggtggggtgggaagggaggagcagcgaggtgtcccctgaacctgggagagaggatgccgtagagcaggtgcccatagactctttctgtaaaggaccagatagtaaataatttaggctttgccagccagccagtctctgttgcagctcctcagccctgcccttggagcccagaagcagcctgagaggattcgtaaacaggcatggaggtgttctaatgaaactttatttacaaaaataggcagcaggctggctctggcctgcttagactcctggccctcaacctcgcctctaggccaggggtcttcaaagcatggtccctgggcctgcagcatcagcgttacctggaacttgtgggaaatgcagattcttggacccccaccctatgttcatggaaccagtgactcagtccctgcactgttttccaacccaagttgagtttgtgattccggaattctggaagttagctcagcacctagacccaagagagagtgaagtgtggggtgggctacatgccctgttaaaggcacaggcatcccagcccccatccccttctgcaaggctgtgtgaggacatcctgcctcccgtgggccatgtttgcttatgcagcatccatgggagggctccctggggacgggctgtggtgatgactctgctctcagcagaaccctccactctgaagccctggtttcctgtccacgtccctcagctactcaggggagcctgggggcaggaactccattgcttgtaggggagcctcccacagcagcagggctcagccagtgttccatgcaagaagaaatgcactgtcctccgatcgaaagcacagcatctttaggagtttaacgacagttttttaacgactttagtgagatgatttgatttcctgcctctgagtcatctaagagcaaaatgcgtgagctgctaatgggctcaaagagaggctgcctttgaggcccctccagccccccagtgctgcagggattcaatcaccccaaagccaggtaaccagccttggcctcccaaagttctgggattacaggcatgatccatcgtgcctggcctgaatgagggtcttttttttttttttttttttgaggcggggtctcgctctgtcacccaggctggagtgcagtggcgcgaactcggctcactgcaagctccgtctcccgggttcacgccattctcctgcctcaccctcccaagtagctgggactacaggcgcccgccatcacacccagctaattttttttgtattttttagtagagacggggtttcactgtgttagccaggatggtctcgatctcctgacctcgtgatccacccacctcagcctcccaaagttctgggattacaggtgtgatccaccatgcctggcccaaatgagggtctttaagaataaaactccaggggatcgtcaccaagccccaccacttcctctgaggttagcatagtgctggatcttctctgcatcttctgtccttgtttttggttttcattttggtttacttgaaacaggatcttgctccatcacccaggctggagtgcagtgacacgatcatagcactctgcagcctcaatctcccaggctcaagcaatcctcccacctcagcctcccgagtagctgggattacagacatgcatcaccacgcccagctaatttttttattttttaatttttttgtagagactgggtctctacaaaacaaatgtctctgtgttgcccaggctggtctcaaactcctgtgctcaagcaatcctcctgcctcggcctcccgaagtgctggtattccaggctggtcccattttaccagcaggtctacacatgtgctcacatcgctcactcagaggagacctccgttattagggggacctagacctgtgctgccttgaccccagggacagaggttgtttgggaatcccctcccttactttgatttcttccgaggaagccggcttcctggtgacgggaggtcactgttctggggaaaaagagtgggaaaaacaaagccaatcagccacttggctaagtgtcaggtttcccaacaacttcatgggttgctgtggatgggcggggctgttttgagcccagaccatccctttgcctgtgggtgtgggaccacgtgattttggatcaggggtcatttgtccttccagaagccaagccctgttccaggcatgggggtgcagcagtgagtgagacccacagaaccactgccctcctggaacacaccccccccagagagggaactggggcaccacagacccgtgtgcaggcagcaagggcgtggtgtcggccggggagcagcagggacccctgagccccacagtcggggctcatggcgctgagaagcactgcagcaagggcgcagccagtaggagaggagccgcaagcgcaagcatccgcagacagtgtgagctcagcgtgctgggaaggcgggggcctgggtcaagggccaggcggcagagcataggggcctgggggggcagtgcctaggagtgggaggaaagagcatgggaccagattcactttggaaatagaagcccccaaccagcagccagccaggtggaggaaggcgtgcagagctgagagggttcaggaggcggtggggggagccactgggaggggacccaggggttcaggtgaaagacagcagtggctcagcccaagggtggcagccagagatgtgggtggacggctggatattggcagccatactcattatcaatgctgctgtaacagctcatcacaaaccctgcagcttccaactgcccagagtgagatctcctggttcttgtgggtcaggcattggggcagagcagggctgggtctgctgttttgggacccctgagctgcagtcgaggttcttgccgggactgggctcaccttggaaacctctggtaggaaaggatccacttccaggctccctcgttcgtttgaaggactcctttctttgggctgttgggctgagggctcagcttctcgccagctgtcggcccgaggctgccctcagttcctgccccaagggcctctccaacaccacagcttgcttcatcagagccaggagggacagtctctagcaagacagaagtgacagtcttgccattacctttgccgtgttctgctggttagaagcgacttgctaggtgcagcccacactccaggacaggggctgcccaagggcaggaatcccaggagctgcggacatcagtggcatctgagaagctgcctgacttaggagctcaatggcagcaccaggaagctgcactgggctggagtcagggcaagggacagtgtcagcgatgaccctgggggacagcagtgcagtcaggagctcagaaagtacacagatgccccctgggcggtctcttctgcaccatgtgggcagcagaaactacacctacggtttcagaacaacagttggggtggtgtggaaggacctccacgacatatagggtgggagtgtggagtgatggagtgtggaaacccttctcacagttgtcacctgctctccagcccctcctgagcccgtggacctgcctgcctgccgtgtgtctgtctgtcgtctgtctgtctgtctctctgctgaggggctccccgatgccctgaacccagacagcctcctcagcctttgtgatcccagagtctcccggccaaacctggttgatcttttttaaccaccaccctcttcccctcccttattttgcttttcttccagaattttcccactgtaaaaaaccgagcaagtctggataagtgaggctggctccatgtatccagaatcaacgacgggctccccggctcggctctcgctgcggcagacgggctcccccgggatgatctacaggtgaccccctgccccctcacccaggccccctcccagggtcagtcctgcttcgaggacgggttcccaaggccactgtcctcccctctggaggtggaagggcccaagcagggcccacaggcttctgccttccacggggttttgaggtgcacgctggtgagcgttttctccaagaaaggagcaggggctttaaaaacccaagtgggaaagaaaaaccaaaacttttccagggcgtttgagccagagtagactcctttcttgtccctgacccttccgaaatatctcgtttgaggttaacagagcggccggacagtgagtgcacggccaaccccggcatcctgttcctcccactttatacatcgcagcccctgtggccctgccagtttctcctgagcgaggatgacgaccttgcaggcctttggggaaccacgtctgccggtttcccaacactggagggagtgggggcggccaaatgctcctggggcatcctgaccccctccttgtggaactcacttccgcttgcagccctgggtgtttctgtctgcaccataaacagcgctgaacatcagcgacagctgcggagggcgttcagtgagagctgagcctctggggacagagcatagaacccacgaaagacgcaggcacaggcagtaccccagcagcccatcagtcttgggaagccagacctttccggataatcactggggcctgagccagagcccgtgtctgtgacagccacagggaaaggcagtgtctgtcctaagaagagccaggcgggcaggtgcgggtttgccagcacgcgggtgctctgcacgtctgggttggagggttttcagccattgcccacaagcatattgcaaagcaagtcctgaagcacattcaatccaaaccaaccctcactcggaggttcaccacggaaaacagggcctggcatggaaggagcccttggtgtccaggaaactggctccgggtctctgccccgtggccaccgggtggcgctgctgcagagcacttggcaccggctgcgcttcctcagagactgccctgagcaggcgactggtgggggcctgggggcatgggacattggtggttctttctgacctgcacctgctggggttgatgccaactgtggactctctctcttctctccctttctcctttttctcttttctccattgctgtccgaagtactcggtatgggagtcccaaaagacagctccagttttacaggtaatgagtcttcattctccctaaaacccagcgagccgaaggccagggagcgggtgggaggactgcacccttgccgagcagggtgtgctggtgtattctctgaagccaaagcccccgagacccccaggctctgctcatcaccctctgtgcctacccacaggatgctgtgcaatgtcctgatggaaaatgtgaagtcaggttaattgtatgtgttggtctgccagaagtttgctttgatttgagcaaatgggcttttgatgactgccaagctctcagccaaatctaccgttaaagcttcactcatcaggcagtgagggagatgtcttcctgtggtcaccagcttgccctgcttccattatcagagtacaggacgtggcgagcccatccgttccccctttgcctgtgggtttgacctgatctggaactcacagagctcctcaggctcattgaaggttaatgcctgcttgggggtgtgcagtactgatacgacgtggatcagtgacatctttctgatatgtttttctgttggtgaattaacaaaccgggcacctggcgagagactgtgccccagcaggatgtgacatcaagatgccaggcttagggccctgcagggtgctcttggggagacccgttcctctctctgggctgcctctccctcacctgtaaggcaggggatgcatgttcttggtgcagcctccaaccctaggaagtaaaatgtcagggctgcctggagcccatgggcagcagcctccccatgccttgggactgtttggggaattggcacggcttctggcagcaggtccctggtatgcattgctgcatcttggcggtcaggccgggaggtctctctattcggacccggacatctggtaacagtgctttggggatcgttgccaatgtgccaggcagtggtcatggaggtggcaatgtatttccatgtagcttttctctccccgcgcccccactccccacccccccccccgtttgccagccatagcacctctgatggggaccgtggacctagatgctcagagtgatctgtgccacgccttcagtgcctcctcggaggtcctgctccttacagggagctctgaagacatggccaactcttagatcctactgaaattttggtagataagattttgcttaagatagttaaatctgaactccggcttgcaaatgctttccctggatgaaatgtttgtattgtgatgtatgtacacatggtataacagatcctaacaaacatatgccgctcatcccaggggatttcatcagtgaaacaaaacatgtacctgaactgcatcctcagagagccgggagcagcctcagtcctcagaagggaaggggtgaggtctgatgagcaggcaggaaaatcccaggtgcagacctgccagctcaaaagggctgcccacaggtacagaccatccagctccaagggcctgcccctaggaggggccaagtaaattatccagtgaccaagtgagagccttccagcccactcaaggccctcaaaaccccacaggctcaacatgttgtcccccccgccgggatccctgtgcttaagaaccttcatttccaggtggccttcctggccccaagggaagctctgaagcttaccctctaggctctcagccccaattctggtgcccacaggctctggccatcctacccgttggatctccagggggtcacttgggtgtctcttgtgggggctctggagatgacctctaagggctagggtctttgtttgttaacaggctgggggccactcctagtagggcaccctcatcacaccaagcataccactaaacatggctattggatggttctttcagttacttaggcctggccctctcacagggcagaggcgttcaaggcatgtgccctgcccccatgcagctcccaggcaaggaattggcataggacactgtgccaatcagctgtccaccaagtgctgcataacaaacaactccaaaactcagtgccacgcagcaatcagcatctcttccttgctcccgtgtctgcgggttgaccaggcagctcgtctaagctggcttggctgggtttgtctccaagctgcaagttggatccccatgtcctccatcttcccatgcttaactggggcctaccccaggcatgtccttcccatggcaaaagtaccagaggaaaagcagaaacatgcagggtctcttacggcctatggttggggtcagagcgctgtcacctctgctcacgtgcttttggccaaagtaagtctcaggaaccagcccacagtcaaggggctggaaatatattgcccccaccagtgggaggagctataaagtcacatggcaaagggcatgggtacagagaggggtgaaggattgggagcaatacttccatgtaccccaggtctcaaatagccctgatgatctccagaaggcagagcacgtcacaggagaagcccaaagagcatttggggtccaaggaaggaggggccacagccagctgagagccaagaagacttcacggagaaggcagcaggggcttggatctggtccttgaaggctgggcaggattcaacgcagaggctgggaagcatattccagtagatacaacagcctgagccacagctcagaggtgtgcacagagaacaggaagtgacagttacccagcctgggccatcagggacatgatggagaataaagagaggctggctgtagaggtggatgttggtggggggcctcgaatgcctagcgatggggcacagatgcactcagagggcactggggagccatctatggtgtttgagcagggcaggggtcagagatctgctctaggaaggaagcctggtagcagggagtaagacagggaagagagaggctaatgcaaggagaccagacagtgcccaggaaaggtgcaggacggctgagctccaggaactgcacagagagagaatgaaggggtgcagggcctgaaaaaaggacgtcagaagccacgtccacagggcttggccactgatgggcaggtgctgagacagaaagggacagagaggagcagtggacccagggaaggagagggcctcattcggagcatgttaggctgcagctaccacccagtagtgaggcgcaggccccccgaccagggcgacatgtggggatctgacagagtgggcttgggcctttggggacaaaccatttcaattgccaaggccttcgcagctagtcacccgcagccaggcacctccagactctacgtgctctcccagcctcccacttcatttaccttccacactgcgactggggcactgatttcctgtcccccaccttcccccatggcagctaccactgtttgctcattcatcatggggggacggttctgcctccattcaaaatcccacattcactggcgcgctttctcagccggaagatgatgtcacgctgggactttgctggcatcctgtgacacgcagtgaccctgggggtcatgaccctggggttggggctcagcacttagcctcatcccagagctcagccttgtttggcctagtctcaaagcatttcccaaaccccaggtcaggacatgtgccgtggagaagggctcctgtgtccctgcctggagtgagtggcagtgtggagtccaaatagcaggttctggggccttcctgccatttatagctaccggtagtatcagatatacccatctcgggtgtatccccagaggacaggaggagcatgcgcgtgtgctgagcagaggcctctccagacccccttggctgtgggtggtggccccatacgacggggcccccagctcccctgctgcagacacagttcagagttgagtggtatgcggaagccacaggctctgtgtcccgcactcagataccaaagagcaaggcctgcccctttcgacctgtgggtccaaaggtttgtgtttctggcacgcggggatggtggaggcagcaagggtaggcctgagggacgggcaggacctccccctcaccttgggctgcaccccaaccccacgcaccgggagtcagccttgccaggttgcagcacggaactgcacttcccgagcttttaggggaagaggcactcgtgaataattcagcctctttcactgagatgaaaacgccctaatagaactaatggactcgctgcctcaaaactcgactctggtgggactcatctcattcaccaattgcttctgacgtcctgcagtgacactccctaatgaaaaagccgctgtgccagatccttagagtgtctggtgatccctaataaaccagactgtggcctttttaacgagcagacgcccccacgaaggcaggtgagtcctcccttcagccgctaccttcctagtggagatgccgcttgggggcacgcatccgcgggaatgaaaaataacagaggagaccatattttggggtggttttgtctgatccggaattagaccctccgtgtttttgcaaagcagaagaccttaaaaaagagccagcctgaggtaaacttggaatgaccgtgatggatggggtggtgggcggcaggtttcagccgggcagcacctctcgcttgagtctgctcacagcccagacctgcccaaggctgactgttttcccatctgccggagacacgggcgtctagctcgtacctcgctgtgttcaccattgattaagattcagcattttccagttttgcccagagcgctgtcagggaggtttggtcttgtctgaaatgtctgtgcaggaagcacgtgctgagggagccaggggctgcttgtttgggcctcagtttgctgattgtccttgagcgaaaatcattctgtgtttgcactgaagcaatgccgtgtcttgtagagccgcaccccggaatggtagcagctccccttccatttccgctttggagaactctggctgggctctctgctctctggacaggtgtcaccattcagaagagatgctcagggttccttctcaatctcaggttgtatgctttgttggctttcagtaaacagaacaattcagaaattccaggtagaggagtctggggtgaggtagtgattcctactgacttaatgaggttaacatcttccttgcatttttccatgtcacggtgttaattcacgtgaattcccctgggcccctgatctacaggaatagatttgcaccaggcaggcccagcccaggaaagaacttgtgggttccacgtaattagcaatggctattgaggaggggctcgtttttcttggtaccagggtggtgagggagtgtcagggctcagagaccctcactctggaaagcggccgggatttgggatattttgaattggaagtcaggggtcactgtgctcttgagcacaggagaagtggggaccctgaggcaggagcccggcagtggggccactctctcctccctgcagtgtcttaccggggggcccttcgtccaaggacctgacgctgctagagtctcggcaaaagcccagaatagagccccagtgtgagggagtccagaggtgtcctctgtccccaggcaccgctggtaacgggcagagcctctttgccttctgcctgtacctatccttcttcccctggggcagccctcccagagtcatgagccttcaggaccacagggagcccccgctgtacagagtcctggcatgggagtcccccccacacaagagagggtgacctgcaaagagctgctgggtctgaggtaggaagccagccccgcccccaccaacagctgcctggcactgccaggaaatgcccaggtatagccctggttggccttttggagcctgggccttggttactgttctacaaatatctgagcccctcctctgtgcacgggacactcccgtgggcactggtcagggggcagtggcagcaggcagaagagtccttgccctcctggacccaaccttcaggggagtccagcggccatgggctcctcatggcaccagccctgctcctcaccccaccaccccatgccaaaggctgccatttctgtgcccgcaagttccctggcccaagccctgccctggcaccatggggacaagctcgtagcaagaggctctgggctccctccgtgccgcagggctcccacctgcaggtctgctcccagggctgcaacatgagctctaaggaaagattgcaagcgggcccccacagggagggacgccctctaaatcctggccacaaaacccattctgtcctgccctctctcccctctcccactcacatccccaaactcggccttccaccatcttgttgtgaagggggcgattattcacatctgtgttctcttcccttaagcattttctagggagatttggtgtctgtgtggctcactcctctcactcaaacctgtggtcacaagttccttcccgccctgcctgctggcccctggtggtggatttttctttccacagcatttatcataattggtgtcttatcccacgccccccaacagactgtcttctggctgcgtcaccaactcccacccagttgtccaaagcctcatctcatgcagcccacagcagcctggtacaacaggcctctgcccagcctacctcacagatgtggaggctgaggccgggagcggtcaaggtgcctgcctgggccacaccatgagcaggtgacaagcagagctgcccctgtccagaagctgggcactcagccaccccgtcctccagccccggggccttggctatatttctagagccaaaccagacccggattgctttttgtgagtaatgtcttgaaagctaatggctattgatctcagcctggtcgggccaggcagggaacttgcgtgtctgaggctggtcctgcctttcagaaagagccctggggctacagcctgcccagctggccttctttctaaacacagacctcagggaagtgagggttggcccccatttgccccacaccggactggcagctagccacatggccacctcagaagcagctgcctgccacgcgcatggagggaagggagtggccggccagtaggcagggaagggaagctggtgctgctgtctgtgggtgccaagggcctcatttcctaaggtgaacctctcctggagtccgggcctctctgccctccagagcgattctcctggaaggcagacggctttccatgccagggtacccgcctgctttagcgtccagaggtccagcagccaccacccctcccagcatagaaatgagcagtggtgaatgcaactcctggcatgggaaccccccagcaagagaggacgacctgcaaagagccactgggcctgaggcaggaagccagccccgcccccaccaacagctgcctggcactgccaggaaatgcccaggtatagccctggttggccttttggagcctgggccttggttgctgttctacaagtatctgagtccctcctctgtacacgaggggcactcccatgggcactgagcagggggcagtggcagtggcaggaggcagaagggtccctgccctcctggactcaaccttcaggggagtgaattcagcacacaggacagctagaaaggaatcagcaaggtggatgatggcgagcgccatggagacagatcacagcaggaaagaggcacatggtgtggtttgtgtgggacagagggtaggatgggaaacgcagcccccccacccccgggagccatgcccatcagacagaggtgcagaggtgcagacagcacagcaggctccccaaggacgactggttgctcgcctttagggagggggccatccagccctgaccagggtggtggggccaaggcctgtgtggacactgctacccagctccctgtaggggctcctcgggggctccttgcctgctggtctctctttagctcttctctgagcccaccttccctacctcaattgcatgttcatgcaacaggcatttgtaggctctgctctgagctaggcctcatgctgggcacaacagggcagacatgaatgaaggtccctgcaaataagatacagacgaatacttgcagggaaacccccatgaaagaggcagctgtggggctcctggaggtggcccccctctctgggtgcacatataggcagagcagtgaaaggtcagcaggctggtcacccattctggaaggaccccagcacatggggctcatcacaaactcctgccccttgtgggtctttcctttggcccctggagctcaccccaggaaaggcccagcctggggcaactccaggacatctcaacccccttcaaggaccgtgctaaagcctctgtagctgcctcagctcccaggatagccctcccagctccttcccagggataatcgaacttttcctctcttggggcagaaggtggggacagtgctggttcctttccagctcccaggccaggttccaggatcccactgtgcagctgacccagctgaaatggtgacttcccctctgcaccttctctctctggtgatgatgcagagctgcagtgcaggccacctgggccatggccgaggctgcagtcaggtggggtgagggtcactggactggggacctcctttgtgttgagcctgcctccatgtcctcattgcgctgtcacagactctgcagggtgaggactcagccccgaggctgccctcactggtccactcactgttgtgcacatgaattaacaccagtggttgcgttctggacacacgctttctcccttggccttttaattgtccactatctctcagggctcactcactcactatgttgagatgcctcattcttgacagcagcacaaattcccactatgtggatggactgtcacttaggtaaccagtttccctactgatggacatttacattgcttttagtttccaagaatgtgcattcatcatttcagctatatttcagtggttcttcacatagaaactttgaaactcccctgtcccaactaagcctatttccccaggccactctcctccgcaacctgcttaaatgcattctgctcagtttttcttttgcaaaaagcatgaagcccaaagatctctgcggtgcaatgatgcgttcaacaagcagggaatgtgttgtatagatagcatttccctttacaaggctaagagcaaataggaccttcccatgttggggccacctggcatgcgggggtgaggtgcctccctggcataattacaggagagtttacttcagcaacaggtgtgccctgcgctgctttcccagggacagcttttgacccagttttaccctgggaaccacctcaagagaccaccatgacatggtaccgcagtcaccacggaacagcaaccctggtcttcagcatttggggggctcaggctctgcatgctctctgtgctcccgttttcatttggacacttggggtgcagctgtcctgcctggaatgcagctttgcctgtgcttgtctcacagatgcaggggacagaaaagggcagcttagccagagttcctggcaagcactgctttgcggactgagaatctcatgccaagaggtgtttacatccaggggccgggtcccactcctagacaccaagacctggtggtggcactagttaaaggatgtttcgctgcagctgccccctgccccagggccagccatccagcctggggcacgtggggcattggcacactgtctaactcatcaccgtctggacagtggcagctcccaagccaggcggcaccatgctgtccatgacgtacagcgagagtctgcggagcgtgagcagcaggtgccactctgaatgggccctgcaccccgtccgccagacggacacgctggaactgcagcggctgcgggaggtgcgggcggctgcccaggccaggaacatggagagcttcctccgcatgcacggcctttccctggacggctgcaccgcccagcgcacaggcatgaagtatcggtaagggccgggcaggggggcggtggggtgggaagtctgatttcagccatataaatatgtataaaagggctgggcacggtggttcacacctgtaatcccagcacttggggaggcagaggcgggtggatcacctgagatcaggagctcgagaccagcctggccaacctggtgaaacaccacctactaaaaatacaaaaaatagccaggcatagtggggcgcacctgtagtcccaactactcaggaggctgaggcagaagaattgcttgaactcaggaggcagagattgcagtgatccaagatcataccactgcactccagcctgggcgacaagagtgagacactgtctcaacaacaacaacaaaaatgtataaaggaagaaaatgaggccaggcacggtggctcatgcctgtaataccagcactttgggaggccgaggtgggtggattgcttgagcccagaagtctgagaccagcctaggcaacatggcaaaaccccatctctaccccaaaatacaaagaaattaggtaggcatggtgccatgcacctgtagtcccagctacttgggaggctgaggtgggaggattacctgagcccaaagaatctgatgctgcagtgagccgtgatcgcaccactgcactccaggctgggtgacagagcgagactccattgcgcaaaaaaaaaaaaaaagtttagtaaattctccatggggtaaaaatgtgtgggtgtgtttctccatggggaaaaatgtgtttctgggtgttggagacccctgctcttaatgataggcacgtaggtctgaattttcttggaacctccaaaggacattctttttagtgcgcttgtctttgaattcagcacctcggacagcgctctgctagccaccgttctctggctggtgtaaatccctctcaattgcaaattgacagctttatcttctgtgcctctcaggaacatgcccttgtgagagccattcagccaaagaggaccctccccacccagtccttgtagagttgccagttaaatttgaagttcagataaacgcgtaactttttagcataaatacgttccatgcaatatttgggtcatacttatactaaaaagttcctcattgtttatctgaacttcaaatttaactgggcgtcctgtgttttatctggcaacactaaatatctggcttccgtctgagacagaccctagggatcatctgcgtgctctgtgcagagtggagtgcaggccaggaccgctcctttaacgttttctcctgtggacggcgtgtttggtccttcagcccattgtttgaatatgtggttgtaatttagaaacaaaacacttctcctgtgagtccattagatggcagtgtttttcaggctttgtatcctaaatccagctgtaaaggaaggacaaagggtccgctagtttggccacagctgacctccttgttctgctggaaatttctcaagaaggagacgctgggcattcatgaggggctggtcattgattccttttgtttattcagtaaatgtttattgagagtctgcttggcaccaggcgctgagccagatcctggagctgctgcatgaacaagagcaaccaggtccccaacctcacggcagccatggcctgggggtgtggggggcagagaagcagcgagcttgcacggagacaagttccaacagcgaccactggccgaggcagcaaagcaggacaatgcaatgaagaaagaccagggaggccgagggggaaccctctgagagagggatcatctgaagatgtggagaacattccagcccaagaggagaggggtctggaatggatgcctctctcagctggaggagcgaagagaaggcccaggcggctaggctggagggaggaaggtggaggacacaaggcgatgatgcaggaggggccagaccccatcctccaaactcagggaaacctcagctctctcctatgtggacaggatttgtgatggaggatagtttagtgggttaaatcaagaccccccaaaattcacattcatcctaaacctcagaatatgacgttaggctgggtgtggtggctcacgcccgtagtctcagcactttaggaggcagcctgggtaacatggcgaaaccccatctctaaatacaatcaaaaaattagccaggcatggtgacacatgcctgtggtcccagctacacaggcggctgatgcaggaggatcacttgaacccaggatttcaacgctgcagtgagccctatttgtgccactgcactccagcctgggcggcagagtgagaccctgtcttaaaaaaaaaaaaaaaagaagaagaagaagaatgtgacattatttggaaatagggtcattgcagatatcattaagatggggcaatggggccatacaagactagaatggaccctaattcctacgactggtgtccttataagaaggccatgtggtgatagagagtggagtgacgggtccacaacccaagggactctgaggagtctcggtgttaccggtggagggtgtgcagccaggttcctggcatcttgaacaaagaattggacaaaacgcacatacaaagcaaggaaagaatgaagcaacaaaagcagccgggtgaggtggctcacgcctgtaatcccaacagtttgggaggccaagacgggtgggttacatgaggccaggagttcgagagcagcctgggcaacatggcaaaagcctgtctctactaaaaatacaaaaattaaccagtcgtggtggcgggcacctgtagtcccagctattcgggaggctgaggcaggagaatcacttgaacctgggaggcggaggttgcagtgagccaagatggaacaaaagtacactccacaggatgggagtgggcaagcggctcaagaacctggatacagaattttctggggtttaaataccttctagaggtttcccattggttacctggtgtacatcttatgtaaatgaagtagtggcctgtgatcattctgattggttgcagaaagtgaccaattagaggctgaaatgaagttacaaagttacacttctatgcaaatgaagacttggcccacagccagcctgattggttgcgggaggggacaaatcagaggtattttccatttttcgtctgccacacagaaaagggggcgccatgcaaagagagtagcctctggttcttttgttacttgggcgtggaaagttggggttttccttttgacttagttataggaaatcagcgggaattggccttcagttccctgcctccagaccctggtctcctgccccaacaggagccacgagatgctggaagggacaggaaaggacacctcatgagggtgtttggagggaacactgcccacacctggacttcagactccagaagtgggagagaagacattcctgttgttgtaagtcctctaatttggggatctttgtaatggcagccgcagggaactaacacaggtggagagaacatatcttttatttgcctgaagccccgaggaaaatgcctgagcagcctcggagacactgcaggtcccactgtggggctgaaacgcccttggggatctcgcttctcagggagtggaggagaccagaagacaaacgcttttttttttttttttttttgagttggagtttcgctgtatcgcccaggctacagtgcagtggcacagtctcggctcactacaacctctgcctcccaggttcaagcgattctcctgcctcagcctcccaagtagctgggactgcagggatgcaccaccatgcctgactaatttttgtatttttggtagagacagagttttgtcatgttgaccacgctggtctcaaactcctgacctcaggtgatctgcccaccttggcatcccaaagtgctgggattacaggcatgagccatctcaccccaccaacaaagtccctttagcagttgatgggccagaggttgttgttacacccaggtcagggtgaaggtggggcggggagggtggtggcctcactctatctggtgaatttcattttgctgcaccagggttgacggggtgggtgggatgctccgtgactcagaccaccagttattaaagatcccagataaatttattctgtgcttacctcttctccgtcagcgactgggctgggtcaccattaaacttggtcttaaatatgaatatagaaaagatgatacctggggataggcactgcccggtgccgcaagaaaccagctgtgcccctggcctgggcatttcatcagctgaactgagctgtagctgatggaggtggacggcagcatgcctgttacacttccccagtttttttttgagacagagtctcactctgtcacccaggctggagtgcagtggtgcaatctcagctcactgcaacctctgcctcctgggttcaagcgattctcctgcctcagcctcccgagtagctgggactacaggcgcgagccaccatgcccggctattttttgtatttttagtagaaacggggtttcaccacgttggccaggctgatctcaaactcctgacctcaagtgacccactcgcctcggcctcccaaagtgctgggattacaggcgtgagccaccgcgcccggcctacacttccccattgtttaaactgtcctcaattattgctgttaaaaagaattttaagatgaatttttaaatccacacagcccctgtgtaagcatgagggagcagggtgagggcagctggcctagcacacacttcccctcccctgtggacgttagggttcagagatgtggcctcagaatggcaggccagaagctgtggccgggcccacactgtgctgactggacaccagccctcagttcagctgtgttttcctctgctccccatggtgctgggagtgaacccaaactccccgcaaggctctacgtggccctagcctgcctccttggtttcaactcggacccctctccctcccgctcaggaggctctggacgccgccccttccttctgtatccccaaaggggaactcattccatccacagggtcatcgcactttctgttccctcttcctggaggctgcctccccagacgtggcctggttccttcccattgtcacatctaagcttggtccccaaagagactgtcccaagcacccactctaaacaagcacctatgaagtcatcagaagcccctctcctgagtgagtgtcttcctcacccctcctccatctcggttgccttgctctttgcccatctgcactgctttgagatcagagctttgtctgtccctggcacccggaacacccccagcctctgtgagtttaggtcggaaggcgctgcgtggtcttggtcttaatctactttccaaagcacatgtctcgttcgggctgcatcctagatggtgggaagacaggactgactggaagctggtctgaggctctctctgcagtccagatgtggatggcagggagcctctgcggtccttgggcactgacccttggtcatgaactcctggcagggcaggagtcctgatttcctgtgctttctgactctagatcccaggctcttaccacaagctcaggttcaccaggaagtacttggttggttgccaggttcattgagcagactgtagttgctcagttaaccataggccatcacttccagctgggaagagctgggaatccaggtgtgtcttaaaggacaggcgggaaggagggcactgagggcaggaggaggggaaggagaaaaacagcagagaccaggggggatggcaagttaacctgtctacaaggccaagtgcatcctgggaaagaggggtccccaaggaacggggtccatcttgggaaagatcctgttttactttcctgaggctgctgtaacaagctgggtggtttacaacagaagctttttctttcccagttctgggaggtgaaagtccaacggccaggtgcagccgggccatacttcctccgaaggccccagggagggtcctttttgcctcccccagtttctggtggtgccggcaggcctgggcattcctcagcttgtggccacatcgctccaacctctgcctctgccgtcccatggccattttctctctgtgggcctctgtctccaaatctctctctccttataagaacaccagtcatggccaggcacagtggctcatgcttataatcccagcatcttgggaggctgaggcaagtggatcacttgagtccaggggttcaagaccagcctgagcaatgtggcaaaactctgtctctacaaaaaatgcaaaaaatggccaggcatggtggcaagtgcctatgatcccagctattcctgaggctgaagtgaggatcactgagcccaggaggcagagtctgcagtgagccgagatcgaaccactggcactccagcctgggtgacagaacaagaccctgcctcaaaaacaaaaagcaaaaaacaaaaacccagtcattggattgaaggctgaccctaatccaggaccatcgcatcttaacttgattacatttgcaaagaccttgtttccaaataaagtcacactcacaggtatcaggaattaggatctcaactgtcttttggggacacatttcgacctgccacaggccccaaggattgactcaacaccttgagcctgcggggacatccctgagtgtcctgggaggaacccgggctcccaccggctacctgtgtgacctcagacaagtcccctggcctctccatgactcgatttccttacccggaaagtggagaccggggtcactacagcagaattgtcctgaggactaaataagctccaggtgacataactcaaagctccaggcttggctcattgtgggagagaaatgcaggcccttcccgtccctggaaaagggaccttcccacacagcagtcgctgtccaggcacctggactgtcccctgtctatccatcttggggtctcactcgtgcacctagtctcacttagagatgtagttcagtgccgcgcagacaaggggcggaggcatcaggaaggaacaggaggagggagggaggcgagcagccagtcattccggaagagctgccgggccagacgcaggggctgggagaaagccagctggcaggcccagtgctctccttgagggcctgcccaggaccacggctggcagctgtgtggggcttgggtcggggctgggagggcttctgctggcagcgggcaccacattggagcctcggtggtcatggtcatcccaggcctggaaacagcatccgtctgcagccccagcctctccagccccagcttccctaaagggacagaacagcccttccctcccccacagggctgctgcaggagaggtgggaggaaaggcagagagacccagactcctgcactgggtggttgccttgtaaccgactgatgatgtgctaggtgtttctggagctgacctggccacaggaatcacgggccatacctgtttttcctgttttttgttgttttttgtgttgagacagcgccttgctctgtcgcccaggctggagtgcagtggtgcaatcatagctcactgcagcctcagcctcctgggctcaagtaatcctccagcctcagcctccctagtagctgggaccacaggtgcgcaccaccacacctggctaatttttgtgctttttgtagagatgagtctcactaggttccccaggctagctgggaacccctgggctcaagcgatccacccaccttggcctcccaaagtgctgagattataggcatgagccactgtgcccagccacacctgttacactaccgatccccaggccccttcctggaggtttggggcatcttcccctggaggctcttcggacaagcaaggagagggagcaccacccatgtgctggcgccgtggtcattgttgttggtcttgttacgtctcaaagggtgcttctgaggacagaaggaggaagagaaagagaggtgctcgcttggggctggagagttgcatgggaaacagcagcaactcagagcagagccggccatctcacagccgcgggcctctctcccctttctgggctcctagagttggaagtgagtggggccatgaggtcctggtgagcaagaggaaggaggaggaactggctttgcagaccgtgcaaagccggttcccgggaagcacacacatggcctgcaggaggccttgtcctagcatcacctgcagcttcaagcacagtccactcagcccaaccacagaatgggccccgccagtgggatgtgcgctctgggcaaggctcacatgtcctgtcatcggtcctgtggcctcctccttccctcggcctcccactgtccctccgtgtcaagtctcccaccatctgatgcgccctctggcaaggccagtgagtcaccctactccagacacagaacctgctgctgcctcacaggctcccgccatctgccctcctgcctctgctctcaggagaaggacactcctggaattccacatggatcccaccttctccctggagccctgccatactcctgggcaccgctgatgcgctctcctgctggctgacttggccttgaacacgggtggctcaggcctttcccagggacccttgcttcatgccccagctggaggaagccacactcacagcacttagcccctatggggtcttcagctcttactctcctggtggactcctcctccaggaaggccaccggccctgcctccctttgttcttagaaactgctcctttggggcagcccctcaactgttcaacatcctctgcccttccttgggcaagaagccacctttgggtgtaaaccacactccgttcagcacggacaaggcggtctctgcaggatgcagaccctcagtctcactctcggaggagctgctggaggctgtgcttttaaaagccatgtcaggccaagcgtggtggctcacgcctgcaatcccattactttgggaggcccaggcaggtggcggatcacaaggtcaagagatcgagaccatcctagccaacatgctgaaaccccgtctctactaaaaatacaaaaattagctgggcatggtggcacgtgcctgtagtctcagctactcaggtggctgaggcaggagaattgcttgaacccaggaggtggaggttgcagtgagccaaggtcgcaccactgcactccagcctggcaacagagcaagactccgtctcaaaaaaaaaaaaaaaaaaaaagccatatctaaaaccttctccagaccttgagccctccacaggcctcgttctgtgcatgagagggcatccgcccccttccactgcgagcctgttgccattgtaggggaggagctggccggccccagctttccagcctctccaggcccaagggggaggagtggaccccaggcactgagccggaagcctccgctacagcagggatgctgtctgtggtgcactccagggacacagagcagagcttttaatgggggtggctgctctccagtgaatcacagcaagagctagctgcttcatcttatcaacagcaggtaccggagagacagaaaaagaaccagaaatgggttgtaggttgaagtcaaccagccacgctccatgcctctgaccaaagcctaccagcactgggccgggcggtggctcacgcctgtaaccccagcaccgggccgggcgggggctcacgcctgtcatcccagcaccgggccgggcgtgtccccacacatgaatgttccaggcttcccttgtctggacgatgtgatcagggagacaccatcccagattctggctggtaacagagcaggcctcctcaaccctggcaccattgacacttgggctggacaattctctgtcatggggcagcatccgtggcctctgcctactgccagtagcacctcctgcccagttgggacaaccaaaaatgcctccctatgctgcccagtgttccctggggaacaaaacccctcccaggtaacatgcactgatacagagtaatcatctctgccaccaattttcacagattataacggaatataatgtgcataatgcaaaaattatattgaattctttttaaaattaccctccaccccaccttattccaaaaaggattgtaggtgacgttgttaaattaatctgctaccatgaaatttttaaaataaataatagcaaatatggggaaaatggaaaataagggtaggtcagtaaaataagtcggtggtaaaaataaaataccaaattcacccactagatgaccaggcagtgactggtgagggctgtgtgttttatacagactttccggcaaagaataaacccactgattgcttagaagtccagtgtcagccaagcgcggtggctcacgcctgtaatcccagcattttagaagcccaaggcaggcggatcgcctgaggtcgggagttcaagaccagcctgaccaacatggagaaactctgtctctactaaaaatacaaaaaattagccgagcgcggtggcacatgcctgtaatcccagctactcgggaggctgaggtaggagaatcacttgaacccgggaggtggaggttgcagtgagccaagattgcaccattgctctccagcctgggcaacaagaaaaaaaaaaagaagtccaaaaaaaaaaagtccagtgtctctaaaatttctaccttgggttctcaaaaaagaacacaatgtgagctaggaaacgccattcccccagtaagtgggcatttgtctagcagctgtttgtgtcccttagtatcatatcataaggaacataaattagtctttcctgggtccattgatccaatatttattgaaggcttttgggcacgtgacatggtgctggacggtggagacaccaagatgaccacatgcaaactgctccccaccccctggtgtccctgggaagaacatggtcagtggcgctcggagaagggaggggttacttgtgctgggggcctagcttcatagcgcacacacactgtctgagctgatgtcacaagtgactccgagttcaaaggcagagaaacaggaaaggcacttccacagggaacagcaggaatagaagcccagagggttttcaggcaggtgacttttttgggggagatgggaacagctttattgaaatataattcacgtgccatacaattcatttaatgcaattatatggaattaagtgcaattcagcagttttcatgtattcagagctgtgcaaacattgccacaattttaggatatgttcatcaaccccagaaagaagccccatacccttcaactctcactccccattcccaccccctgcaaccaccaagctttctgtctctacggattcgcctatttggattttttttttttttttgagacggaatctcactgtcgcccaggctagagtgcagtagcgcaacctcggcttactgcagcctccaggtgcaagcgattctcctgcctcagcctcccgagtagctgggattacaggcgcccaccaccacacctggctaattttttatttttatttttaatagagacggggtttcgccatgttggccaggctggtctcaaactcctgacctcacgatccacctgcctcagcctcccaaagttctgggattacaagtgtgagccaccgtggatatttcatatgaatggaatcatacgtgttctttcatgaccgtctttaacttagcatcatgttttcaaggttcatctgtgcctgtgccagtaattttttttttttttttttgagacagagtcttgccctgtcacccaggctggagtgcagtggcatgatctcagctcactgcaacctccacctcccgagttcaagcaattctcctgcctcagcctcccgagtagctggcattacaggtgtgtgccaccacagccagctaattttttgtatttttagtagaaatggggtttcaccatgttagccaggctggtctcaaattcctgacctcaggtgatccacccacctcagcctcccacagtgctgggattacaggcatgagccaccacactggacacttccttctttttatggctgaataacacttcattttctggagagggctacatcctgtttctccatttgtcggttgatgggtgtttgggttgtttccagtttggggctattgtgaataaggctgctgtggacatttgtgttgaagtttttgtgtgggcgtatgttttcagttatttgaggacatagctagcggggggattgcctggtcatgtggtgaggccgatgacattttacacttggtgactgaaagtctcgtgagtctccctgaactctgtgctgcttaacgtgcaccactggggtaagaacacccctggggaagagtaagatgccagccattgtgggatccgatgttgccagcctttgtgggatccgacggtttaccagagtgcagagaatgcgtaaggaagaggtagaggatttctgcgtctcactaggccagcatgcgtagcaccacttgaagctcttggtagaaacgccgccttccgggctgaacaccgccttctgggctgggcctcagagccactgattccgtaggtcagggggatgcccaggaccctgcctttgtaataagttcccctgacatgatcagatgttgaacagccctgtcctagacggtgagcgccatgagagcaggtgccttgtgatacacagtaggcacccagaggctctttgaacaaatcaatgtgatcctttttataaatagggaagggggctgttgaaaaattctgttagatagtctgagcaaattccatcttggccctggctttgcacatttaggggaagtagggatgctaagatttgctgctggtcacaccctataaagagcctccaagtagggagaagggtagggggcaaaagacttaacctgagccctaggtaggggccaaaggtggaatggttgccatctgtgcctcttcagcagcccatgagctcccgggaggccagggctgtggcctttgaatcctggggtccagcctcaaggaggggtgggctgtgcatagggttgcctatcccccgtcaccccaccaccttccagtgcccttagtacctcctggcaggacaagagggggcccagaaggcagctctgaccagggtccacctgcagggtgtgagggggacacttgggatcagagggcagagccagcccctccggatgctgaagaggatgaagtaaagtagggcaggggcttcattcagccattcactcactgattgcagagtatgtattgagcgtctgctgtaacctaagttttactgggagtgttggaatctctctgtccctttgacccccgcgtttccttccttgggccatctgtgtcataaccatcaagacgcagtggcttcttcacatttctggtgatgttgcttctccatgtgccaatcccccagcggataccccactctccggagggagaaccccaagcaggtgccgctgggcatgcgccagggaggctgtgaccggagcaagcactgccttgcttggagctggctgcctacaagctcagacatccagcccgcagagtccaccctggctgcagcgcctgcccaggcctcaggccagtcctggctcagcagctgtcagcccggagcagccagcgatggcctcaggggaccagccaaggcaggcggcttgtgcatcctgcttcattaataatgaatggccagacgctgcccgcgcctctccctggtcgcctcattgacatggtgggagcctcagccgcccacagcgcgcagagccaggagctggatcccaggccccctcagaaagactcaagaagccccgagaagcagctgctccccaagaccccctgagctgctgccccagaagagcagtcacagcggccctgcgcagccccccaggccatcacctccggctccacaagtgacaccagagagagccctcccttctccagtccaaggaaggcgggtgtgctcatcacccgtcactcatcatcaggagtaactcacagcccagccctgcccaacacttttggagactgttgggctgaggacttgggcagccagggctggttgagggtggggacagaggaaggacctgcagagacgagagatgtgaggggaggagaaaatgcgcaccccccaacctccagccgcgcttccagcaggtcttctgtacctcgggcctggaaatgtgactccctccctcagagctgtgcagccttcttccccaccgttgccttcggaaatcctcactcctcaaggaatgcctgcagcttccttggcttctggataaagtctcgtcctggtcgggggagaagagtttcttggggacagatggctcctgagcccaaggggacaggggacgcagccaggatctgagcacccggcctcagcatgcaggtgtccttcgtttgctcggagcacagcctcaagggccggggccctgaggatcggctgggccgaccggcggccagcagtcccagcctgggctcccgaggccgcttccgcgccgtggccatggtggcccggagcctgggacagctgtcggtgcagagcctcccgtgtgccggtgacaccagcgtgaagcagcaaaggatgaaatataggtacgggggcacacagctttgcagggtgggggctgacctcccggcctccccaactccccacctcctcactttcgagagcgcataaaatctgcaaatccccatttgtcagacttgggcagtttgtgctgagggccgggaggggctgtgcttagtgcttggtagatgatgagaaacagcgtggagaatccggtcagtgctaagtttctttcttcccagtttcagggggagatggtgagggcgccgtcttccttccttctgcctctgttttctttctgagggtcgtttacaatagccaagccaccaatgctcccttttcctggggaaccctgaggcatgggccacagggcccccccaacatcctcctgccctcccctgggcacacaggctccacaagatgccctgggggtggtctgatatctttccagccaggccaccatgacaaacatccgtttgatagtgagggactgtggggtgaaccctgtgatggaatgaatcttccctcctccacctgagccaggcccagggcccaattcctctagcaggcgggactcttgctccagcaggcacaggcagccaggccgcatctggagtttcccgatggtcagcccaggcaccttgcttccctccacccgggctcagcccccatctggctcccggtgctgtgacttgtatgtggggaggatgccgaccactcatgtcaggagcagggcctccctcctcttccctgccggggcctttctccaaggctgggtgaatgtgcccaggatggaaaagggagggtcccagctttgtacaaagggtcccgggagcagggttctggggcacccttctgggggccggccttcctcactccccatgtaagtctctgagtccagagccttgattgcgtccagaaccatcctccaggcataaaggaagtctccacaacacgtggtctacagaagctggaaaagctaaattaggtctctggttcccaggtttcctgggaaagttttcccaaaacaggaaccgaactggggacaactctgcttttcagtgacctgaaactggagtgcaggccaccagcctcagaaacagccacaaactgttctcattgcatttgggaatcttctgggtttatagctggtatgggtgccaacctgaaaagcattgtgagtccatcctgatgcctgagctgtgtggcttaaacctctacaaaaccaatgcctgagagttgggcctcgtgtgaaaaccgtgtcatctaagccaacccttgctggaggtgaattctgggatgactctgggggtcctgcatccacattcgtgtctcttccttccctgcgtcctgggagggtgagacatgctttaatgaacctctgggctgaaagtgtccaatcctctaagcttaatgacagtccagaatggaattctctgttctagaagctctggggtttacatcttttgttaagtagggatcaaaagctaaaattagagccaggagaggtggctcatgcctgtgatcccagcactttgggagactgaggagggtggatcacttgagctcaggagatcaagaccagcctggccaacataatgaaaccctgtctctaccaaaaaatacaaaaattagctgggcatggtggtgtgcacctgtagtcccaactacttgggaggctgaggtgggagaattacttgaactcaggaggcagaggttgcagtgaaccaagatcacgccacagcactccagcctgggtgacagaatgagagcctgtctcaaaaaaaataaagctaggagtaaaccgaacatgtatatgtatattttttggttcagatacctattgccttctgcaacttttatgtcagtcctaggatctcaaaggagttaaaagcgggactatttctaaacataaggcactatgtaattggaaagtgtggctgttaacactgtttccctcctaaaactcattgaggagtggctctcagagggtgaatgctcaccacgcccatgtgtgtgcttatgtgtgcatgcacacacgtgcgtgctggaggcagggagggcaagacagggcagtgaaggggggtgttcatcaggctggcaggtttgcagtctgtggaccagagttcaaatcccagccctggcactctctgactgagggcgggtttgcagtctgcagaccagagttcaaatcccagccctagcactctctgactgagggacccccatctctccagtggagttgcaaacaccgccttatacctggccaggcctgggagctttccttgctgctgtcacggcgggagggtaggttcatagccctgtaggatgaggtgcagtttcacaggggctgagatgggccttagaatccaaagcctgtgccatcgggcacccccgccccgggcctctcccatcccactcatgcggtacctgcgtcatgagttgctgcacagggactgtcccagggccacagccagggtgcaagaggggggcagcagggactgagggggagcctgatcccagcctccctgtgactctggcctcctccctgggaagctggcccttcccagtggtgtgctccaggcacagctgtccagtgacacgcacagtccacaggtactaggaaactaaaggtgcatggccagtaccaggcgccacattcttgcccaagggcctaaggcgtgctcagtgtaggatggcgggaggccaagcctgataagtaagggaggggccagcacttggtcccgagagtctgaccccagggcctgggcttctcacccctgaattactacccaacatcgtcccaaacaagcactccctgggaccctgccactgccagctccaattagaagacaaagactggaagcccagcctgtccttagggagcctggaatctcggagcagggcaggcgtgcaaacatcatcactgcacggagcagacaggcgagcagggcactaacaggagccaccccatgtgccttcctccgcaaccagctagccaaggccacggtgcttgcccttcacctgatcacagttttgtcctctgcccaggtggctccaatgaaaggccccaaactcctctttgtaaaatgacctgtcatttcccggagccttccagctccggcccttcccaagtctgaagtgcagtttttaggggtgtgcagcagccgggggctccacgatgggcatcagtgctcccctccggcagaggttatgtctgtgagtcctcactccaggagtccagaccccaggagagacatgaggcaaattaatgaagaccgacagtatttgggtttcgagatgttgaccacctgcttcattaggatgtcaggtttcaacgatggggaagaaatcggtagaaaatgatctctgtgtctgggaagtttcaagtacagcagggagcagccccatccagacccggctgagacgtgtgctccccaccccacacgcagcagccatgcttacaaagcgttcagcctggaggcgccctgtcccttcgcatcccttctcccgaggcctggcagcggatggcagaaccaataccatcattttcacagggaaacaagttgagcagggtaattgcggcatcacgtggtgccctagttttgttaaattagtcctgtgggtggtgggtggaagagcggctgaacccagagcccactcggggaagtgggcccatttcccaacactcagaccaggaacagatatggaatcaggggcaggggcaccttttgccagccctccccaaactggtgaccaaggggtgcctcttctcttcagccctgacctggccttcagcagagccttttcaagcaactgttccccacagtcactcgtggaggtggttttgcagaggtgggggccaggcctcccttctcgatgcccagacatatctagaccagtggggtccagggctctgtgaacacccagacattgcaagcaaggttcgttctgagggcattcgtatctaggcatatttccaggctttatctgtttttgcaaaggggttatgaccccaaagcagctgagaggcactgatcagaacctccagccctttgcttcattattggactcctactaagcatttataatttcttaccacagttactttctagccagcatgggggaaattacctaaacttctaaactgaccaggcttatgtggaatgtattagtggtacagttgggctgttctccccagcagccacagacacgagttattctgggttggaacatgccagcaattcagagggtactatcaagagtatttcactgatgtataaggaggaaaaaggaaacttcagttcctttttaacatggtaatagttaaagcttatttgatttgtccattgtttttgaataaagaaaaggttaccctcctgctctctttgggaaatgagacacatgtgagtcagtgtcctgtggccttctatcctcatggatcttcttctgtcctcgtggcagccaccgtgagaaaggcagcctcgtgagcccattctgcagatgagaacactgaggcatcgggccactccataaaatgcccggtgtcctccagccaggaaagttgtaccaggatttgggctctggcttcagagcctcagcccatagccgccacccggtgcgcccctttcctgaaagaaaactcagcttttcttatgttctcctttagggaaaatcccagctctgcctacaggagcaatattgctggcagctggagtggttttaataggaaattgaaaaataaacctaggcaattttaaagtaccttcagtttggtgacacgttcaactgttttcaagctgcttacaaatattatatccactcatgagttaggagtccaggagccttataaccagggaaaccgaggctgagagggacagagtgggctcgtgtcagaagtcgggggttcagaatgaggcttgagccccatgccgccttcccaggggccaggcttggacaggaaagaggataaactgaggacatcgcatcctccgaagttggaagtgtcatggccccagggaaatgcagggcccttgggccaggaggctgggcctcacccgctggtaactcatggctctcactccccaccgcctagaaccagctgccccttgaccagatgctggcagctggattccacaagggaagtggaatctgaccccagatgggtcaaggcctggctgcagctgtgagatccacccggccacttgtcaacctcaccatctgggcagatcacgccctgcttaacaggctggggtgtgggatgcatgccaccatggtggggaacgtgagctggcagccaactgcctgggtgggatccagctcctccgcgtgctgggcaggtatcgtaacgtgggaatcgatgtcacgacaagcaaggcgcctgctgcgtagggcacctgccgcttaggactcctgccaccgcgtagggctctgctgcgtaggactcctgccgccgcatagggctctgctgcgtaggactcctgcggcgagggctccctcctgccgcgtgggctcctcctgccgcgtgggctcctcctgccacatagggcacctcctgccgcgagggcacctcctgccgcatagggcacctcctgccgcgagggcacctcctgccgcgtgggctcctcctgccgcgtagggctcctcctgccgcgtagggctcccgggaggatccggggacaggatgcctggggactgcctggcctgctgcaaccctgcaggctcctaggcaacctgtgccaggacatacgggcatgccggtcctcagcagagggctgccaccctccttcacctcctaaggacagtcatgatggcccaaggcctgttcctgtggaccctgggatgcaccacagtgggcaggtgcctcagtggccccgggaaggagcccgggcagctgtgcttggttaggaggcctacgctgccaggctctgccgctgctgttgggcctggctgtggctgtaacaaaggaagggctggccttgcttgagaactggcagccctaccatggagctccccgcaccccgagggacagatgcacaggccatgtggtccagtgaagtgggacgatctcctgccccagtcgctggagacaggaagaagagacacaaaatcacaaatgcagccttagagaggaaggaagaaggggcttctctgcaaggggcgccgcatggatggtgccatgggggtgagaccagtccagtttcgccataaaacagacagcgtccctgtgcatttccatctgtccttgagaccactctgcagacccccactgggcaccagcagggcccgtgccagcagcatggtgtgggccgggggcagttggcactttacccccggggtgggtgagcagaggcacctctctgaaggtccccggtgcctttcggagcctccaaacacacattgactgttgggggagtgggtggggggctggccctggcgggaactgagcctggctggcagggtcctgcctgggtgctgagaactcacgtggcgtttgtttttcaggaacctgggcaagtctggcctgcgggtctcctgcctgggacttggtgagtgtgggggtcccctccgtcccaccagggaaacaggctgtggggaggccgggcatggactgaactggacaccccttgggaggcagggtggcccaaaccttggcactccccagggagtagctgcacccagagcccaggattcaggggggctcggttgccatggcaacaaagaggcaggtgggaggggggctgggatagagggagagagacacagtctcagcagaggaggtgaggcggatactaggggcccctccacacatggtccccaccccacaccacaaaatcagaggcccttagggccccgggagtgcaacgaagacaccttaccttccaaggcaggctcagctcgtgagtccctcctggagcgccattggatttggccctttttcctctcctgtcagatacaaggcctgtttccagaatgtgcagtccccacctcccctctgcatgcagtacacacacccccacacacacaccgcccactgcagtacacacaccccgccccccaccagcacccactgccctgacaccgccctccccgctctgtcccagcaggagcacgcagacgcggctgtcagacctggtgtgttttcagagaggcatcccttgtgccatttcttgcggcatgtccttggaactagagctgcctcagtacagctctgaccagcatttcaaaagccccagacctcctggacccatagccagcagcccgctctagagacttttgtcccctcagtttattgaccccaggagagcaggactttctctgaaggccagctgtccacacacactaaggacaccctggccacagagcagcacagagggacacctgtggctgccccctgtgccctacagcctgaggtctgagcaccgacgggataatctggcttcctgccaggttcctaacttgagcccctgtgtctccttccaggaacatgggtgaccttcggaggccagatcaccgatgaggtaagatggggctctcccagcaccccagaacccagcacgggctcgccagagcacatggttaagtctgccgcgtggaccagtgagcacgtgctcccgggagccagcgcagcagcctccctccctctttctgttttgtgagggcgccctgccccaggggagagtagaaaggtgagccaggtggccatggccagaggggatgccgagtctggtgccatcacccagcagtggatgcctcgggcctcagcatgtcccttaagctccccaggactcagatttcccacacgcgtgacccccattccacagttaacgaggagaattcagggtgcacacgcttcccaaattctgaagccggatgcaggtcctagctgcccccatggaggctccagtaactgtctgtcttggtcattgggaatgcagcccctgcagtgtcacaagctgaagaacctgagatctgcatttcacccaacatccactgtccatttcccagctgccgcgaaccgtgcggatcgcagtcagatgtatttgctggggctcatgtccccacaattggaacaagaaagtgaacactaacaaaaagccagcttgtatgccgccagcgcctctgggtctctcggaaggacagggacggcacacgcccagacatgtgtgcttctggacagtgaggcagcatctcagaaatgagagcagtggcatttgctcagacagctctgggcatctgcacaagaagcagttttcacatttatcctacttagcactagaaaggttgcgtttaaaaattgatcagcgaattgatgtgagaccttgttagctgcgattgctcagtttccaagggaaagctttgcttctatcaaaatttaaatgcgtacagtttgtgtttgaggtcacttttatctttaagacactagctggccgggcgcggtgactcacacctgtaaccccagcactttggaaggctggggcgggcggatcacctgaggtcaggagttccagcctggccaacatggtgaaaccccatgtctactaaaaatacaaaaattagctgggcgtggtaggggcgcctgtaatcccagctactcaggaggctgaggcaggagaattgcttgaacccagaagggggaggttgcagtgagccgagatcatatcactgcactccagcctaggccgtagagtaagactctgtctcgaaaaaaaaaaaaaaagacaatagctggttatagaatgatttgccccttgctttgaagttgctggataggcgctatctcagggtgaagtctggagttattaaggcaaaaggaattgccttacctcagcccaccagattggttcagttggagccctggggcccatatggttcaatctgaatcagccttgcctgacttggcctcgtttccctttcgatgtggtttctaaaccaggatgggagaattctgtagaacggcataacttcatttccaaacaatattagctgggtggcctgtatgtccttgtgggaaagataaaaacaagcagacagactagacccatccaatgagatgacgttttcaccagcaaaccaggcatacccttagagcattaatgaatggcccagtggcagccccgctggcccaggcctctgcagtgtctccatcaggaacacagtgatggacatgtgtgaagatattggaggtcatttctagatgacaccaagctggaaggacagagaataaaatagatggcagtgtcagggttctgaatggttgtggcaggtgaaaatggcttagcaaaggagcaagacaaatttttgtattaatcctatagttagtgtcaaaaaagaaatcaatacatctagaagggggggcccgcctggctgcggttcagatgaaaagggtttgtgcacttcaggtgctgcggctcagtccgagccagcagggaagcaaggaccgtcctggactgctttttttgtttttcagttttttattacatatatgaaacataaaatttgccattttaaccatttttaagtctacagttcagtggcattaagtacattcacatactgtgccacccttaccaatatctgtttccaaaatatttcatcaccccaaacaggagctctgcacccttaaacaacaactccccatcccctggtcacctctagtctacttcctgtctctatgaactctgcacactgtttgtataaataaagttttattaggacatagccacgcccatcatttacacatagtggctgctttcactccacaagggcagagctgagtaattgcaacagagactctctggcccacagtgcctgaagcatttactatgtggccctttacagaaaagacttgacgtctcctgttctttgggccgcagcagctgtaccctgcactatctgcagggctgctgtgtgaactgctcagcccagttctatgccatgccagggacaaaatgaaagcttgcccaggggtggaacaaaccacctggtgaggcaggaatgacagccaccctcacatggcacagggcagagtccacagtttgtaggacaccatcacactctcagccagtgctcacaggagcccatgaagggatcaaactatgctaggaaccctaaaatgacgtaatgcctgtcggagccaccacggtggtttcaggtctccagccctcccattgttaggtgccctttctgtggcctcacactccccattagaagcatgtgttcaagacaagctggacaataaaaatttaatagatgtaatggttgagaacctaacacttattatctcacctaatcctctatcaacccagggaggcaggtgctattcccagttcagggaagctgagcctctggctataaacaggtgcaggggcctcacctggcctctggccacagggggttccacctggtgctctttgcctcaacgcttgcggccagtgctcagctgtggggtaaccgtactggggtagggacagattccttgtccccccagatgagggtgacagggaggtggcctgtatgtctcctgagcttccttctgacttcagtgtctgggacccagatactggaaggaaccaaaaagtcacaacataaaggctgcgtaaactgaaccaggatgcagccacagagcggagggctttagaagtcatgttttaggtctaggggcggtggctcatgcccgtaatcccagcactttgggagattgaggcgggtggatcacaaggataggagttcgagaccagcctggccaatatggtgaaaccccatctctactaaaaatacaaaaaaattagcggggcgtggtggcaggcacctgtaatcccagctactcaggaggctgaggcaggagaattgcttgaatctgggaggcggaggttgcagtgagccatgatcgcaccactgcactccagcctggatgacagagcgacactccatctcaaaaaaaaaagaaaagcatgttttgaagaacagcatgggaaaggcccgtgacagccaatggaaaatgcagccagcatagacagcagtctgtggagtagagctgcagttttctagggaaagggcagaaaaacctggaagagaaagtacagcaaaatcagagccgtcaaaacataaataaataaaatagtgagaaagcagagccccacagtgccgtgagtcgctccctctctttcctgcctctggtcctgccaatcccaggcgccaccctggatgtagctggaattgtatggtggcttcgtttttgctgagggacaggtgaggttagggttggtgtctgcagtgccggaccctgctgatccggctgtctgcacgccttcgggggtctgtgatgaccacaggtttctgtgattggccgggctttcctcccaggagggagccaggtgtgttcagggccaccgtgctccggagcggagagcgccgagccctttgttcttagtctatgagcaggagtgggaggcctcccggtgggcagagcagagccaggagcatccggggccccgcctcaggcttgcggagcccctgcctagcgccagctccctgcctgcttccagcctcttcccagtcactgtctttctagagagggcgacagggtaaagaggcaggcaagacaccgtctccagtggtcgaacagcatgctgtggagagggtgcgagctgcctgtggctgctgtaacaaatagccaccaatgcgcggctgaaaacagcagcaacgtattctctcacagctctggggtccagagatccaaactcggtacccctgagcctaagtccaggagtcagccgggccgggcttccttctcccggccaggacctttcccggcctaagtccaggagtcagccgggccgggctcccttctccaggccaggacccttcccagcctcttcagcgtctggcgctgctggccttccttggcctgtgcccgcatcccccagtctctgcccctgtggatactctccgtcctcctcttctgtcagtcaagtctccgtctgtctcgtcctcataaggtcacctgtgatggcactgagggcccacttagctaagccaggacattctccccactgcagagtactcacgttaatcccatctgcaaagtccctctttctacctaaggtcacattcccaggttccagggacgtgatacctttggagaaccattatttagttgactgcagagaagaaagtagaaaaaggagggcaggggggcgggggtcctgacgacagggtggtcaggaagcagaagcgagcaaggacgccacgtggtggtccagagaaagagccttcgggggccaaggggacaaccaaggcacagccctaaggccgagtgttggggagaaggggatgcaggggatagagctgggggtcagggtgcagatctggtggagactttggctttgaccctctgcgagatggaagcccctggagggcttttgcatggaggaaatttgacctgatttaaaaggtctgccaaggctcgccctggctgctgcactgggaatggcgagtcatgaggatgtcccagagttcagcgtgtgcacgatcccatgtactcggaaggcacatcctgatgtggcagggctgtcgtggagcctgggaggccgcatttctgatctcatgctgatgctggcccatggaccacgctttgcctggggaaggtgcagggagagaggatggaagcagagagctaggaggctattgtgagaaaccacccaagagccgctggaggctcagagcagggtgggcaccgtggaggtggggagacgggtcagattctggactaatttgcaggggaagccgcggcaggggctgaacttcaggctccagtgatgggaggattagtcaaggagggctccccagggtttgacctgagcacaggtgagcgagacctcccgggagctgatgctgccgcaggctgccctccctggcccacaccagccccagggcctagagtgcccctcccccacccaccctctccttgcctgcctgacaaactcctaaacacccttcaaaacccagtctttgtcggccgcactttgggaggctgaggcgggcagatcacttgaggtcaggagttcgagaccagcctggccaacatggtgaaacctcatctctactaaaaatagaaaaatcagctgggcttggtggcatgcacctgtagtccagctactcaggagactgaagcaggagaatctcctgaagccaggaggcaaaggttgcagcgagccaagattgtgccactgcactcccgcctgggcaacagaatgagactccatctcccaaaaaaaaaaaataaccccagtcttggatattctggacatgtgataccccttggatgaaccttgaaccttgaggacattacactcactgaaacaagccacaaaaaggacacacggtgtgactgcatttgtctaaggtgcctagagtagttaaattcataaataccagagaatgatgggtgctggggctggaggcagggagcggggaaggggagttactgttcaatgggtacagtttcagtttaggaatatgacagggagatggatggtggtgatggttacacaactatgcgaatgtacttactgccattgaactatgcttgaaaaaggttaaaatagtaaatttcatcatatatattttaccacaacttaaagtctctttgataaatgcagtaatgttttaattaaacaaaaagaatgaaagggatcttcatgagcaggtgtggattggtttttaggatgtattgtgagtgaaaaaatcaaagtgcagaaacatatgggtagtgtgccacccctcctggaagaaagatgggggataagaaaatacatgtgtctgaaatataaaaacagaaaacggagccctgggtcccctcctctgagaagccctgccaggagcgtgagtgccctaaccacagacttagccccttcggggcccagcgcaccgtgccctcctgggctctctcctcctgggcctggatgtgggaggcatctgggaaaagtcaggaggaagacgaggaggaagcagtgagcaggtgaacaagccacccgtctgtccgtgctggagccctggtgctgggaaggaaagtgctagaggtggggagagattcctgggctctccctgggtgggcacatccgggaggaggaggctgggggggcagcagcaggtccctcgggcggcggatgcatttgatgcatggatgcatttgatacctcagggcagttgagctgcagcaggaagacaacaacagagccccggcaggtggatcctgaaaaccgacggcctccacccccgggcttcctgactcaaatcacagccgctcactaaccggggctcagcttcagctgtgctgtatttcagtgtctgagatgtttggggatgagtgccagtgtcgccaggctgccggccagatttccatacaccccccacccacaaacatgctgcctttctggcttctcttgagaggttggcagatctctagcaccaggtccgccttcccacgtgcagcatttgggcatgggccttctcccatgggtgccccccagtggtggctactccgtcctcactctccatacctcctggccacaagggcttctgagttcagaaaggagagacgcagccctgtgaagccacccctggctggttttctgtcctatggtttttgagggttattaagaattattcaccccacgctgggcttgttgctggtgaggcccagtgctctgagccgcacctggggaagcgtgacactcagagggaagcagccctgtccgagagccagaagctcaggggcacctttctctccggcctcttggagggagctgtcacttgcagaggggctcccctcgctccatgagtcccaccccacgaccagttctttgctcatggagcacaatcgcgtcctgacagcagccatggagcaaagtctgatgcacagcgcatttagctcgggcagtcattcatccatcttgcccatgaggcagccaccaccacagcagtgccgctcagggccgggagtatgtgccgttggagaaacactggacaagaggccagaatggatgtcacccaccatgcaccagctgtgggatgtcagttgctccatctacaaaaataacaattcagtcctcatgtgcaggtgctgggaaagattcaatgagatacaactgaatacaccgccctggctttaaggacatagactcatcccagcaacatccacagagcccctgctggggactgccttggtttcctaggactgctgtaacaaagtaacataacctgggggcctgaaacaacagacaccgttctgtcaccttctggaggccagaggtctgataccaaggtgttggcagggccaggttccctgtaaaggctcgggggagggtccgccccatgcctctttcagctcctgggggttgccaacagtccttggcttgtagacgtgtcactctggtctctgccttcgtagtctcatggacttctgtgtctgcattttctctccttgtaaatcaccagtcacatagggtgtaggacccaccctaacacagtacgacctcatcttcgctaattacattgaagaaggccctattcccaaatgaggtcacctctaagcttctaagtagacatgaattctgtggggatactgttcgacccagtacaggtgctaagccctgtgatgaccccaactgatggggtccctgctctcaagaaattcacagtccttggcagtttcttcattccttttgccttctttattcttctcaatgggtttgttactgagagctgcctccatccctgtcctgtggcaggagagggcaaggagacagcccacaggggagcctgtcgggcccgggagggcagggcctggacacggggaggcctcccaggccgagagggtggtgctccagagcctctgggccccacccccggctggcaggacagtgtcggttttctcgtttcagatggcagagcagctcatgaccttggcctatgataatggcatcaacctcttcgatacagcagaagtctacgcagccggcaagtacgtgtcttttcacacgggaaaaagtggttcagaatgcctgggcagagccggagctacagggattcctgccgctcgcgttcccaagagtgctcacaaatgcaccttgcaccctgctttcatttttaaactctgaatggctttaggaggtgctattttcatggggctggaattgcagaacacttggacactgatcacttgctgaactccccgtggagccaccagggggaccacagtccctctggtgccaaagatgctgtgctgggtgagaggcgcgatggagctgctgtcctgggctctcctgatgtgcctgacattttgacatttcatgtctcacttgtgcaactagggctgcagggcctcagagctggggagggcaggctccggccaagtgctgtggggagcacttcccatcttggcggtgaactttcctgctcaattatgtaaaagctcagccttcttcagccaggctgttggcttcaattttaaagactggctgtaatcaaatcatccactctcctgcatcgggtttccagaagtcagcttttgtttgtgaaatcatttgttggccctctcttcatcctccttctgcccccctcctgcctggggccagccaagttcccgtcagccgggcaggctgcaggcctgggctgctgtgcaccatagctgcttggcccgcagctgcttcgtgggccctgggtggttacctgcaactgcagcggggcccagagcacccggcggcagggaacccaactgggccctgctcaagttcccacccagagcctggggagcgcacagccctgggggctgccgctgggaccctcaaaccgcctccagcccccatctgcagcccttttggccctccggatggcacagccccctcccactccctccatactggcagcagcttcccatcaaagtgaactgctttccagacagatgagcccagcggaggggtctgaggtcaaaaagcccagtgcagatgccaagccgagaggcacctcccgtcccgagccccccacctcttcgctgcctgctttggcctgggttatgctgccctgaagaatgtgtgggaggcagctccgtgcagcctccgtggatgaggccgggcacaccccatgtcacagcagccacactccgtcctctgtcactcgcagtttccatgttcccctgtttaactggacacccagagctggtgagctgggcaagttccctgggtctccggcagcctcgggcctctcggaagccgcttgccagaagaccggggagtcagggagcagcttcccctcaggtcgccgtttctgtggaatcccctgccctctgctcctgggccggccactgcggtccctctgtccagctcagagctgagcccccggtggacgcccatcagtgccctcacaggggagctgggcgctgcgtgccggggataggcagggagaaactgctttggggagtttgggggaggctgagaggcagcttgcagggggccaaacccgtatcttcccgaggccccttgcttctcctgctgacactaatttgcacgcttctcagagagctgcaggatttctgtgtcccgcgaacagatgtgagtcctaccaaatcacagccagagccacaagccacaggcttagataactcactgtctgctgctcctctgccccagagatcgctgctagcttttctctcttcctcctcctttcctgatccccaaatcagggaccaaggaataaaaggaagaggcctagggctgagtgaattttctgtgtgtcttgaccataaatgaggagcattcagagcgcatgctaaacagcttgcaaatcagagcccattatttctgagtggatgactcaggcgcttttataattggaatgtagcacagagtatggatcattctccgtctgttgttttgctcagaaacattttgctacaagcagaaagttcttcaaagttaatccagtgctgcagtgccaggcaaggctgggacggccgcccatgcccccagctggcctgggtttggtgcaggacccagtgatgccaaacaggacagacagtggtccgcctagcatctgactctgccgttcagtgcaggaaatgagagggacacgtgcacccacacacatgcacacatgtatacacacacatatacacaagcatgcacagatctgctggaaatccagcccttgaccctgagtacatgttgattgtctctcaaaacagagcgtgacttgatgaataatttacctttgaaaaaagatacttgtcccggcgcggtggctcacgcctggaatcccagcactttgggaggccacagtgggcggatcactcgagatgaggagttcgagaccagcctggccaacatagtgaaaccccgtctctactaaaaatacaaaaattagccgggcgtggtggcaggtgcctgtagtcccagctacttgggaggctgaggcaggagaactgcttgaacccaggaggcagaggttgcagagagccgagatctcgccactacattccagcttgggtgatagagcgagactccatttcaaaaaaaaaaaaacaagatacttctctggaaattttgcccacctaatgttgccaggcattttccctggtgaattttcagctgactaggaaatgggatgctcgacagcagctccttccttctgtgtgagagctggggccgccactgcttagacacgtgtctgcaggggaacatgccacagccatcctagtggggggcaataacacagctgctcccactccctcgggccaaccctgtctgtggaatgagctactgagccaaggcgggtgttaacagcctggctctctggccccagtgacattttcacagagggaaccaagtggccagtggccacagtgggtctgggtttgatttttctgtttggctgtgatgagagctcggtgtcttgttttgcagggctgaagtggtactgggaaacatcattaagaagaaaggatggaggtaacggccctgctctctgcggcctgtccctggggtgggtgcgggcgaactatcccggggtcagcctcgtcggcctgtcgtgcagtgtcgtaaggcccgcaagtccccacatctttcttgctgggaagtggagaggaaaattcagttctccaagaggaggaggtgactctgcttgagaaagaagttgaagggaggccgaatacactgtccacccccaccctagcctgcccactccgcctctgtcccaactcatccacagagacccagagcaccagggtccctgcttgcaaagtgtcaggccaaaaagagcttggcgtgagaacgggcctgggtacagcaaaggcgtgctgctacagaagatgtgggtgcaaagcacttccacttctttggctggagcacttagggtcaggggagccagggggccagagaagggagtggctcagagagcttgggggcctggggttggatcccaccctgcaccttgtccacaggatcttcgcggcgtctcagcctctccggagctcactgttcccatctgtaagagggtgtgtgtgggaccgttccggcagggctatcctgagggtcagtggccccaagtctgtaaatcacccacccagctcagggcgggacgtgtcacactcctctgggaagtggtcccctccagcacagaccggggagcggtccccgggtgtgatggagcccaaaggtcgcagatcgggggccatccacccttctctcccaggagcctatgggcccttcccaggccaaggtcctcacccaccttgggaccaactgggctgagcacttgcctacattttgaggctccccagacccctggacacagctttatctgaaggtgctgacaagccccggggccctgttccttaataaatgcgtctttattttcagaaacatcagaagcagttataaagttgggcctccctcctccctcccctcgaaatgccactcagaatcccagtgccaaggggagcccccgccccctcccccatggattcctgacaccccttcctcttgtcccatcaaatttgttttttggcaactctgatcccaaaacaaattcctcctcaccctgtaattaaacgaaattgcacgtattagcaaatcccctgatcacgtctttggcgaatgtgcatggaggtggtgtggggtgatcccccttcctggaggtgacgctgcctctgccagagctctgtggccgatgcttcggggcagaggaggcctcctactccagcctcgtgagctgcttccctgagcagcccgggacccgggtgggaaagaagctcagccatggggcaccaggaggtcattgtcaccccctgggtgggaagtactccctcctctgggaggggtcaaggtcaaacgtggctgggaggggccatcattatcccccatcccaccaggacaaagccactggtatgggcatttgtctcgtgtggacttagagcagaagaacgaattacttccctttgcgctgctcaagcccaaatcctcagaattctctgcctcagctactcaaacccagaaccccactggcctggccacacttgggctccctatgcctcccctccctcctttggtgccccccaagttaccccgaccaggccgtccttatgcctcccctccctcccttggtgcccctcaagttaccccgaccaggccgtcccacacagattttctgcaacacgtgtcacattctgtagggaacgttgcagagagcttccctgcctgcctcccacctacatctttccatcctcaactcctgccagatccccccagagcccgcccctgccccctggcccacacccggcctcctccagccttggctcttgccacttcctctacctggatcaaatccatgcacccctcatagtccctgagccaggcccccctcccacatcctgggcggaaggcatctcctccggactccggtcacactaggccccccactgtccaactcccactgcctgactcacagttactgcctcggtggctgcctcctggctccatgaggagcccacgcaccccggctgggcacgtggtacacatcatatgatggagaagtgcccatttcatgccccaggctcctgggtgggagggctttcaggacctctgtgtgagagatgaggacgtcggggatgaaggaggaccccccaggggccgggcttatcacaccccttctttctcttctgttccacaggcggtccagcctcgtcatcaccaccaagatcttctggggcggaaagtaggtgcaacagctggcgatgcttccagccccggcccagcagccacggccccgtgctccccagagacccctgacctagaaggctcctggggtggcgggaggacagtcctccttgagaagggagagtggtcggggtctgtcctggacaggccccggcccagtgccatttcctgtccccagcaggggcagagctggtgtttctgcagccatcagctatgcctggtgcctgtccctgttaagggacgtcaaatccagaaaagaagctgtggccgagtttgccttttacaaaaacctcgcttaactttcctttttactcacatggattattttttcctggtcactatggtaacatcataaaaattatagagaaaacagaaaatttgtgaactgcccaaacccccaaagcactccaaattccctgggccgcctgtcacccctgcaggtctccaagtgtctagctccatagtttctgggctggacacacttgggctcataggaattataactacgattcattcattcattcttttttttatttttattttgtttttattttttatttttttgagacagggtctcgctttgtaatccaggttggagcgcagtgccacaatcacagctcactgtagcttcaaactcctgggctcgagcgagcctcccacctcagcctacagggatgagccaccatgcctgactaatttgtcctttttctctctctctcttttttttttttttttgagacagggtctcactttgtcacccaggctggagtacagtggcgtagtcccagctcactgcagcctcaacctcctgggttcaagtgaccttcctgcctcaagtagctggttctacaggcacatgccaccatgcccagctaatttttttatttttatttatatttttatttttgtattttgtagagatggggtttcatcatgttgtccagcctggtctcaaactcctgagttcaagtaatctgcccacctcagcttcccaaagcactaggattgcaggcgtgagccaccacgcctggcattaatttgtccttttttaagatatggggtctcactatgttgcccaggctggtcttgaactcctgggctcaagtgatcctcctgccttagcctcccaaagtgctgggattacaggcgtgagccactgtgcccagcctgatgtgttcttaatttaaaaaaaataataataataataataataagtccaaatcaaacagacgggttaggttgaaaatcaaagccccccaccccctgctgctgcccccctcccctctgagccctgtgaccaggcctctccctgggcctctgggagttcagccctgtagcctcgggtccctacccccaaagtggaatccgactccacacggcatttgctgaccctgtttttgcgtctaacattgcatcgtaaacgttttttgggaggggccagggtgccaaaaccgctggtgacatcacacgcggtcggcctgttttccagggcggagacggagcggggcctgtccaggaagcacataatcgaaggtgaggacgcgctcgggcacctcagggcccccatacctgtgggatcatcctcggaggccaaagtgatggcagcacagggcccgacccccccagttaacccactgagggcccaatcccggggcacccggtgctctggcctgaccttctccttccacccaggtagcacagcgggaccctgcagagaacgagggcagcccggtggctgagcacagaccacagaccagcctgggtttcaatccaggtttggccccacactggctgagtgggtcttcagcaggggcaccctgccccatgcctctgccacagtatctgtgcaatagggacagtaagagcgcacccggcgagggtggctgggatgcccgcagcgcccaggagaaggtgccacacagcccggggctcagcactcgcaggcaccggagcaaggcaccggggtgtctggctcttgctgtatctttattgtcttcatgcctttcctgtccgtgttcattttcttcgaggtaatagatcattccattgaaaatcacctggcggggcaagccacccactcccatcctccccaccccaacccagcgtttcactctgccggctgtgtgtcctgagctgctctaagcaccagcgggtggcttgggcgttttagacactattgccattgtttttgtttttgagatggagttttgctcttgttgcccaggctggagtgcagcggcacgatcttggctcactgcaacccccacctcctgggttcaagcaattctcctgcctcagcctcctgagtagctgggattacaggtgcccaccaccacatctggttaattttttttgtatttttagtagacacagggtttcactatgttggccaggctggtctcaaactcctggccctcaagtgatgcgcccgccttggccccccagagtgctgggattacaggcatgggccaccacgcccgaccatagacactattgcctttgatgggacgggcagcaggtgtagccctccctccacatgtgatagataaagtcatctccctgttgtaatacacagtggcctcagaggagggtatattgtctgagggaggaggggcttccccttcatttagtcaaggacacgtggcctgtggtcccccgatgtcctcctgaagggaagatccccccactccctgtgggatgtgcccccacctctgccgtggcatttcacgacctccatcagcttctggaagcttccagatgccagaggcctcttctccatctcttgttccctgagccgggcatggatgggcccaggtgcctgtggagatggagccacagcagtgacgcccccccacctggtcctcccccaggtctgaaagcttccctggagcgactgcagctggagtacgtggatgtggtgtttgccaaccgcccggaccccaacaccccgatggaaggtaggtggtctgcggcggcgccaccggttaggcctgggcggggtctgaagggtctgaacctggggttgtagaggccgccagcatgggccctgctgggcacctgggtgagccgtgagaggaggccgggtccagggtggggggcgagggggcaggcctcccctcagtagggggtgaactcagcctctggctgcagacccctcgccaggtgcacctggcacctccaggctgagtccctgtcctggctttggacccaggccgatccgccctccgagtcagagccgcagtggaactgtcccctcccctctgcggctgctattttgcagctaagtgaagtcgcagtgtggggactccaactgcagtgttctctccaatcaccatccattgggaagcttggggggacttttttgctctgggggataaattactacatagaggagaagaagcgttcagcgctttgaaaatcggttttggttactttggcgttttttattctttctactcctgcgatctcagccccctccgctcccccatcctcctgctacaggcgtctttccatgtgtgctttgctgctgcagggacttgaaagttaaattgtgttccagttattgttttttatttgttcatatacagcacgcacgtgcgtgtgttgatatatttttttcctttttaactaaacgcgtgttctgcacggtgatttgtgcctccccgctgtgccttcgtcgtgccacgcctctcagtgctcccagctatcaactctggtctctttaaatctttcttctatcaccaggggacccatttagttcctccaagtcaaggacattcatcatagaaggtacacagtgcccccagcctgactattgacttctgtgtccaagctgcattttatgagacagtatttttatttacatgattcttttaccccatgagaaacttctccataaaatgcataaagaggggaaagagcaccctatgagaacaccttgcaagtgaaggaaaagcaaagtggtgttggagcccctcgcccccagccccccatcccctcgttcctccttcctcccgtgcatggcccccacccctgggcttgcactgctgagctccgcggcggccgggggtcctcttgatctgaggatgctgtgatccccacctggagccttgaccctggatggtgccatgggaagggttggggaagaccaggtttccacaaggagcaaagccatcagggaccccaaaacacgcggccccccaccgagtcttagctcctccatggtttatgtttgctaagctcctgtctctcctggaggcagagatcacctggcttgtcacgctgccccgtccacagcacgctgctcctcggacggcatgctggctgcgtgtcccctctcaccaggttgccaaagcgctccatcaacgtggaatcattttcctcctgaaagaataaccacaggagccggcagccttctgaaaccagggggtggcctctggccacgcacagtctctctgccctccccacagctaacggccccaggaccccaccccaagggcaggtgtcgatctccctgggcctgggcccctgtctgccaactggtgctgccacctgaacccccatgtattatttgtgatgcggcaggagatgctgtgagttttggcagcagctagaaggattcagtcttcctacttccgttcaaccccattaaatattgaggtgaaggacagttgtccctaattgtccctgggtctggggccactgatatcacacttgggcacaagtgcagggtgctccctcatgtgggctccctgtccagcctgcttctgcccagatcctccagggagcccaggggcctttgcctaggactccccacctcaggacagccagaggctcctgccccgtcagccccgtctctccatcactgcatggaaggggcgccgcagggcagcatgcggtttcactggctgggaccttggagacctgagacagctgccggggagggagagtgagggaacggggctggccttgggggccttggcttccctctgtctggcatgtggacctaagccttggctgagaagaatcgggaactgatgctgcatgctcacaggtgccccgagagtgtttctaaaaaaccacaaggccgggcaggccaggagcccggacctgggcaggatgtagtcagagattctcctgggaccctctaggttctcctcaaactttcccaaccaggcacttcctgagggtctatcggagttggcagttaaagcaggtggcccagggaggtggcccagagagttcagactccctcccagatctccacccccaggaggggacagagaggattcccaggagctacaacctctgaccttggaagtaagcagagagcagggctgggcctgcaagcgtggaagccaagggtggtttgccaggggtcctgggtgagtctgccgagaccaccactccagaaaccccagtggcctcagctctagcctttaggaggccccaggttctgctcagggtggacctcagtaaaggggcactcagggagcgacccccaaaacagaagtggacgggaagccagcactgccactttgtggcctcgttgccattccaggggggagcctgcagaacaaacccagcatcttccatccttccttccttcccatcagccccactcccagcattttcaggacctcagcttccacgcagcatgggcaaaggacaagcaggcactgagggagagccagggcttttccagggtcaacgttgttgctgtctttagaaacacttgcactcccactcactcccacactgcctttggcggtcgaacttgcaagcactgtatccgacccgtgagaagcctagcgccatagtccctcgccctgcaaagctcagaggcttctgaaatttgaaatttcgacgccaagttctgtttttaaaatcacaatatccccatgaggctgagagggagctataaccagcagattgctgtgtctcaaagccatgtttgaatattgggaagaatccactgtgtcgctggggcgagggtccctcctctcttctttaaaaggccagcgtgaagtctccgcgatttcatcctcagggccttaggagtctccgccgtccacgattcaggttgttcccagggctcatggagcctcaaaactgtcctactccaggccctggcccctcacaggaggagcacccagacccctgtggccctgggaccaccccttgccaggggacaggcgggttgggactctggcctggtgctgggctggtttgagaacctgggccatggtcttacaaggctttccacgcccacttctcagtctcctggacatgacaggaaacatgagctcagccccgaagccctattctccgggaccatatggcgccccaggtcctgccacatctccttatccagcccactctctgttccaattagactttggaatagcccgaagtaggagaccagaaacgcaaaaacacatgtccctcctgccgccaatctgactgtaacgttcatgcattcacctggtccttcctgagtgatcggggccctcgaatcttccccagaccagagaacctccagttctagagtccagagccacattctttgattgtcccctctaatctaccatagaaacatcacggtccatccataacccatttttcaacatttccataggcctgtaaccagtcggggaaattgttttcacgaccaacttctaggattgtggttcacttttctctttcatcccaaaaaacccctcccacacccaacttcagagccaggaagtacactgcttgcaagacatcttcgcagcccctgtccctcctcccagcgtcctgcctgtatttgcagaatgtcccgaggctggccctgagccctggctgccccccacctgcggtttccctttctctcacgacagagaccgtccgcgccatgacccacgtcatcaaccaggggatggccatgtactggggcacgtcacgctggagctccatggagatcatggtacggtggccgcgcagcatgtgtgtgtccaggcacagactcccggcaccggctgcgtatggagaccccaaagctctggcggggtctgtgcctttggtcccaactgcaccgatgcctgggtgctaagggagggacaggatggtggagtgtggtggttatgtctgtaggccttgcagacggggattctgcatggatcccagcgctgtgtggccctggacaaatggcttaacgtctctgagcttgtttccccacctgtagaacacatctgctaggtgagcccccatggggccattctaaggagtccctgagagagccagtgtgaagctcttagcagatgccctggagctcagcaagcactctggggtgacaacaccgtcagctgtttccactgggctcctgagacgtgcccggtgctgttagggtcaagggttccacagggaccctctcacatgcaatcctcaccggtgcctttaccaggtgagtgccgcaggcagcccatttttcagatgtggacactgtggcacagagaggttcagtaacatgccaaggtcacacagcttgggccaagattaacatccaggctgtgtggttcagagcctgggctgctcataactggaccctccggcctgggggtcccaccacccacctccttttcccagctcaccagggcctgcctggctcccagggaagctatgagtgtgagcagtggggagcccgggctgcagctgctgggccagcctgctccggggacaccttggtgccctctccatggctgccccggcagccccccgcctgctcacaggcaagggccctcggggtccctttctgccttcacaggaggcctactccgtggcccggcagttcaacctgaccccgcccatctgcgagcaggctgagtaccacatgttccagcgtgagaaagtggaggtgcagctgccggagctgttccacaagataggtgggcaccctcgggcccctcgccccgccccaccccacccctgctctcgggcccagggcttgactccacctgcttttcctcttcaggagtgggcgccatgacctggtcccctctggcctgtggcattgtttctggcaagtacgacagtggcatcccaccctactcaagagcctccttgaaggtgaaggaacagcctggtggggagggacgggcaggggataggcattttggacgggtgggacctttgggccgactgctttggtgctgggcaggggttccgggagctgcagctgttcccacctcggtctgctgggggcgggctccttggcgtgagaacatggagcccctcctggcctgatcccatgtgtagaggggctgcccagcctgtggcacaggcccaagtggagaggccctttcacatccccccccctgcccccaccacatccccccatctctaccccctaccacatcccccacctctgccccccaccacagcccagcattcagaactctgagacccctgggcctgggctccgagatgggggctgcaaagccacatggaggtgaccctgggagaggcgcccctccccaccacacaacctctgagtggggactcaggagggtccccagactgcaggatctggagaacaaggagcaggccaagaaagtctgcccagccagcagtctcagcactggggcccacagccctgggttccagggcaacgtggcctggcccccgactcctcccatcccatggcaaggtcagggcccccctccaggaggccctgcaatcctctgggggggatggccaggggagagagcactcccctagggccaggaggttcttctgggccacgggtggcagccgagaccccaggctgccaagtttcctaagagaaggaaggccagcacctcgcctccttgtcctgacttggggttgggccagcaccacagtctttgcacttcagagcctggacaggccccgctcatccaccagcccgtgcccggcccactgcccactctcccctacttgagaggcctggggcaggggcactgccctggcttcaagatgagaagagcccctatgagggagaagggtccagaaggaatgagcccatcggccccctgcacgtgggggtccaggtgacctgctctcatctgtagctgtgctgctcccctcccccgcaaccagggctaccagtggctgaaggacaagatcctcagtgaggagggccggcgccagcaagccaagctgaaggagctgcaggccatcgccgagcgcctgggctgcaccctgccccagctggccataggtaacggtggggtcgccatggggccagtgcccctggggagaacctgccccagctggccgtaggtaacagggtggggttgccatggggccagtgtctccggggagagagggaagggatccctggacatcatcccccagccagcctcgggtaatcgggctctaaggggcatggttgggaccccatgcctctagggggatgtcaggagtccctgaggacctgggccaccccctccatctgccagccataggtaatggggctcccgctttcatgggaagaggatggggagcgctaagcacttgggccacctctccatcagggagcagcgggctcccccatgcctcctccagccacctcttagacaaagcccgtgcccagcactgcagggcttcctagaccccctcagacccccagaccaagatgctgggtctctcggcccagtcagaggcaaggcagacccatcaggggtccctgtggtgggtgtttctccctcaccttgggtctcgccgccacagcctggtgcctgaggaatgagggagtcagctccgtgctcctgggggcctccaatgcggaccagctcatggagaacattggggcaatacaggtaagagtgagaggccctgctgggcagagggcccatcccagcccgagccccgtccagtgcatcctcccaggctcgtcctgcgtgccaggctctgttctaggcactcaggatgcgcccgtgaaccatcagagttgtgctcctggagagcttgctttccagcaggaacagacatgaacactaactgcacgaaacaaggaggttagaatgtgtgtcagggtggacgagcgctgtaggagagaagccagagataaagggagggagctggggccagggacggtggcgctgcagactcaggttcaagggggcctgtcaggtgggcttgttgagaaggtggtgcttgagcagtcttgagagatgcggagtaagtcacgcaaatgcctgcgggaagaaccttccaccagcaggaagagttgatgcaaaggcccaaaaaggcctggagcagaggggcagatcctgagaggcacgaaacacctccagggacttctgagtgagacgggagccgtggcaaaattgtgggcagaggagggcgagctgcagctcagcctggaaagggaggctgctctccggctgctccatcggggaggctttgggaagcaaaagtcgaagcagagagccctggtgggaagtggcagctgcgggtccgagacgggagtggtggttggatcctggatgtttgggaaggtggggcccccgggactggctgacaaactggatgtgggggtgagaaggcgaggtggaagtcggtccccgggtgtgtcacccggaagggtggcggtgctgtatgctgaggcaggcgcagctggaaaaagcagtcacggacatggaagtccagcatttggcctggagtttccattttatgtcactgctgccaccacccttcaggaaggttctagggcaccttgacatttgagagggagtgcacagacccaggcatgcttcctctctgccccaaaccttctgaaacacaaaagcagcgtggcctccatctgcctcagatggagcccagatgtgatggggcaacccgggcctggccagccgaccatctggaagagcctggccccacctcctccccaggccaggcccgtcttgttggtgggattctgatttgttgttgttcttgcacgcaggtccttccgaaactgtcgtcttccattatccacgagattgatagtattttgggcaataaaccctacagcaaaaaggactacagatcctaagccgcccccgcccgcctgctcggacagtttccgttccctcctagtctctgttcgctcgcttaagctgttttgaagccaagtgaagagtgtggtttgcatccaagagaaaacaccacactgtgatgtcatcgggaaatgatctcccaagtcgctgccagacaccacccactgcttcgccggacaatgtcgaagtccagtctgtgccggggaaggcactggttaggaaggatgttcaaacggtcccacccaagcctgtcacctctgctcatcctccaagaccacccagctttctcccagccacagccaagattcccaaagtcaaggcccaaagatttccaaggttcccaaagtcaaggccaggccaaggcctggttgggtccttggggcgggcagggccggcctctcctctgctgagaatccccacttggtgtagggggagaggggaaaggggtctggcccatcgaggggccccttctgccagggccttggttgctggggcagggcctccccactgggggtcttcctccacctcccactttccaagggctccaggaatctggggcctgaccacagattcctctcccatccttttctgctccaacctgccccactgggtcccggcaggggccatgcctaccaagctcgagctggcccttgacccccacccacccccacccttgctggcaggggcagggaccccagggggattgactctgcagtttgggagccacaaaaagcgtagcggtgtgatttctagctcagcctcccaccgtcttcctcctacacaccaatgatgagcctcatgccagtgaggcccggagcgcttgggaggggtcccagtggggcaggcccctctgtctggccacccctctgtcctggccccggaaggccctgtggtcatgtgctcctagctgcacggtggctgctggccacaccacggcaagtggcagcaggggccggccctgtgcacaaggatgcactcctctcggcccctgtagactttctctaaagccgcccgccagcccaggccgctgctctgcaccgagctggtgggcttgggttttgtggagcgcatgcttggaccctttcagtaaggaagggtctttggggttttctgtgcccatgacttgggggctgcacccccacagcacccccacaatgtaggaaaagacctcagggaacctctccctggaaagacgggcagggctggttagcccctcccactgcctgacacctgggacaggctgggcagaggggagagagggcaggacaggccagagtgacgcccccgtgcagcttgggccggagggcaagggatgccagtaagtctgcaggtgcggggtgccacctacaggcccaggcctgtgtcccaagcagtacccaggctttgcagaccacgcggggcagggctccactgaagccacccccacccctcgccagctagctccatagggaagcctgtgtctcctgcccccagggcgcaccctcagtgcaggcacctctgttcccgctttgcccctggaggagccactattccagaaggctccaccctgccgtcctgcgggagcctgctgtccagtcctggccgggccaaggcctgggaaactgtgaaagtcagaaaggccagcggggagaggctggggcgaggggaggagggggatcagcttctgctattaccgaccccccttcatgctgcccctggcgcctagaacccttgcccctcctcatagaccaagtcccgggggtctccactcagtcctgctgcctgcttcaccagaagcagccctgtgagtgtggggtggggaagtcccttcccaacggaggtcccagcctatggccctgggcccaggtgggggtcgcctgcttccttcccggacagggtcctgcagtggccaatggtgccagagggcaggtggcccaccctcgccatcagggagggtggctggccccatccccactgccacccagccccacccactgttggaagagggaccagcgcg

SEQ ID NO: 13526 - DNA, 47200 bp, Human
actccaattggctaacacataatttctctatgcagcttaagacttcaggcagacagatatgaacacatgaagggagtaaaaactccaacctctggaccacttcctggagtgctcctaacccagactcccacagggcttcctcccatacttcatttaggtctttggctcaaatgttacctctttagaactgcctcaagactggggcaagaggagccccagtctagggctctgagcacctgattctcttccgtccatgttcctttccatagggcaagaaatcccacgggccaacgggatgtactcactcagagctcttgcccctctcctttttagagcatactgtgagttcctgggaccctagaaaatagtgccgcaatagcaacaggtcaccagctacaggctgcctcagccttttcccaaggtctatcctcctgaggagcaaggggtggtcaaggggaggctatttgcaggtgtggacaaaactctgatgtgcagatgtcgttgttataggtgtgggcaaaaggccatttgaagtatgggacagagctggggtgccaagagaagaaggaaggctgagggccaaggacatgttccccctccaaagcactacgttcgagggcgtatctcagaagggtccaagaatcctaaacttaaatgtggccttccagattatgatgaaggtatacatgtcaagataaaaggataggaattttacatcaccgtttaatttgtagttttaaaatatgtagacatgatatgtgggcctccatttgtactactgactcagttcttgcaaatattaagggtagacctgtccctgatcttcgtgtgtaaaatagcacctcctctgccactctattcttaccccagtctacatttcttcataacatcggtcaccatctgatctacatttacttatgtatcatctctttacccccactggaatgtaagttccacgtccctagagtctatattttgtttactgccttatccttatacctaaacaagtgcctggcatgacaccactcagtaaaacttgaataaatgaataacaaatctaggctcaaagctcttacaggtgaaaggggctaacctggcagtcacaaaggaaaaatatcactgtgacaaccgtctgaggagcaccttctccccttaaaataactcactcaaaacagtggagctgcaaaggtgaccagagaaaatccattaacaccttagtgcccatgacaccaggtgagttgatcgggctacttgcgagagggacatgtgagtgagcgtggagagctctgagtaggctgaagagctggatgtgggggatctgggctgctgggaaccccgaatgttggaatcgccctgacaaccttatgagggtggtcagatatgggtcctgaggaaactgattccacggcaactgcccgccaacccagcacaccccacagtgaagaggggcttctgatccatgagtagggcccctcaaatgatgttcccctttagatggtcatggtcatcagcaggggtgggtgcatcgatcctgtggggtcttggtggtcgcagaccaagcgtccctcttctcacatctaattcacaacgtctcatcgctccgcgggagcccaggaactgccctacaacagccgaaatccgggtcgtctattccaacggactcctcttccgttggatacgggggccgtgagaggccaaacaacctccgcgaggctacccccgcagcgaccgctcggcgggcgctccattcctttaccggactgtacacctcgcctcctggggcctgaggcgggaacccgggtcgcgctgctccgaggcctcggcggaccgcgaaaggatggctcaccgcccggccagggccagcccctgcaacaagctcagccccgcccgctcccgcgcccaggagcggccggcggggcggggtggctgggccggcctcgggggcgggggctcgggggcgggggctcaggggcggggccacgtggctcctccttgcgggcggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaaggtgagaagcgggggcggcccgctcccccgtgccccgccgcccggacccctccacctgcccggtgggcagcctcctactccgggagcgcgtccctcttccagtcacctccgcccacctcttcctctccgcgcatcccacgcccaccaccttcatgtttctcagctccatttttgcctcccgctcccttgccttttcctcttggccctcatcccgagcttctttccctctccgcggcctgggcccccagacctgccctgctcgcccggttcgtcccccgccaggttactgcctccttccctgcgagaggtctcctttgttccttcctccgcatggtccgctgacaccttaccgtttcctgggccagccttgtggcagtcctcttcctctcgtccagggacccatgtcatcttcctgccaggttccctagctgctgtgggtcagtgctggggagaaaagggaacggacatccattttgcctccctgccacctttctccactccctcgactggttgaccaggtggtacatagacttcctttctcatttttgtctttgatgtgggtatgcccacctggcagttttcctatctctgttccgggcctctcctgacctgccgcctccagctccttagcttctgggccacatccttctctctcttcccccgctcagacccttatattttaaacccatgcacccagaggcctttggtgcgtgtttggctcttgctccatgttcccaatccctggttggggcaccaaaactatatttcctgaattccaagacaccatcaactgtgagacacactgttcattttatgacagcccaaggggtagaaggataggaaaaaaccactacatgtataaagatttgaaggtgaactctattacagaaatgctaaaattttgaaacacttaagacttagagtcgaggaaatatggtaataatagtaattaatatttacggagcacctatcatttcaggcaccttactaagtactcggcatacattgtctcatagtttcctttccacaatttaaagattcctgtggtgtcacacatccacctaatccaggtagtgggtatttggcgggcaggagtggtatagtgatagtgatttgttcctgacttgctgcctctgaatggagttacttcctgactctggtgctaggtcgctagcacggcctcctaccctgaaatggtcattgaatgagaactgtgggcatctttggaaataggcctttttctagagaaaggggaactggaaccattgttccactgttggtatttcttgataaattcaactctttgtggtagaacagtgcctttgtagatgttagttttcagactcaccctcctcttttcctgagcagcttgcagattggtttctgaagaggcgagatggaaccatgtgtacatcttttagccatatggtcctggaaaattatttttaaatgaaacttataagctgttttgacctccagtttacacttgcctacatgcctcactggtcccattagctgaacgtgcctttctgagcagtgcttcacaccatttcaacacatttggtcaggggaggagtgatgtcaacacatctggtcaggggaggagggaggaagaacatggatcatggaactggaacacctaagataaggtaatctcaggggacattgtgggcatgaacatcataaaaattcccagatcgctttccactttgaggttataagaggtgttcagtggctgcagatggacttattctagaatttcttccttcttgagagtgctggggggaaagattagcttccagctgactcacatgtttggcctcttgcaatgcagagtttttagttttcctatgagttgcatgtctagatactgacccattctgctcctggatgagggttaccacttccaaacaggattccccagtgcatggagcctttctctaaaataagaaagcgaaatcagaatttaacctctgaaaaggaaatggaaggatcaaagtctgtgggggtgagccagggtaaatgggaggtgggagatttcagtggaaactggaggtctcctgtgagccattggtgtgagtcagtccttgagccagatcgtgttgggagggcactggcagaatctgctgtcagcctgcaatgaagaatgtcctccactctaacccaaaggggtgttccctggtgaggccctgctgagaagctagggttggtctcgcttcatctctgtgtcctgaggtttcttgagaaaggttggttgtgggcccgcagagggctgtgctcatcccaccctgggctgtgtgagtactgcccatgctctctgctgaggacacctgtatcttgaggcaggaacagagacagagtgaaggtcacagggagagagaagaattttgcagccatatttggctggcttcaggcatttaatctgactgaatagggttcatttcttcagtgactagggcagtagattctctaggcacctgctgccccggggcagagcatgtgtttctgagaacctggtttatcccctttctattccagagcagctccggttgtctcactgtatgttttggaaactggttgtatccaatttagaccttcattgctattcactggctaatcaatcagcaaatatttgttgagtgataagcattgtttgcattgcagttggggaaatgagctactcatagaaggaaaattggcaactgttacaaagctgtgtttgaaaaaggccaaaggagtggttcagccatttcttatgggaacccaggggaggggaaagtcacagagggctaatctgatcaccagaggccttcatgccagtagttatttattacacgcttgccttatgccagcactttgctaagggccttcacaggccattattatgacaatccttacccgggaaaatatctgtactatggatattgtcttcctctttttttaaaacaggtaagtaactttccaggtttacacagatgctggagaaggtcattgactccagctctttttggctttctggagcctgggcaggtagagaggtgggtggaggaggaaggatactccaggtggaaaaacagcatgtgccgagctatggaggtgaggttcgtaaggcgtgtgtttgagtgacagtgagcagtgttggttttgccccccttctcttccacggcacaggccacatctgctatgtgtacctgtgattcccagcacagagcctggtgcagagtaggagcccactgcacgttcatggtggccagtggcctgagcctcacaggattccaaatgacagcgtgagtgtagaaccttctgctggtgccgtggatcctcttgactcagaccgggggtgtcagccaggtgtgaggggtagagaaggcattttgtccatccagtgacgtcactgcccagaaactgtcagcaaggaggaaggaaggcatgagttggtgaccgcatagtgctgactagctggacagggcataaactaactctctgtgtcaggagagctcctgaattcttcggtgtagagtccagagctgagggtcagtagattctagtcactagaccaccaggtctgactggctcttggtggtttgggtaaatctgtgcctctgtcttcatggaagtccagacccacttaacactcggaggctgcatgtttcttgttaagagttgtttgccatccagcacctcaacggttgtcagagctagaaggggcattagagatcattcatcctggccctcgctgatccaggaggaagcagaggtccagagagacatgtggagctcacggtgctgcagccagttaaactccaagcaaggcttcctgctccacccagtgccctccctgcacttgtgagtggggcaggggacgctgcccttgactccagaccaagcccccagtgggggctcagcagaatccccacaacaccccctaccagagggcatcccctcacccatcaatccaagatttacagctgtccaacttctcttgcctcgccacccttcccctctccattagtccatttattctgtggttggtagaaaaattacgctgttcagagcaataattgcaccaggaaagggttttctccccagtagtagagctagactgatactactgatcattttggtgttaggcatttaagacacctgacacttcaaaaagcctctgtcacccagctctgcattgcgttgacagtaaagcttaaatgcagctttgctttaacaatggagcactcacataaggaccttctctattccatctcctgttacttgtcaaaagacaaaattacaccacattcaaaaatcttaactggcttctatttgtgattctggaatcggacaacaccacattctgtcttacagaatgagtattctgatgagctgagcagaggagtttggctttatagacagaaaaaggctgaagaaagtagaaacagatcaaaaatctgattggttatttcggtcccttttaaaggttaaagcagaggagacttctgtatgttggctgaaactggcttgtttgaagatttgactgttaactcactctctcctgatcttggaaggtcagatcgacagcttagttttggcttggtggcgtggaacttcagcttgagggactccatcttggtttggtctcttgggccttgtgcaggagctcagtcccaaccaatggcctcctagaaatattatttaacagttctccccttttggtcaggttctcacctaggtgagagttactaaaacagggcatcagcactactctcagtaatcatcgttttgggttttcggtcttaacacatcatttataggttaaggtgtcctcattatcatgcgtttcttggagttttatcattccagctggagagagaccatttagcattcagcagagggctgcatatagatatttaagactctttgagaggatacagtgtaacagggaaactactgtaatgactctccccaggataatactaagagtttacaatatgacgcttagccagggacccatgaaccaaaccaactaaaattgaagagatcaaagaatgagccagatgaggaatttaccctttttaagcaagtactatttgttcatttttttgcaactgagtctcaatacactatgtgtctatccatgtgcaacagaaagtgtcagcaattgcacagattccctgttcgctagtaggtagcagttctattatctagtatcccatgactgggttaaattaaagcaggaagtgagaacacatgggtctaaaagtctgactctataaaagggaccactagtacagtttgaacaacagttgtgttagggatgttgctgaagttacccactgggcagactaaaggatccctttggtcatgtaaagatctgggtttagcgtgacaaatccaacagtttgtgaagttacccacagaagccactgattgtgaaattctaactacagcattatcctgccagacaaaaaaaggtagatgtaatcaaggataaagtggaagtcttattccaatgaaactcttgttcagaagttttgggaaagcatgaagttgtcaacttcttgtcctggtttgcagtttgattgtctctggttatggcattgggcattttggtgaactctttgtgtagcgtacacgtcaggcatgagacttgtcccttgaaatgtatatcaagttgttcagcttctgtttatagggctttaggcacagaacagttcctgttcttagttggagaattgtagctagttattggaagaaactggaagaattcagaattcaatccatcttataggtagatgataaaaacttgaaaatgatcaacaaggctacaatctaataacagatgtactatagtttttctttaggaacatattttttctctctatagtcacccccatttctaccaaagataatcagggtaagtgggaggcagaggtcacagtgagccgagattgcaccactgcactccagcctggatgacagagcaagactccatctaaaataaaataaaataaaataaataaaataaaattcagactaatttgcttgcagaaaatatttagtcacatcagacttggcctaattatttacataagtgtggcaagaatagtgattgaccacgtaggctcttcttaagtttgctttgctagaacttatcgataaggaatctcagattggacttttaacaacttctcaaggctaggaagtcaacccaagcccaacttcagatttcacctgcagtacctatagattcatcataggtatattctcaagtatggcatcacactcaaaaccttggtaatatgaccagtgtttcctattgtatcctgttgtaaagagagcagatacttattgaacttatgcaaataacagtattgccataaaaataggaatattcacaaatagtttctgaattccagagaggtcttgtagggagaaaatgtttccatttttgttcacaagagtatacttaccaaattgctgtaaactatagatagcttaaaagaaaataagttttcttaaatctggacaacaaaacattaaaaagaaccagcaacgtttcaaatttaaaaaccagaaaaacccataattcttcattagttcatttagtctcatgtaattaattcttgttgtgcttgatcttggttatcagttttgcagacccatcagtttttttcattagagttctggaaattctttcccagtccaatcgtattatctcgaagttatcagaaatggtacttatcagagacgtttccgtggatctccttgaagatgaagcacttcaggattatagttgcttagaaaaaagcttttagaaaaacatcagaataaagcaattaactgtagacaataagacttaaaatggttgtggttaaagatctgatgagagttcatagtaataatgacacaattgacaaggaaatctggttattgctgtgcatacaacattttaacctaataaccaaaattaaggctgataatgtatcatatttctaggaatatcatataattttggggatacaccttaatagcaagtataaacatacatcaataaatataactcaaagaagattaaacatcatttcttgtttgacaatgcttcccatataattaatacatcaaatgagcctaactagtttagtatctcccctttgcagaatctttgagatgttccagggccccctgaaatgttccaaagttacttcaagttcagaaagccttaatttagaatttgattttgggaagtttgtacaaaatgtcaaaggtttaaaattaaaacacttaatcagcctgggcatggtggctcatgacggtaatcccaacactttgggaggccgaggcaggaggataccttgagcctaggggttcgagaccagtctgggcaacataggaagaccccatttctatattaaaattttaaaaaattagccaggtgtggtggtgtgcacctgtggtaccagctacttaagcagctgaggtgggagaattacttgagcccaggagattgaggacaggtgagccacgatcgcaccactgcactccagcctggatgacatagtgagaccttatctcaaaacaaaaacaaaaaagcaaaacaaaaaaaatcacttgatcaaaataggatcacaggtcactgtgaagtcacagtcattcatctaaccagaatgataattaaaagacttcaaaatgaaaatatagaatgttacattgttgcagaaaaaacagctcttttatagagaggactccattttcttaagtaatcaaggacctagtaaagacaacatgaagcacagggaatcatcttgatgaaacaaaggatctttctttaggagaattacctaaaaggtacagaaaaacctttcactgtttccttttaagaacagatcaatacttcaagaaaaccttgttttaacagagaggaccaaattctgatttttcatcagtgtacttttgatattaaggctcatcaaaaaaaaaaaaacacaaaaactataagttagcccattcgaccacacttgaagttcttttctcttcacaacttccttgtatccattggtttgtcctgtactgttcctctttctcattgtgaaataaccagtcactctactttagaacaaaatgactctctttttcccttaattaaaatacatccttacattttatgacttcctttataaaccgtgccatacttcccttgcatacagaattatgtcccttattatttttagttttagttgcttatattaattagtttttactccttagtaatcttaatttctagtgaaaactagcaagcattgtgaactgtcttctattaacattcaccatttcataatttctagaaacatgtttcctcagcttttcatgcttattacagacccaattatattctctatgccatacaaaaacaagatgccaaagcatatatactttagacttatgttcagcaattaatgtttcagtattttaatttacttagaaatgatattttatgaatatctatgacttaatttaacgtaaaataaccgtaagaggaggctggatatgtggacaggggccaaatgaagaactgccttctggttgtagattttcttctaaagtcagttagagcccccagagaatgttgaatagagattgacataatcagatccacagaaagaaaagatcatttggtggctagagaggccagtgaggggtggagcacattagaacctcaccaggagagaaataatatgttgatgtttctctggaagccctgccatgagaacctgtactagctcatgggacacggagggtaggttggaggtgaggtcagtaaaaaaccagatcacgggttcatgccaacctaggacaggcatgaagagatggaggtttgggtgagggaagagacttcagaggagagtggacaggatgtggaggcaggtggggatcagcaatcccctggtaggggcagagggattgcatcctgggcctggcatgcaacaggccctgaccatacctgcctttgtgcaggctgccttgcaggtgaggtttaaagccaaaggatgcaccccagcttgcagatacttggataggctcaagttgctatccttgtgtgctaagggagtcaagaaggctccccaaaaagtgtgtggtgggggggtgttgaggaggttggggaaatggcatcataggatgtagctcacctcactctgctaaatacttttgacgtctgactctggtaaatacctccatctacttcctcttcccaaccccccacccacctccctccttcgaggagtccagaagctacaatgccaaaagcagactaccagcaagaaaggtgggggaaagaagggggtggtgtggccacaggccttcctcccagctcgcagagccccctcccttgtatcagccccaagaagggccagcttagttgccttctttccagggatgcgtcagggtgtgccaggctcttcctgcatctgtctcgtggaggtgagggtaacactccttccccaggcgtaacgtgttcttaggagctctgataccttctgaaattgtgttcttctgagacgtcgtaaggagtaagttctagggtggagtattagggtgtttttgcattgataaaagtaagtacctgaggctaggtaatttataaagaaaagaggtttaattggctcagggttctggaggctgtacacagcatctgcttagcttctggggaggcctcagggagcttttactcatgacagaaggcaaagcaggagaggaagcaggagggggttgggaagtgccaccctattttaagcaatcagatcttatgagaactcagagtgagaactcactcgttatcaagggggcagtgccgagctgttcatgagggatctgcccccaagatctaatacctttcactacctaatctaatacctttcacctcgtctaacattggagatcacatttcaacatgagatttggaggggacaagatccagaccatatcaggtggggtcagaggtcctgctaaaactgtgactatcagggatgttattcagatattagtgttctgtacttaatgggtgctgggtgggctgcctgtgtaaattccactccctgcccctggggcatgagcttcaaatgggaattgtgcctgccaccaggcaggcctcctcctcctctcatctgcttcagagacgcatgtgggtccagctgccatggacgtcatcctgagctgtccaggcagacactcccagtctggtctcttcttgctcccttctattctggctcccatgcctcccaaaaaccctcctctccaggcagcctggtttctgccagtcctctcctcctccaccttgctcaggcagttccctgcccactggaccgacggtctaggttcaactctgtttccacctttcctgctgagcccatgccttggtctgcagggccgacctctccaaacttgagagttctgtgccacatgatttggcccctgccactgccctctcacggcttgtgtgtcttcctctgtgcgcaccttggcttccagctggagcagcctccatgtgggtggaactttggtggatgctcacggggcacctgacctggaacctgagctcaggagagctgcctggtatatgagcttgtttcttctcagttcctgggctgtggcccagaatggtgccattattctctctgccaatgtttcagcggccagcagccttgtggcccggggcctgatgcaggggccagactctggcctcaaggcttctttccccgcagttcctggattccagatgctcctgtttctgtctggggacccagttcctgataccctttaccccagtcactcaagctctgcccactaccagtatctctggccccaggaaacttccctaagggtcccctggggaattccagatcccctaaggcatgttctccaccctctggaactgatcccatttagagccccagggacaaaggcaataccagggcttttcctggggggtggggggctggggggatggcgaggagcagggcaaactccttcaacatctctcagcccccatccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtaccagcccctcttatttacccctgggttttttgtcctttcagcctggaggccggccctgtatctcgccgccctggactgtgctgaggagaccaacagtgcagtctgcagagacttcaacatccctggcttcccgactgtgagggtgtgtgactgacaggaggggaaggcaggctgggcctgctttgtttccctttataagggaaagggaccatgtgggatgtgtcgggatgggcagatttcagctgctctgatttgagctgggaggtgatcatcacttgggctggtgagagctcccacctcccaaggtcctcttcaattgctctccctcttgacctccaagccttaagaggtctgatctaactctataaaaccaggattcaggctctgacccacctgtgggcagggtcagactctagaagcctagtggtcccccacaaagggaccccagacactctggcaagcctcagcctcctcaggcaaaaatgccttgaaccacaggtagctaagaagggacctgtcagggtagcctcaccccactgtcagaatgtcagtgcctcaggcagcagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagctataaataatatgtaccctcccaccagaatggcatctagaaaaccagtttcttctgtagccattaaggattattaggaaatgcctttgaaagctgaaatgccaagcattgtccctggaacaagatacctctgagctgggggtaggggcagccaagtttcaagcagaactgtgagccagaactcagcttaattaccccagcagcatccatccgggaagtaaggccgtggctccaccaggaacatccagctctaactccatgtgacctttctgttcctcgagcccagtgcaacccccactggattcagggtttccacacctaatagaagtcccttcctaaactgttaccacatagggtcagggccccccaggccccaggtttagctgagaccaggttggtctcctgatagcgaaccaacagctactgccgtgtcattgaaaagtggcagcagagagtctgcatgtcaatcatccctttgaaatgaaaggccttcctggcagggacatggtgctatctttggccctaaggtgtgtaattgagaatattcaaacagggcactctgttcctttggctgaaccagggtgagtggccctgagtgggaagctgtgggcaagttagtgtggcacaaggaaccatcattcacaggctgatatttttctcccagtgagcatgagccgcaggggtgcagccactgcccagcccccaggggaggggttgacactggtacagcagccagggcaagacaaccgattggagttctgtagggcctgacacctgagctttctgactctgcctgggagaggctgggcacagcagggatgaaggaggcggcctaggcccaggaggtcagaggctcctcagcgccaccccatgtcacgcagcgcacgcagcctggatgcctcaggtgagtcaccatctcctgaactgcctggctggctgtgggaggggcactgggagggccctcgctgggctcctcagccctcccctgcctccagacgggcagcacctggcagggccagtctggtagtcatctgtccacagaccaacacggtggcctcccccggcaaagcctttcctgcctctcctgaggaacctgtggctcagttttggccagggggaggcacccagtgcccagtccataggccaagtggcttgagctggcaggtctctgctctgaggtcctatgcagcggctctcaaatagtttcttactgtgaccaactgtaagcaatacacatttttacattgtgatcccaaagttggtatgtatctattatcattaaaccagaagtttcataaaacaagattcttactaagtgcagttaaactgtgatattttctgttctatttttttttttaaatccggctgtgattaaatacattgatttgacagctcattacaaggttgtttctagtgtttggaaaacactactcaaacagattccaatatccagagattcggggccatgaagaacctgtgtgcccttggcagaggctgacctggagactgctggtgggccagagacatagccctgttgccctgcctgctgccctctgggggctggagcctgtccttgcactctgtccatgaagagctgaaaagcgagggcccatgcgaagcagggggaggagagagtgcttttggtatgatggggacaggcccacacacaagtctggcctccctgagtggcatgtgtgactgtccttttcttctgtctccagccccttgtcactatgagcaaacagtgagcttctaccagcccagcctgtttagcaaacacctgggccctgaagggcgggccagctgtgtcaggtccccatcaggttggagccagagcccagctggaaggaaacaaaggcgtgggagagggaggggctggttggctgcaggttctggctggagcttggcaacctagaggctggaacttccgggtcaaggggcttctccgtgggcctcaggagtgcccttcagtgggaatagaatgggactttttatggccgaaggcctggccggagcaaggggtacacagcacagcagcataggggtggggaagggcaggtcttctctcttcgaggctctgaggagatcagtgatgtggtttcaaatccaggcctctctgcttactgtgtgtggcttggaaagtcacttatcagtgccccagccgtgggccccagtttccttgtctgtaaacatgggatgataacatccacctaagaggaccgttgccaagtgtgaagtgaggtctcccatatgcaagtgccaccatgctagtgtgatttggacttcagtaaaagttagtttgcttccttcccgttgtcccatctcactcctgggccacccgtggggctgctggtagctggtgtgtggctgctgctggactgtgtggcagtccatccatctgtcagcagccactgcgggcctacttgctgggtgcccagcaccgcactcaccactgcaggcgtggccaggagcgtgagatccccagagcccatggccagtgagaggcggccagggataggtacccagggaatgccacaggagtttgctgggctcacggagctctttcactggtcagagaggagtgtgtgtaggagaggacttctacttggtgttgaaggacagatggggtttggctgggagagaggaggaatgtgggcgggccttataggcaggcgagaaggtgagagccaaggccctctgtgggcagggcgaggtggcgtgttgaggagactcgtccagctgggcagaggctcatgttgagggatgaggcagagctgggggaggagggagcccagaaatggcaggtccttgaatgcaggtttggaagcagggacgccctgtgagggtacagagtctgggctgttaccttctgtggcttttgctagaaggtgagatgtcagggaggaagacaggactccaggatgtctcctgtctctctctggaaaaaggaggtgggcccctttctcagcagtcagctgctgtttttgaggtcttctccatggataatccacggtgttggaagtggttaaggtaatggatcctcatgggcttaccataaaaatatctggaggctggaccattttccttaaaacgttataaaagctggaattgaatgccatcggtgtcacccctgggaagtgtgctttctcttgagctcttttggccccaagatagcagtcactccatagtttcgtgaagaccagcctggtgttgcctggttttctgccattagggagcagctagaggtcttccagtagctcctgtgtaaagtgatgaaagaaaagggctgggtgctgactgctcctggagaaaagcaacacactcccagagtcttaattgcctgcttccagggagctgtggtggtttcccttgggcagggcacacgccccagtggttgacttaataaggatacattttaatcagaggacaaaaatgtgccctgacttgatttccgcatgggcttccagcatggtcaaagggcagagattctctgttcagctgaacagatgtctattgagagatgccagacactgtggagcttgcagagataaataaaatgtcgtcctgcttcctggtcagaggtgggtgcatgggtgagtggtggattcaggttgaagttcattgcagctggagtggcgggagtggagggcaatgtgaggtgagtttgggtttggagcctggaaggccttgaatgcagtgagtttggacattattcattgacagtggggagtcatggaagagatttgaggaggagcaaaatgttcagaccagaactgtgccttagaaaactaaccttagtagcagtgaggaagatagctggagtatgaaaagattgagcatactaaaacttctgagagcatgaaaggtggggactgatgcagtgacccaaaaatacgtcatcatctgtcgggcctggtctagacaaggcaggtggagaaggagaggacttttgaagaggtaacacggaggtcaaattcataggacttgtcagctaactggatgacgggtttttgaagagggggatggtgtgggtggcagggagggggactggttgctgggtgaggtaaacacaagtggcaaagcaggttgagagaggggtgattcagtcttggggatggtgggggaggggctgtatccagacacctgagtggaggccaccaggaagaaccaggagtctaggacaggtgaggtctgagatgcagagggttcagatggcaaatcatttggacaaagtcattggctttggcaagggagaaatgataggtttgttcattgatccctttatccactcatcatttagaagcaagattgagcaacttctttgtgacagtgccttcaacagctttttaaacagaagagtgtcaggacctgacatgtgtctgtaggagagaccggggtaggagatgggggtggacagtgggcacaggagagcagtcgaaagtgaagctaggaccagggcaagggggccaagtaaggctggtcagtgtcaagccaaccaggggagggtggcaacgtgaaagcaacaaaggagagcaaccacaaaatgtggcacgaaagttgacaaatgctcgccatgggaagacaaagcaggcagtaataacatctgtaccagagagaggccaggagggcggggagagatcactggagtggctgaagagaaggtcaccaaggagcttccctagaacggcttcaactgagggttgtggggatggccagagagcagtctgaggagcaagggcagacgctgttccaggaacattggcagcatggggacacgggaaggaaatgcggttactcgagaaggaaggagggcctctcttcatccccatcctccttcccttcccatcctttccttttttaagggttagactagaaggattcgaatctatctgtaggcctagttgggcagctgtagtagaaaagaggaatgatgagagatggctaggaagaagttcctgaagagcgtgaggcgtgggagccagaactcggaggagacattggcctgggaggtgggtgcgaagcttctgaggacagaagggaacagctgaggtgcagcagggccttcccttcagcctgcatcctggggagaggctcttggggtccctgcatccccctgggccactctggctgaccgaggttcctggtcagactccaagctgcttgtggctgctgggatcttgaggggttgcctttttaaaatttttttattttttgagacagagtctctctctgtcgcccaggctggagtgcagtggcatgatctcggctcactgtaacctccacctcccaggttcaagcaattctcctgcctcagtctcctgagtagttgggatacaggtgcatgtcaccaaatttggctaatttttatatttttagtagagacggggttttaccctgttggccaggctggtctcaaactcctgacctcaagtgatccgcccacctcggcctcccaaagtgctgggattaccggcatgagccactgcacccgtcctggagaggctgccttttggtagaagtaatgcaagcctcttttaatatgggcacctgctcagatgtgggtgacctgatggttgatgacaaaaaaatgaccatattacttttcagaggtgaaaataacagctgtagctgtgggaaagccacccatctcaaggcttcatgatgtcagtgttgttctcatatatgtagaaaccagtcaaagtgtaacctgtctgtaaataaacaagagcaccatcaccatgaataactgcagcgcaacatcaccctcgggtttcttttttgtttttaaattttatttatttttaatttttaactttttgtagagatggggcctcactgtgttgcctagggtggtcttgaactccagggttcaagtgatcctccctcctaggtctcccaaagtgctgggattacaggtgcgagccactgcacctgacctggtttattatttgtcggcaaaccaaaccccaaatagatgtatcttcaattttgttcatgaaaaagtgtcagtccataaatgccgtaacttacattatcaatacgatctcctaatcaaggaaatttatgatcattttcttaagtattaggataacataattttaataggccaataaaattaaataactgtaaagaacgctatttaaatatgtgtggtatgtataagtggatggttttcatccacaataaaagtttatattaatgttttgaaaagagagagtaaagcagtgagcaggagtaagggcccgggggaggtcacagggagcagaaggttgcagatggggagagacaggtggcttctctgcagcctttgttcctcatgtgggagagggtagcaggtggcttccagattttctgcctacaaatgtctgtaacaaacaagtcctagctgatcatggttcctagtgtttaaaaggtatgaaggagggaaggggatgctggtggtgggtgatgatggtacagttaacatgtaccagttccttgatgtatgcactaggtaccatgctaagcactttagatgtatggtcatggaatcctcacaagtcttcaaggtagatggtgtcatcctcatttcaaagatgagaacacaaaggttcggagcagttgatgcgttgcccaaggtcacacagcaagagcaaagcagaaccagtccttgaacgaggtctgccagagcccggggcctgttctcagctgccagcttgggataaggccaaacagctctatcccaaggagggagaaggaaaccagtgtttggctgttggaggcagaagtccaaggtagtgaaaagtggccccgaggctagagtcccacaggaagaagcctcttcccagcctgcaggctctcccctaggcagttcagtggccggcttccaggacaactcaactgtgttccctcctgaatcggaagagcgcaggcaaaagccttggcagctgtcttgccgcctgggcagaagcccagattgccaggagtcaggctctgttcggtctgtcctcttgccccaaggaggtgacagactaggcttggggtgtcatgtacatgggaaaagaggacaaagtggtgagttaaatcagctagtctgtagcaaggcatgtttccccagggactcaggtccccgcttcaagagaacctgttctggagaccccttccttgactgtgtctgctgtgctgggctgggacttagtggacagagacagcagcctgtaagccccttttcccaagtaaggagcaagggcacattgacatagaagcaagctgacatttcccaagggacgtaggaagtgcctgcacttcatgttttcagatgagtctgcaaaggaaaacagcagtggtacttcatcactcatccattcgataaatattggttagtaattacatgctaggtactgtgctgcatagaaatggccctcgaggaggaaagtgtatgaactgctgcccacaggatccatggatgcttctgaggggtgtgggagggtaacaggggagggagccagtgtccagctcctagagcaacctccccccaactccccccaattcaccattttacagatgaagaaacaggctcggccaggcgcctataatcctgacactttgggaggctgaggcgggcagatcacaggtcaggagttcgagatcagccttgccaacacagtgaaaccccatctctactaaaaatacacacaaaaaaaattagtcgagtgtggtggtgggcgcctgtagtcccagctacctgggaagctgaggcaggagagtcccttgaacctgggaggcagagcttgcagtgagccgagatcgcgccactgcactccagcctgagcgacagagcgagactctgtctcaaaaaaaaaaaaagaaagaaagaaaaaagaaacaggctcaacaacattaagtgatttgcccagccaccgcattgaataagtaggcagattttcagagcaggcctgcgtggctgcactcttggccactatctattactgatgcccacctgtgtgtttgcttccagttcttcaaggcctttaccaagaacggctcgggagcagtatttccaggtgggtgcccagctctggttgtcctgttagcatcttcctcccccaacctccctcttcacctgggtttctattggggtggagaaagccctggcagtcggcagggtcgagggtgaggcggtccccacgggaagcctaacttgtgtcttcccaaaactatcctcccagtcagctttagggaaaggcaggatgaagaagcccttcaggttggacatatccagggccctagggtcggggcaggggcaccatgttcccagaagagctcttctgtcacaatggggttggcgcccagagagcagaccagagcccttggggaaagtcctgacgactcccagttctgagggattctttcctgtctgagggatgggtgtccttgcactacttggggccacaggaggactactcaagccccattcttctagcacagggaaggactgacgcctcgtctgtctctgtcagagctggctgtgccctcggccctttgtttctgggagtgaaggtggccagtgtgctgtggaagcagctctgctctcctgacactccgctcacgcctgttttcatttacagtggctggtgctgacgtgcagacgctgcgggagaggctcattgacgccctggagtcccatcatgacacgtggcccccagcctgtcccccactggagcctgccaagtactttgggctggggcaggcttagtgcattgtgggccaggatcccaggcctgggagtgagagggtggtgggaacagcagggcggggaccccagtttattttccttgctgcctttgcctgtggggctcacacaccagtctgctggagctactccagaaccaagtggcagctgatggctggtggtgggcttcctatcgcacaggtcctgctgaagagccctgtttttctggggctgactgatggtgcaagggtccatcccaccaggtgggaaggaaaagatggatggggcttctccaggttgtacctgctgctgtttcttgctaccttccctcaaaatgtttgcgggacgcagcaggatttcacatgctctatccccgggaaggccactgagagtcagaatggcatgaggaggaaaaaggagatcaaatattttgagggaaattggggggaggtggagagaaggtggtcatgcctggggcatgggggtggcccctggctctctgtatggcagagcatcaggtgcagtggccggtgctctgtatctgtcagccaggcaagcttcccagcttgcctcttttccaggaaaatgaagacagtaaggtgcatggtcttgcccatactttcccaaagaagagacagctagattaaaaacactaggccccccacttctggatcagaactcaagataggataatgcccacctcggaggactcttgccaagaaggaacaaatccatgtaccagcaggagctgctagagggagcccagccttgtacacagtggaggccccaggtgctaagaaggcctcacaaggccgctgttggtgcgcagaggctctcttaaaagtttgtgtgcaggtgctctcagagacatggccctgctgagagattgtgtttccaagtgtcagttggggttgaatccaactcacaatgactcctttgtcatctttcccaattttccatcctccagagggcctccaggggaccctggatacagcatagtctttatgtggtttggggttccacagccagaccctgtctctccagaaaacacccatgtcagcctgtgccctggtccttgctgcttctatttctcaatgactgtgtttccatctccctccttacacacacacgtacatcctcatggcacattttcagccctggggtatctcaaaagcaacagctcaagcaatcctgccaaggtctctcaaagtgatccttttttttttttttttttggaagacagaatctcgctctgttgcccaggctgggagtgcagcggcacgatcttggctcactgcaacctccacctcctgggttcaagcaattctgccgcctcagcctcccgagtagctgggactacaggcgcctgccaccaagcctggctaattttttgtatttttagtagagatggggtttcaccatgttgcccagggtggtctcaaactcctcagctcaggcaatcggcctgccttggcctcccaaagtactgggattacaggcataagccactgcacccagcccaaagcaatccttttaaagaactttaggaaggaggtagagatgtgtgatgaaaggtgagctgcctcttctgaagtctgagggtgggagtggggaaaggggtactggcccccatgtaggttgtgctcttctgccagcctagggaagacccagggaagaggtctgagaggctggccacctgatgccaccctaaaggctcaacacctcttttcctccaccccagcggggtgcactctggccctcacctgtctagcatatccatttggactgtcactggctgggctccagcatcaataccatgtttttgtttgttttgttttgttttggatatgttttgttttgttttggaaactgggcctcagtttcctcatcttaaaataaggagattgggttagagatatagatggcttctaaggtctcctgaacccaaggctttctgattctttcattgctttttaatgcctgctctagggaggaaggagcacatctcccccttggtcgtgacttgtcacagttccagacttatagctgttgggttctaataccccccagctctcaggggaccaataaaaaccacatccagtcagcctgggcctgccccagcacatggagacaactggtctcaaagcagcccttcccagtccccctccccacacggcctcctacccacttccgactctttttgtttgtttgtttgttttttggagacggagttttgctcttgtagcccaggctggagtgcaatggtgcaatcccagctcactgcaacctccactccccgggttcaagtgattctcctgcctcagctgggattacaggttcccgccaccacacccagctaaattttgtatttttagtagagacgggctttcaccatgttggccaggctggtctcgaactccagacctcaggtgatccacccgcctcagcctcccaaagtgttgggattacaggcgtgagccaccgcacccggcccactcctgacttttaaaaagagacaggaagcaaaaacaaaaccaagcacccaaggtaggtcagatgaagagccagggttagataacaagagcaacatcctttgagactaaaggtttggttgactcccttggagggccctgtgtggaagcggaggagggcgggatggccatacctgcagcactgcatcaccagcgtctggcgttgccagcggttttgtcttatttctgctggctgtgcagagtgactgccagaattgtctcttgcaggctggaggagattgatggattctttgcgagaaataacgaagagtacctggctctgatctttgaaaagggaggctcctacctgggtagagaggtgagctgccctgaagttccctgcaattcttggatagccatggagagagagccccagtttgggagcagggcttttcctgccaattctagggtcttggctgcctgggtcttttagcctggcattggcctgacccctgctgggagccatgggaagtgcaggagctggacctttgcgtttcaaaaccttgctgtttattcttatctccttcacggaaatcaaatataacacctgctgttattgagcattggaccagattgctgacacacgtagctgctaatccccaaaattaatgaaggtgatcaaatagcatgcccaagatcacacagctagtaagttggtagaagagggctttgaaccaggtccgtctggctccaaagccaatgttgtttccacagtgtcccactccatgggactggagtgaaatatttgggagggagggaacattagcgacgccctagccccaccggaggaaatggggtcctttacccagatgccggtctgtctcatgtggggcatccgtgagccagctccccagcgcttccagctgcagtgccctgtctagaaagcagggatgattacgtttctccgtagtattgttgggaaggtcaaatgcagcagtttatgtaaagggcctggattgcagctgacacatagtaggtgctttataaggatccattcccctcgcctaatgcagagagctcaccattctgccattggttcatggacttctccatagaccagttgtgagcttttcccagctgcaaaggtgggacgtgccagtgcacgggagatactccaagtcagtgcagggagacaggcatgagagtaggcatgaaattaaactgcactgtcagcctgagtgattttcctgctgaaactcaacaagcacagctgagagtctgagctgaagccagatgctgtctccaggcctctcagccctgagagaggaggcacaggggttggggaggggaaagacagcttggcttaaggagtgcctgaccctctggggtcccagttcatgcctggggtcatgcctgttatgtagaggtgataaatggtgattggaatcaggtcttttccctcccctcccaccacagtccttgagtaccaaggggctggggtcccagtggttggagccaagtgccccatgcccatgcagtggtgcttagcgtgggaccagtggctaagggcccaggttctggagccacactaagctgggatttgtagcacagttcaggcatatgcaagctgtgtgatctggaggcatgatttcacttctaagcctcagtttctccagctacaagataggagctttatatttatttatttattttgatttttgtgagacggagtttcactcttgttgcccaggctggagtgcaatggcactgtcttggctcgctgcaacctccacctcccaggttcaagcatttctccttcctcagcctcccaattagctgggattacaggcatgcaccaccatgcctggctaattttgtattttcagtagagacgtggtttcaccattttggtcaggctggtctcaaactcctgacctcaggagatccgcccacctcagcctcccataatgctgggattacagacgtgagccactgcgcccaaccaggaactttatttttattattttgagatggagtctcgctctgtcgcccaggcgggagtgcagtggcacaatcttggctcactgcaagctccacctgtcaggttcatgccattctcctgcctcagcctcctgagtagctgggactacaggcgcccgccaccacaccaggctaatttttttatatttttagtagagacggggtttcaccatgttggtaaggatggtcttgatctcctgaccttgtgatctgaccaccttggcctcccaaaatgctggaattacaggtgtgagccaccacgcccggcctgggagctttatttttaagtaaacacttatgtacctactatgtgctagtcactgttatggcattttaataacattaaccccttcagttctcagaacagcccccctgaagttggtggtattattattattgttgttattattattttgcaagtaaggaaatttggtcagggaaaggtttggtgcagtggggccaggattccaatgcaggcaactgtagtgtacggtgccgcatctcttagtctcctgagaatagctgctatttcagtgtttctctgaagataaatgaggcaatctgtgtggacactacataatacctatgcaatacaggttagctagtgctttctctttatttctttctaaaaaaaataatgatgactgatgtatatttttctgattcggagtctagataggaagctttataaatataagaaaaaaggctagggggcgccacctgctccatggtgaagagtgagacgtcagtaacagaagtccgtgcctgccatttgcagatggcctgtccgattatgctcagaacttctcttcccatttctaatgtggggacattgtcatctcaacaaggcctcttgttgccttcagagagccccacgttaagaaacgttttcagatcttcttataactatacacattgaccaaagggcccctctgactactgcacatactgggctcagagttagcctgctgtttagaagtttacccaattccaaaggtttattttgtttgtatcctacccatgaaatttgttaccatatgtatttgaacgcaataaaatcacagttctttaaacatctgtgactcaagcttccataaggaagactgctcttgcccccaacaattgatatttcaaacaaacaataattagtaatttctaaagggatcttttccctttagaaaaatgttatgagaaggccctggggaatcctggacatcagagagcagtcttggggtgtgaaggtcttaaagacaagaacgtgctggctcagtgcaaaaaacaaacgagaattaaaatgaaaccacattttattgtgctctttacaaattgctttcattagaaagaaaatgctacccagttgggactgtcgtaagaaattaaagcgtgtgtggcatgcacagctccaaggcctctcctcctgggcagtgattggcacttgctacctactggttagctgctgttgatggcgagtatctcttgcgcatcagtgtggtccactctttgtgggtttagagtctggaaggagcacagctgccatctgggtgccttcacaggtcaccgagctgggacccagccctggctccctccacccggtggcctggcccccagatgttctgctgtccctgcaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgtgagtatcctgtctcctggcgtcccctctcgtccctccctgtgctcatccttccttcttgcccagaggggctgcccgcctttcacagtggccaacatgttctttctgaagagccccctcaggagaagctgcagtctgctgtctgcggggccagcgcctccaccgtcaggagcctgggcctgaaacgctaaccctgttccgcagctcagagacctcaaaggcctcagccccccgcacccagtgtcgcctgcaccctcattacgtccccaccacagccctggccctcttccccaccctcttctgttcgcaggcagactcattggcaggctacaggcctggcaagcactcgtatatgcctgaccctccctccctttggttttctaattgcagaaaagttcattagcagccagacaatagccagttccaaaatgccgagagaaaacaatcaggccagcctcagcccctctgccaggctcctgctgctgaatggcccgttaatggcaccagatggtgccttggtgccctccctgggcagatgattgatgtcagccaggccccgcaggcaggagcattgggccagggaggcaaggcttgcctgtggtgcctggtgagctgctcctcggggccctcagtgccgacccacacggcgccgggcagggtggccacttggcctcaccctggcccagatcacctgctagagggcccaggaggtgcgatgccaccaaggacagggaggcactcgctttccgggcaggcccagaaagtgccagtgatggtggggagagaaggcattgtctcctctctccgagttggtggaggggaaaattgtttgtgacgatgctgcctcccgagccatctgctcaccgagaaacccaggatggtggagtggaatgaagccgtgcgtcccatgccagctcccccggggcagccctcacgctgctgctggacccggcgtctctctctgcaggtgccctggctgtgggtgagagggaatatgcactcaggaggtatcccgtgccctggaggactcctccctgtcggaaaaaagaaagaaaccaaaaagaccgtaaaaagatttagagaattctggaggctctttgtcattgttgctacctgttttttgaaaaatcccatatcaaactccctggacttcttagggggtaatgtcacttatagtacctcagggcgagcttatggatgggcagctgccatattgaatctcggggtccttggggaagggagtcacactccgccgttcctgtctgtgggcaccgggctgtcccgtgcctttccatgccctgcctggagccagagggccactgggggaattcttgggcccaattgccttaccaggtgaggtttgacatcaggctggtgtcagagaggctttccagagcatgtgcagtgattagaagggttacagcgaggcctgggtgccgtcttctggcctcacagaggacaagatggaatctcgttcacatatttaataaaccttcctgtccgatgagccacccttcttcctcttctgacattggttagctctaatcttgttctctgcacttactgcctctcctccctggttctgtgccctcacaggctcatggaatccaggtccttctataccgcttacctgcagagactctctgggctcaccagggaggctgcccagaccacagttgcaccaaccactgctaacaagatagctcccactgtttggaaattggcagatcggtaaggctacgcctggttctcctcacttcttctccttcctctgatcacagaccaccacaccttcacacccacgccctcttgctcattcttcttccttgtcatatgattagtgtgtacattctgagccaggctgtcccccaccctggggtctggccatgctcagggaccttcaatgtgtgggagcggcatttagctgcggtgcctctggtgtctgttgcggggccggggctgactggggaatgaacaccttccatgcccacgctccttcagcttaactctgctcacaaatggggaatctgcgtgcaaggacactctgaggcctccagaccaacttcccacccaagcaattatttgtgcagtcaatatttttgagtactcactatgtgctaggcactgtggcagcagatatgtacaggcagatgcattctctgcttgtgcagaccctacagcatcccttctaggaaggcacccaacctcacttgaatgcctgtggtgtcagtgagttcactgccttttcaggtcacctgtgtgtgtgtccacagtcgtaagcatgagagagctgctcttctctctgaggctcgttgccttttctgttgtggttgggcagtgagacagagctgtagacctcctgcactggtaccagctgcataccaggtggaaatgtctgaccagggagctcagagctggccaggacggtgcccctcacaaggggatgcacgagacagtgggggaaaggtgattgcaagaaggactttgcatcctagcatgagggactttaagggtggaaagtgccaaatggagagacttttagtagatcaagggagaaggaaagagagagtgaggggtggtgtaatcattatgatcattccgtcattatgaatgatcatcataatcattcgatcattacagttatgcaaaccattgacgttcttgtaatagcttgggctggtgtatgtgccaggctctgtgctgggcaccttccctgtgttacctcattcagtcatggggccacttctggaggcagggcacaggaatggagaggtaaactgaggcccaaggacagcaaagtggaacacagaggagaccttgccctgaggaggagcataggcagccacaatgcgtaccccattagttgaccttattggctctttccaacctcaggaggttgtcatggaggggtcaggagcaagtcatgtgttttacaggtgagctgactgaggcccaggaaagtcaactgagttgcccaagctcacaaactagctcacagtcaaactgaggtcagaacccaggtctcaagagacaggggaagaggcacccaactttcctggcccctgccatcagaaccctgagcctggaccccagcatgatgggcctggggccagcatggagcctccggcccttccatgagggctgcggagaggtgtgagatgggcccacctaagatgtgaggtccggcagctgtgagcacatcagccctgaaagaaatacaggccctgcttcccctcctgcccccagtcgccatttcccagacttggtgggcagctaaaccctggtctttcagagagggcccagtttttccagagccatgtcgtgtgtatgaacctgctggtctgattatgtctagtggtcttggctcggagctggcctgattagtgagttgcaggaggggtggctgtgggcctggagagagaaaactcctactccctgccaggagctgctgagagttttttacatttgtgcttttatttgatcctctcagcaacttacctgtgagcaatgtgttattcatatcttacagatgaggaattgaggctcagagaaattaggtaatttacccaaggtcacacagcacatttctggcagaagccagtggtaacttacaagactctgtgaccatcagcagtgccccttctcttctctccctttagccctggatgctccttgcagcccctgcaccatggttaatacttctttctctctctatctccctctgggtcctcagctccaagatctacatggctgacctggaatctgcactgcactacatcctgcggatagaagtgggcaggttcccggtcctggaagggcagcgcctggtggccctgaaaaagtttgtggcagtgctggccaaggtgagcagggccatggcttcccttgtctgtgcaattctacggatggtcagtgtgcgttcctgtaagctgggcaccccgtcagcccctccctccagaagcccatggtctggctggacacctggacccacagctctccctgtccaccataggtgataccctccagcctcagccataccccacaccagccccacactgccagggacaaccctgccccatgcagcagtgtgggtgggacacagggcccgtgccccccacctggggatatttccagctgattcagtgactgtggctctgcctgcctgagtcctcagtcagagccccagtgtggcttcccacccctttctgtggtcactgggaaagcaggacccctaggacaccctggcgaaggagaggatgctcttctgatactccttgcttccctcccagtctgacccgatccctggccctggccatgccttccttattcctttatagtttccccgggaaggtggctactccacgaagggtagctcctatttattgaggacttgatgtttgtctaggatttaatccttttaactactctgcgaggtgggtggtttattttgtcctccccgatttaagaggcccagggagctcaagtgccatgccttcgttctgccagcctgaaagtgttgtggtcaggccttgagcctgtgctccttcctctctgaaggtgagaggtggctgccattccctctctgcgcccttccctttggttccagatcctggccattgcgtccctgctggaaaccctggactctgctgctcagtactgctgagtcagatgtggctctgggcgcttcgggtttggccgctggctcagcctcccttggccctggggcccggatctgagcccaccctcctcagtgtgggtctgcaggaagctggggctgccctcgggtgatttgtgcctctccttgggaacttcctgccagcctgatccctccttcccacctccctgtcctggccccctggcttggtcacatgaatgcgtggtgacactgagagggcctgacagggacatttcagcctaaggcaggacagtcgttggcccctcactgaagtcccatgcaaaatgagcccttgttcttcagtccattgccataatagagacctttcctccaaggctgagagctgtttggtcctcacagtgcagaggcctggggttgacaacctagagacttagaggggaaaaatccagaactgacccacgtacagtccctcctcctgacccatgagggagagcacccagcatgctttcccggcatgcctcagacaccccaccaccctagtccagtactctccaaaggagtcaccccaggaagatcggcttgtgtgtcactcgcatctctcagctgtgctcaaacctgctattttctttgtccccagtggggctgtttgcagccggtatgggggaaaagaatgagatacagaaaagtccctgagctgggcagaggcatcaccccctctgtgcctgctgagtctctgccttcagcaagggctgggaatgagcttgagatgaaggtgcctgccctgccagagccagggccctcggggtagggctggcagtggggtggaggacagagggaagccaggtatgccccgcagtagcagcagaggcatcgggggcatgggcctggagaccctctgtttgggttttgcccgcacatcccctggggtctgtagagtattctggcccttgccttgcttgggtagcttcttcctgaatagtagtatcctagcagctatcatttcttcagccctgccggtgcctgcagtgttctttgtatattagctcctcattctgtttctcagagaagattccacagcatggcttctagtatgatctccgtttcatagaaggtgaaacaaagccccagagaactaaagcaccttgccagggtcttccagctagtgaggggctgggcagggagccacacccactcgcatccagcccatgcccattaccaccaagtgcatggtgctcacaggcccgaacccctaagggtgccagtggacactgctggctccccctggctagctgccagccctgcaggtgcccggtcagtcaggaggccctctgcatgtcctgccggtgccttcccacccggcctctcccagcctgtgctccctcctgtgagcagctggtaggagtggccactgggtggcgtgtgggcaccagggtttccttgctcccagttgtccagagctccttaattcatccatccttctggcactgtcgccttagaaggcggaagtttctaagtcaggatgatggcaaaggtcagtgagaaatgctgacttcaagctgtaaatttgtgtgtgagttccagaggcccgtgtgggctcaccaggagggcacgtgtcaaagcgtggtcttttccggccatttctcactctgggggaaggtgtccagcccaacgtttgataggaatatttaatggctttctcagaggaatggatctgttagcaggttttcctgttcagttaccattcgtgtctccagtatccttctcctctcaaatgtttgtctttgctttctttgctgtgattttctcagggtcctcatcccctcggccagcctctttgtggttttatctgatcagcctgctgctgtgcccctctttctcctgccctccgccccttgtgctgtgcacgtgcacacacgcacacacacacacatacacacatatgtcctcctccctggagtccttgtggttttaaagtgctgatactaatcggatttgagttgacttattgtcagagtagcttttcatgctcctcagataccactgggagttaccatcaagatctggatcttggctgtgagcccctggcctggctggtcctcactggcagcccatggaatccaaatgaaaggtctcgtgcccacctaacccagctggccagtcagttggcaagtcagctctatccgaggaccacccaaagacaggactgtgtggcccagggctcccagcagccctggcaaggggcacaagtgctccagccttcctcccagtggtggcacatggtcggggggtgctgcacaggagcctgaggtctgagagagggagacttccaggaccccaccccatttagagcgagcaccttccctaccctgtcttctagccttaccaggtgtcccagagcaaaggtagtacagaagtcatatttgtgtcttagttagaatgttttcctggtggttttggaactttgcacaacctcctccccactgccccccgccccccgccccccgccttcttctgcatagcttcctaccatctgcaggacggggaacttggggaattgcttttcactctccagcttccgcttgttcctccccacagtatttccctggccggcccttagtccagaacttcctgcactccgtgaatgaatggctcaagaggcagaagagaaataaaattccctacagtttctttaaaactgccctggacgacaggaaagaggtgagtctgggaagcaaataaagatctctccatcctccgtatttatgagagtgcaaggggttaaccctgtcatttctgaccttcttcgccagtttgcaccagggagtcagtgatcttcgttgggtcctaacaataatcaataaatgactattgattgagctctctatgcgcacatctcatttaatcctcataatgttagtggaaggtagatattctccccatttagcagatgaagaaacagtactttgaaaaggttaagcaacttgtctgggttcatggagccagtaagtgtttgggctgggatgaaaacttggtgagaccccagagtttttaacaactaccctgtgctgcctcttagtttgtggtgctgctcagcatggcctccctggccctctccagggcaccttctgggctcctgctcatgctgctatttgcaaaagtgggtcactgcagccagcagaggtgtaaaaccctgtagacttgtagggtgtcaaatctcgaagggacctcagagataacccccttgtgttacagctggggaagttgaggctggaacgggatgcagcttgatctgggtcacagctttttaggtctgctgctgcttcagtgggtggaactggtgaaagggaaatgccaccttcgaggtgatagactgagggacctcatttgtcttagggctgtctcctagaagcttctgtctctgcctctcccatccttttccttctccatatgtgcactcacactcatgtgtccctcagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcaggtacgtccaggacccgttcaccccactgtgcctccaaccctgctctgttcggccctccaaggggagagggggcagggaagctcccttgaattgccccactggctcccagctgccagaagatggggagagtcagccttggggctctggctggattgctctatctgcaggtagccccacacggccagaatagaaccaatcccaggagggagcagactttaggaattcaaccagtcctgttttcggccccgggagctctggggctgaggcttctccctgtctttctccgggcttatagtttgctttgctttcagtcttcatgaaaaaattgtgattctatttttttatactcttaacaaagaaaaaaacgtgtattttacagtttacatagctgatacatagcaggtgctttgagcaattttattgcacttcccactgaaaaacaatttcctgggggaagttggggaaacacgtttcccctgctgcctcggattgtccacaaactgcaccaccatgttctccggccacgctgccccacacctgcttttgaagactgaaaggatgcgcatccaattcagtccacactgattgaggaaccaggtttataccaggctgcggcttggcttggaggatagatacatgggtgaaaagggcgacagtgcccgctcttggtggacctctagtgtgaggcagggggacagagaggcctgcagtgcatcagggctagggccgtggtggagagaaagatgtggggtgaagagagggcaggctcgacgccattgggaaggggcccgaggccttacggggtgagttgaggggtgatgggtgagtagggattccgccaggagaggagcatcccagcagagggagcagcctgtgtggagccccgtgaatcagaggaactgccaggcagtggtgtgggaagccagtgtgtatggagcatctccaccatgccatgtggcgctgcaggtgccggggacacagcagcatatgagacaggtccctgcccccacagggccagtatctgagtggcaggagacagacacagagggatggcttcagccatgatgacgaatgctgaggaagacaaagcaaagcagtgccggagcgggtgctgtctggagaggggtctgggaaaggcttccctgtggagggcccggtgctgggacccatgtggagaggagaaggcagtgtgggacgtctgggaagagagtctcccaggctgtgttggtgtccttgggctgcactcacaaatgtcaggctggggctcagccagtagacgtctgttgtctgagttctggaggctgaagtgcaaggtggaggtgtctgtgctggtttcttcgagcctctccttggctgggcggtggtcgtcttctccttgtgtctccgtgcagttgtccctctcccaatccatgtccaaatttcctcttcctgcaaggacaccagtcctattggattagggcccaccctaatgaccttattttaccttcattacctctttaaagaccctgtctccaaatacggccacattctgagaggctggggattagggcttcaacataggaatttggggggacataattcagcccatagcacaggctggagaccagcaggtgcaaaggacaagcctggtgtgtgggcagcactgaaagaaggctgctgtggccggagggagggaggtgaggctgcagagacaggccgggggcggaggtgagcgctcgtgggctcagaggccttggcgagggcagggtttggaggttggtgttggcattttgagaagccactggagaggctaacggaagtgacagttggttaacactttagaaaggtggaggatgggctactgcaggcagggggaggcagggcagctgaggagcaagctgcatgctcgcccagcagtggtggtcgggcctggactagggttgtcagtgtgcccctggaggaagtggtcagatttggggatatgttaaaggcagagctgagggacttactgatagattggaggaagggtatgtgggaagcaggactcgggtggactccagggttgtggggcctgagcctctggtggatgatggtcccataagctgaggagtcaggggctcgggttgggatggtggaatcaatggcccgctttgtgtcaatagacctcccaatggaggtgtgcacagttgagtctggagttccagggagaggtggggaatagagagattagctttatagtcattagtagcatcagagctcaagctgtgggactggatgagctccctggcagggaggtagagaagagtgctgaggactgaatcctgagcatcaaaccaccagcaaaggaggctgaacgggggaggccatggtgatttcaagggggccccagagtccagtgtttcaagatagaggtgtagtcactggggccagtgcagctggaggtggcgcaagatgaggacatctctagcaagggctgtgtcggtggagtagtggaggtaatggccttgttggattcggctgaagagagaccaggaggcaagattctggagataatgagcaggaactggggcatgactgggttagagggaacttctttatgatcatccttttccccagttggaatgatcccttatcaggggataaatggatgacgcagtaaagaaaaaacactaacgggagtgaaatcctggaggtgaggagtggggtaacccgagcagcagcggagacagaggctgagcaacgccagggccgtgtggtgaggccttgtggtggggaggtgggcacctgtgctgggtgcagaagaacaagctgagaaggcagaggagagagagagaggcaggtgtgggctgctgcgggtctcaccttgccaggagtgaggagagtagggtgccaacgtcctgctgcgtggaggggtaaaagcaggagattggcttctaaaggcctgggaggtttgcggtaggaaggagcgagcttggaggcaagcaccagcagccctggagcctgagggtgaagggcttaggaggggcgtgttggattaggagtggtgtcctcagcggggagcctggtttcagttagagcaagaaagtggggctggttaacaggtctttgctgatgccagtccagagggtccagtgggtgggagggggtggggggaatggaaggggagagcgaggagagatggagacagattaggaagggcatgtgcaggccaggtccaggcccgagggaggtgacgcatggtggaagcaagtcggacaggcagcatgagtgggcaggggaggaagggccaggggctagggcggtggccctctggcccctgctgacctctctcaccatgtcacaaagagcctgagtttcctgccaaggagtgtggactttgtcctgggtgtgagtgacaggcacccaggttagtggcagggaaggggatccaggtttaggagttttggggggatggggtctcctgtaaagtgaccatggcaggtagagaagtagacaaggggacactgggcctctgctggcataggctggggtgtgtggcacctgtgcaggggtggccacggcaggatggggggcggcagggtggcctggggaggcaacggctgtggggctggcagcctgaagggctggtgcgtggcatctcctctgccctgtagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtaaggaaggaccatccccaaggctggagtcacttgtgggggacgagggggtgaggatacttgggagtcttaggccaaaatttggggaagggacactcattgtcccctcagtcacagcccaggcctgttaaccaatgccagtatcatcagccccatttttgacatgaggaagccaaggctttgacactgtaagaccctggtcttcccatgccgttgctcactttttccctgctctagggcccctctctagcctactggggtccctctcccgcctcccctgctccgtcttctggctgttggccccttactcaaactgctagggcagagggagctggggttctctctccctgggaagggtctgatgagagaaggggctggaggagaccaggtcgttcctggaaataccaggcaccggctcccaggagggagccttgccctctgcgttccctcattatggtgcttccttttcctcatcaggagtctgatggctctaacaggcaaacacattaaactccagggagctgggtcgggagggagccatctgtggacaggaggcggtttgtgtgtcgggagggagcggtgcacgtggctgtgacagcctcccgggggggggagaccagggcggagccgaggttaaaggagctgaatggagcaggtggtggtgcaggcgcctgcacttggtcgtggtctcctggggcctcctatcgaactttgaaaggaagacatgtgcctgtcttctccttcccccaccccgcccctgccaccaaatgctccatttgacccttcagccccttgacctcggcaggctcccagctgctgctggagggccaggagcctgggcctgtccctgagaggccagaagcagggtggttccctcccctctctggtggggtcctttcagaagaaactcaaaattaccaggcacaagctgagagccccctccacaaggcctgatcactatgactcatgactggacccttgactctgcttgttgtcccctccccaaaataaccattctgacttgcatgccacttgctgttgctgctcctgcttccttgtagtcaacaacttgtccccctattaaaacctttaggagaagtgcttctacagaagggatgggctgatgcattccctgggcaacactgcgtgaggggctggtggccgtggctcaccctctgggactcatccagaggctgcctagagggctgggcccacctggggtaccaacagcctgcagccccagcagcatcctgactcttccaagtacccctcaggtctccccccaactatcccttggagcccacccctaccccagagggctgctgctgggtaaaagcaaggattgccatgagcagctgcctcttgcttgaaaacgcattttcccttgaattgacaaagtaacctatttgtgcagtttgtataatttggaaaatgtcagaaaaatgcaaaaaaagacaaacacgagcagaccgaccaaagactgcaaaacagatcaaaatgagtattcttgccctttcccatgtctggtactggggtaaaggctggttgtaaagtccacatagcaggacagtgggtctggccaacaccgggaaatgactgagatggcgctcttcacgcttccctggaaaaccacggagggccggggctgaggggtaggtggatctgcctcctcctccatgctgccatctgttgagctcccactgtgggctagtgtttgtaatctgtattttctaattacccatcctctggaagggcagtggcgagccctttctgcagacaaggaagctggcgttctgagtggaggagtgtggtctgggtttttgggtgggactgatgtcaccaccagcctgtgtatgcttccctctgtaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggagg

SEQ ID NO: 13527 - DNA, 206433 bp, Human
agaacctttttttttttttttttttttttttgtgaggtggagtctcgctctgtcgccagactgggatgcagtggtgcgatcttgggtcattgcaacctctgcctcccgggttcaagcgattctcctgtctcagcctcccgagtagctgggactacaggcacatgccccacacccagctaatttttgtatttttagtagagacggggtttcaccatgttggccaggatggtctcgatcttttgacctcgtgatccgctctcctcggcctcccaaagtgctgggattgcaggcgtgagcactgcgcccggcccaaatagaactattaataagatatgaatcagcaatcccactactgggcatttatccaaaggaaaggaagtcagtaaaccaaagagacatctgtacccctatgcttattgcaacactaactagtagccaagatagggaatcaacctaggtgtccaacaacaaatgaatggctaaagaagatgtgatgtatatatacacaaaggaacattattcagtataaaaagaatgaaattctatcatttgtgacaacatgaatggaactagaagacattaggttaagtgaaataagccaggaacagaaagttaaacaccacatgttctcactcatatgtggaacctaagaatagttgatctcatagaaataaaaagtagtgcagagaatactagaggctgggaagggaagagggcaggtcagaggatagggagagatttgttaaaggatatagaattacagctagataggaggaataaattctagtggtctgtaccactgtaggctgactatagttaacaatagtatatagtttcaaatacctagaaggaggatattgaatgttctcaacacaaaaaaattatagatgttttagatgatggatatcctaattaccctgatctgatcactatagaccatatgtattgaaatatcactgtgtaccccaggcatatgtacagttattatttgtggattaaaaataaaatttctggccgggtgcagtggctcacgcctgtaatcccagcactttgggaggccgaggagggcggatcatgaggtcaggagatcgagaccatcctggctaacacggtgaaactctgtctctactaagaaatacaaaaaattagccgagcgtggtggcgggcgcctgtagtcccagctacttgggaggctgaggcaggagaatggcataaacctgggaggcagagcttgcagtgagctgagatcgtgccactgcactccagcctgggcgacagagcaagactaaataaataaataaaataaaatttctttttaaaatttatttatttttgagacagagccttactctctctcccaggctggggtgtggtagcacagtcttggctgactgcaacttccgcctcctgggttcaagcgatcctcccacctcagccttctgagtagctagggcatcaccatgcctggctataaaaaataaaatttcattaaaaaaagtattgaagatgaaaagagttctggagaatggttgcacaacaatgtgaatgtacttaacactattgaactgtacatttaaatatagttaaaatggtgaattttatgttacatgtaccttactacaattttaaaaagatacttgtatccagttcctgatagtttcttatgcagtctactagtttttttctctaggacttttgttctgttttcttcagtgttttttcttagtcaagagagtttataatctctcaggtgatttttcatccttttccagctgttccttaattttaaagtatacaagttagccctcatcttaaaaattggacaatactggattgatgtgaagttataatgtttggattttagtttataaatgttaattgaagtatttatcaatttagggagctatgagtggtcattgaatattgaaaaagaactgtttagcttcagatacattcagtataaagcttactcatgatttcatatattgtttttctttctttctaataggctttcaaggatatgctgtattcagctcaggaccaggcaccttctgtggaaggtaagatgaattaacccttaagtttagtcacagaaaacctctttttaaggaaagatattttgtactgcagagtataaaactaatatgataacctgtcctattatataggtctttttttcccttttaataatatatattatgattattttatattttattctaaatttttctcttgtctagctcacctttaccctatgacggatcttttactatgtctttgtgtcaccttaggactgtgaatcgtatatattggtttagtcagaagtttttctgtgtaatgcttccttgccttccctcccctcccctccttcctccgtccataaattacacaacatagcttttcctttctatttatgtcatgcctttagagtgggaccagtaaaacaatggagaatgtttacaatggatgtgtgtgtgtgtgcgtgtgtgtgtgtgtgtgtgtaagcatgtttatgtatacatgtgtacatgttctcgtgtcagtaaataggagctaattcaacaactattcttgagggagaatgttccttctcaggctggatattcttttttattttattttattttattattactatactttaagttttagggtacatgtgcacaatgtgcaggtttgttacatatgtatacatgtgccatgttggtgtgctgcacccattaactcgtcgtttagcattaggtatatctcctaatgctatccctccccccaccccacaacagtccctggtgtgtgatgttccccttcctgtgaccatgtgttctcattgttcaattcccacctatgagtgagaacatgtggtgtttggttttttgtccttgcgatagtttgctgagaatgatggtttccagtttcatccatgaccctacaaaggacatgaactcatcattttttatggctgcatagtattccatggtgtatctgtgccacattttcttaatccagtctattgttgttggacatttgggttggttccaagtctttgctattgtgaatagtgctgctataaacatacgtgtgcatgtgtctttatagcagcgtgatttataatcctttgggtatatacccagtaatgggatggctgggtcaaatggtatttctagttgtagatccctgaggaatcaccacaccgacttccacaatggttgaactagtttatggtcccaccgacagtgtaaaagtgttcctatttctccacatcctctccagcacctgttgtttcctgactttttaatgatcatcattctaactggtgtgagatggtatcccattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttcagttcattgtagattctggatattagccctttgtcagatgagcaggttgcaaaaattttctcccattctgtaggttgcctgttcactctgatggtagtttcttttgctgtgcagaagctctttagtttaattcgatcccatttgtcaattttggcttttgttgccattgcttttggtgttttagacatgaagtccttgcccatgcctatgtcctgaattaccggtattgcctaggttttcttctagggtttttatggttttaggtctgacatttaagtctttaatccatcttgaattaatttttctataaggtgtaaggaagggatccagtttcagctttctacatatggctagccagttttcccagcaccatttattaaatagagaatcctttccccattgcttgtttttgtcaggtttgtcaaagatcagatggttgtagatatgcggcattatttctgagggctctgtgctgttccattgatctatatctctgttttggtaccagtaccatgctgttttggtccagtaccatgctgttttggttactgtagccttgtagtatagtttgaagtcaggtagcgtgatgcctccggctttcttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttttttgtatcctcttttatttgattgagcagtggtttgtagttctccctgaagaggtccttcacatcccttttaagttggattcctaggtattttattctctttgaagcaatggtgaatgggagttcactcatgatttggctctctgtttgtctgttattggtgtataacaatgcttgtgatttttgtacattgattctgtatcctgagactttgctgaagttgcttatcagcttgagattctgggctgagacgatgaggttttctagatatacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaatggccttttctgcatctattgagataatcatgtgatttttgtctttggttctgtttatatgttggattacatttattgatttgcgtatgttgaaccagccttgcatcccagggttgaagcccacttgatcatggtggataagctttttgatgtgctgctggatttggtttgtcagtattttattgaggatttttgcatcgatgttcatgaaggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcctggactttttttggttggtaagctattgattattgcctcaatttcagagcctgttattggtctattcagagattcaacttcttcatggtttagtcttggggaggatgtatgtgtcgaggaatttatccatttcttctagattttctagtttatgtgcgtagaggtgtttatagtattctctggtggtagtttgtatttctgtgggatcggtggtgatatcccctttatcattttttattgtgtctatttgattcttctctcttttcttctttattagtcttactagtggtctatcaattttgttgatcttttcaaaaaaccagctcctggattcattaatttttgaagggttttttttgtctctatttccttcagttctgctctgatcttagttatttcttgccttctgctagcttttgaatgtgtttgctcttgcttttctagttcttttaatcgtggtgttagggtgtcaattttagatctttcctgctttctcttgtgggcatttagtgctataaattttcctctacacactgctttgaatgtgtcccagagattctggtatgttgtgtctttgttctcgctggtttcaaagaacatctttatttctgccttcattttgttatgtacccagtagtcattcaggagcaggttgttcagtttcccatgtagttgagcggttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgtatattctgttatttggggtggagagttctgtagatgtctattaggtccgcttggtgcagagctgagttcaattcctgggtatccttgttagctttctgtctcgttgatctgtctgatgttgacagtggggtgttaaagtctcccattgctggatattgttttaacactccacatcaggtttttaaaatgagagttgagtgcaaaaaaatatatatcgagaatattctaagttggatgtacagaataatacctttataagacaccaaattctatgaagttattctagtgacaagctattagagacttgttcttatgacaaaagttaatgaagttatttaataaaactgtagatttatagtagaaagtctcatttcatcaattatataaaaatatccatctttcatctcaaaccattctgaattaaaaatgtatttcctctgaacgtgtaaaaatctcttgccttatattaagtcaggaattggcatttagtttcatgtcactgaattttagactataatatatttaattctctaatatttaactcaagacacttaaggtttaacagtaagtttagttttctgttgggttatcttttattttatatgccgtaaagaatacctcctttaactatttttaaaatataagaaaaatgaaattccatagaagctgaactgattccttaccctgagtaagttgctttaatattggttctcttattttactattctgtttgtaacaaagatactctgagatatattgaaaatgatgatgatatttattcatcccctttatgctggagcatgtttcttgtattttttaaattttctttcagctattattagagaaaaactgaattttgtgaaagtacgctcaaaatgacaaatatttatagttaagagccttttctttcattatccagagacattaacttctttgggccatgttataggggaagtattgtaggaacatgtactactttcacaagaaaaacatctgcacacattctttctttatactttcatgtaaacatactataaaactagttttatagtgaattagtagcttcttagtaggacatttcagggtggtacctttacttcattgataaaataggctttttctcaaaagtaagtcaacaaaacaatttcagtgtattgagaaattatgtttactttaatttgctctctgttactcaaacaaataaacacattcaaattcctagttgttttgtttcgtcctttgagagtgaatttcatgaatcagttatacattgcaaacaaatctctatttaaaataaatgttttatgattataactaggaagtgctaatattctgaaataatatagataaggatttactctcaggtattccttatcaatatatatgtaaatatatattttagatatatttctgatatatttcattatctactcttctatgtaatcactggtatttctgatataattctgatatatttcattacctactcttctatgtaatcactggtatttttgtgtaaccatttacattggaaatatgtgactgagatgttgacttagaattctgtgttacagattatacagtatgttattaatttttttttttttttttttgagacagtgtcttgctctctctcccaggctggagtgcagtggcgtgatctcggctcgctgcaacttccgcctcctgggggttcaagtgattctcctgcctcagcctcctgtgtggctgggattacaggtgcctgccaccatgcccgactaatttttgtatttttagtagagatggggttttgccatgttaacctgcctggccaacatggccagttttgccatgttggccaggctggtctcgaactcctgacctcaagtgatccacccaccttggcctcccaaagtgctaggattacaggtgtgagccactgcgcccagcctattgattttttaaataatgcatatttaaatttttactattttgttatccttttctgcagaaagacttgtaaatatagaatacatggcagtagattaggggattaaagtgactagaattgtggggtttttataattcctgatgtcagtgagtatactacctcttgatatttgtaacaaattatattaaactgcaaactggaggtttcccatcagtgcatcagtcagtcataccttaataatcaggattgttctgaggcaagataattttttacctttataggttaagtataacaattcttacatatagtacccgtttgacattgtgtcaagttttcagtgatacagaactgtggaaaatataaagtgaaatatcttttaccttttctcatgctccccactcccagtttgctgtctcagtaattttatggaattaatctacgtgggtaaatgctcacatccttacatctttatttttttttaaactgcctgtcttccctctttcccaggatacttttgaaattagatatatataaattacatgctgtatttgattaatctattttagtttttactctgaattaattgcaaggaaagcttcaaacttcattttgtcgtattctttttaaaatgtattttttgtttaaaagcataagtgttttctactctttatttgtgatggaaaaatatgagaatccaatagtcaaccaaggtaacggaactaagaaattgacatttctaatggaaagggacattaaaagataattttgcttaacctttgttttagatttgtgcattctgagaccactttaaggttgcatgactcagtaatgacagttgggattattaatgctctatttgacaacaaaagagaattctggagattaatataaaaagactttttaaaaaatgactttgcatttttctctaaatgatatatttgaatataattttaattggacatttccttgtgtctctatttttaaaagatttaagaattttttaaaacattactttgaaaaatactagactatttaacttgttagaaaaaagcaaattgtctctttcaataaatttctctcctaatttttttattactccatatagttcccagaagtattggggaaggtttatagaataagatagcacatattagataacagtagatacagagcttagaataaggggaaaatgaagacagaatagtgagagtaaaactagagtaaatttaatacatagaatagataccatgaggattctggaacagaaaaagaacatcaggcataaactagagaaatctgggtaatgtatggactttagttaataataatgtatcattattgattcattgattgcgacaaatgtaccatatttatgtaagacgttaatgataggggcagctgggtttagaggatattggaactctctgtactatctttgcaccttttctgtaaatctaaaactattctaaggttaaaagtttatttgcccatttgtgatggctgacacctgtaatcccagaactttgggagaccaaggctggcatattacttgaggtcaggagtttgagaccagcctggacaacatggtgaaatcacgtctctactaaaaatacaaaaattagctgggtgtggtggcgcatgcctgtaaacctggctactctggaggctaagcaatgagaattgcttgaacccaggagatgaaggttgcagtgagctgagattgtgccactgctctctggcctgggtgaaacagcaagactctgtctaaaaaaaaaaaaaaagtgtatttaaataaaatagataccgtaaggttttgtaccattgacagaatgtaaattcagctctgaattttcagaggatagaagaagacattatttcaaaattgatataaggtgaatttacaccagttcctcagaaaaagtagcttttactgaacatgaaatttgagaggaaattcttccttggactctcatggagagtcttttgtttctgtgttgaacagtatctccaacaatagttttacaaagaacatgacggtgagttttaataggctgcttcttataatccaaggatgtaatgtaaaaatgtattactatgaactacaattcctaaataatctggtcttaaatcataaatgtccatgatctcaccttctacatttcccccattttttcctaggctcctttctttacctaaatcaggccaagcttcctcttgcagtctaatatagccacttagtcactttatattgcttcactgtagtttatttctttgcatagcatttgttacttactgatatcttgttttaaaaattgattaattctctttctgggatgtaagtctcttgtgactagtgattatgactttttaaaatttttatatctagtatccgaaataggcatgtagtttacatatttacttgacacatcattgagtaggaataaaagtgaatccttttcctcaattccttgaagccaatgtactgtttataaaaaaaggagtaaattaacctaggttgcttctctatgtgtgtgtgtgttttaaaaatttttcaaattctcttgatctattatgtttagatgcagaattttacctgctggttagatggccaaacatattattagtagttgttgttttacagtactggcattttggtttcataaggtatagtctgagatgacacatacggtattttttaaaattagtagaggagcagatgatacaagattataattttaaaggttttttgtttttgtggcatcatgttttattgctgagaaactatattttatgaagtattgagagactatgtattttgtcaaaacaccaattaaaccgtttctttttgtgtttttatgtttagtatgcctcctttcaaagatacatgaaattggcatagatttgaaagaccatatgtgagttgttagaggattttttgatatatatctactcagtggaatgtattttttagactatttaaattaaaatagacctattgcttgatagttttccttgtatattttgcttatctttttatcttacaatacattccttttgatggagagtgtacatagctaatgttagcttaattcatctctgactcagcttaatacagctatctgactttctgaaattggatgaataaatagagataaggacataagtaactggccaccacactagtctctgtttttctgccatttcttctttagtctccctgttccctctccagtcttgtgaacaggttttgttagaaattttggcttaggttctctctgcttattctgcttggttagcagatgtgttacagtctccctaagctccttagaattcagttcttagtgacattgaagatgaaagtgcgcttgtaaattattcattcttattatacgcttcaatggacagggtctacttcaagcatcttcttccatgtcacccctgtccctagatctttgttgttttaacagatgtgagcttgctttttaattctggagaatggaagactgaattgcatttctaaaattcatgaagtagtttttgcatttataggattactgtcaaatatgtgcatttatataacattactttttcatgttattttaaatcttgtcccctctccccagtttccactttgttatcctgcatatttgtctctaaaaaaattatttacatgacttttctgacctagctataaaacagtttgatgtttataataggcagagctatatttaatttgctacattttcagctgggcaaaggcaggagagtagcttttctaagttccatttttctgttagcattgttttgtcagtaaggtaccctagtcatttattgtctctgcttgaagtgggataatgttgcatgagaagactatacaagggactagtagtgaggttaaccccaagaatgaagtggtagatctatctgtaggcactgagccttgttgtgagagccataaagaaatacagatggctaagagtggaggttgagacaatagcaagccaacaaaatagttgccatctctttaagaatgatatattttattcttcattaactccctttaggaaggatgaaaagttctgattgatactcaaagtcatgtaatggagttatttctgaagggtgtgccttattatttgtttcatgtttacattggaaagtgatttgcatattcatttgtattatgaaaatgacagcttgtagataacaagaactattaacttcaaaaatggactcgtatattctataaagatgtcactaacttcagtctagttcactaagaggcaaggtgtacttctgaagaacaaatagcattgctatttgatttgaagaaatatctacttctttttcacagaaagagaattagatctaatttaatgctcattgttatgacgttagataatgatataaatagtaaaattatgttatgataacaaatataatttttagtagcatacaggtaggaagctggaagcaatgaagaaatgttataaacacgggtttataatcctttctttgtgacactgtttaatgcatctttagtgtttaaaatatttcatcacctgtaaaagtcactaatatatgaagtcactgttttagttatcacacagtgtcatttcctttttattgtcaagtttgagagaaggtaatgaaatagggaagagataatgataaaacattaaatcatggaacaaaaaagttctgggaattacaaatgtagactctacgttgtagaggaaaagataccagcagatgaatctgatgatttcagatagaatttcctgaagtagacattagaaagctggagcaattgttaaagtttaaagttggcagagttcaaagtaagggaagttcctttttgagttgttttcattttctttaggcaagaccacctaaggtgttcagtaaagaaacaacgagaaagctagaaagaagcatatgaagttgtgatcagagagtagtggttttccagtattaggtatcattgaataaaggaaaaattcctgccactgaaatggaagagatactctaaaaatcatttggagtagcattgacttcagttatctgaggcagtatgaagaaaaaaaggtagtcaataattggaaaagtagataacctcttgcattagtttccttcggttgctgtaaaaaccacagacctggtggcttaaaatgacagacatttattctctcacagttttggaggccagaagtctgaaatcaaggtgtctgcagggctaccttccttctggaattctgagagagtatctgttttttgcctcttacagcttctggtggttgctggctttcttggcttgtggccactccaatccgtgcctctttaccttgtcctttgtctgtcctctgggtatctaaggacatttgtcattggatttaaggtctgcctggacaatccaggatgatgtcatctcaagatctataattacattacaaagactcttttttccaataagatcacatcacagattctagggatttgatatagatatctttttttggtggaggggaaggaacacttttgtgcctaccatattcttaaaaaaatttttgttgttgttgttgttttagagacaggatcttactctgtcatctaggctgtagtgcagtggcaaaatcatagcccactgcagcctcaaactccggagctcagtagactgtcccacctcagtctcccgagtagctaggactacaggcgcatgccagtgtgcctggataattaaagaaatttttttgtagagacagggtcttgctatgttgcctaggctgatcttgaactcctggggtcaagcgatcctcttgcctggcctcccaaagtgctgggattataggcatgagctgccattctcagcctactatatccatgcttttacatttaaaaaaatattataatgttcttcaaattgtgaactagagcttgaagtccaaatgaggcatttgcttcacgtgtttctacctgctgtattgtgaaaggagcagtcaaatggtgtcaaagaaatattcaggtatgatcccggaaagtgaaaaactggccaatagatattagtcagacttgagtgtataaaatatagtaaaggaccatttatctgcctctagtgatagttacctgcaaaatattccaagttatacctcaaatttatctttatttctgatatccttcctgggggaaacaaggaccacaaatctctttttagtacactggatcaatgtattccccttccccaattttttttttgattgtggaactttttaaagacataaaaaagtggtgaggatgtataaagaaccccatttttcaacaatcgagctttaaccattatcagtgaaggggctaatcttgtgtcaccccgactcctgattgttgtgtgcacacacacacacacacacacacacaccatgttttctttatctgttcatctgttgattccatatcttggctattgtgaatagtgctgcaatatgcatgttggtgctgatatccctttgatatactaattttcttttctttggattgggggattaagtggtcattctatttttagtttttttcagaaacctccaatctgtcgttcccagtggctgtagtaatttacattcccaccaacagtgaataagagtccccttttctctgcatcttcagcagtattgttatttttgtctttttgataatagttattctaactggggtaagttgatatctcattgtggttttgatttgcgtttccctgatgattagtgatattgagcacttttttcatatacctattggccatttgtatgtcttcttctgagaaatgtccattcaaatcctttgcccactttgtaatgggattgctttttcattattgagttgtttgagttccttgggtattctggatactatttgcttttcagatgaatagtttgcagatattttctcccactctgcaggtgctgtcttcactctgttgattgtttcctttgctgtgcagaagccttttagtttaatgtagtcccatttgtgtgtgtgtgtgtgtgtgtgtgtgtgtgtgtgtgtatgcgcgcgcacgcgcgcgcttttgttgcctgcgcttttgaagtcttagtcatgaaatgttttctcagaccaatgttctgaaacatatccctttgttttcttctggtagttttatagtttcaggtcttacatttaagtcttctgtccattttgagttgatttttgtgtgtggtgagagagggggatctagtttcatttttctgcatatggatatccagttttcccagcaccattttttgaagaggttgttctttctccagtgtatgttctggagcctttgttgatagtcagttttctgtaaatatgtgggtttatttttggattctttattctgttccaatggcctgtgtgtatgtagttagtccagtatcttgctattttggttactatagctttgtagtatactttgaagtcaggtagtgtgatgccttcagctctgttctttttgcttgggattgctttggttattcggagtcttttgtggttccatgcaaattttgggatttttttttctatttctgtgaagaatatcattgcattttgatagggattgtattgaatctgtagattgctttgggtagtgtggtcattttaatgctattaattcttctgacccatgagcatgggatatctttctgtttgtgttgtcttcagtttctttcattggtgttttgtagttctcatcgtagaggccttttgcctccttcgttaaatttattcctgggtgtgtgtgtgtgtgtgtgtgtgtgtgtgtgtgtgtgtgtgtgtatatatatatatatatatatattatggtagctattgtaaatgagattgctttcttttcagttcattattggtgtatagaaaccctactgattttttgtatgcttattttgtatcctacaactttacggaatttatcacttctaagaggtttttttggtggaattgttaggtttttctatatctaagatcatgtcatctataaagcaggacaacttgactttctcatttccaatttgggttcctttttatttctttctcttgcctgattgctctggctaggaatttcagtactatgttgaataagaatggtgaaagtgggcaagaatggtgaaagtgggcaagaatggtgaaagtgggcagttgttacaaggaaggctttcacctttccccttcagtatgatgttggctgtgggtttgtcatatatggcctttattatgttgagatatgctctttctatgcctagtttgttgagagtttttatcatgaaaggacattgaattttatcagatgcttttttgtgtgtgtctattgagatgagcatacggtttttgttttctggtgatgtgatatttcacatttattgatttgtgtatgttgagccatccttgcatccctgggataaatcccacttgatcgtggtgcattatctttttgatgtattgatggattttgtttgttaatattttgttgaggatttttgcttctgtgtttgtcagagatattggcctgtagtttttttgttgtgtctttgtctgattttgttattggggtaatgctggccttgtagaatgagttaggaagagttttctcctctccagttttttggaatagcttgaggagaattattgttagttatttacaggtttggtaggattcagcagtaaagccatccaatcctggaattttcttggttgggagactttttattactgattcagtcttactactcgttattggtcttttcaggttttctgtttcttcctgattcaatcttggtaggttgttcaggaacttaaacattttctccaagttttaaaatttgttagcattaatttgttcataatagtgtctaataagtttgtatttctgtgggatcagttatagtgtctccttttttctttctaattttatatgggtcttctttttttcatggttagtctgactagtagtttatccattttattttttcaaaaactttattttgctgattgtttgtatatttttttagtctctatttttgtttatttctgctctgatctttattattgcttttcttctcctgatttgggtttggcttgttcttgcttttctagttcattgaggtgtatcattaaataatttgaaatccctctacttgtttgatataggtatttattgctataaactttcctcagcactgttttaacagtgtcctgtaggtttgggtatgttgtggttctattttcacttgttttaagacatttaaaatttttctttttaatttctgtattgacccagtggtcattgaggagcatgttgttaattttcatgtatttgtatagattccgaagttcctcttgttattgatttatagttttattccattgtggtctgagaagttacttgacattattttgattttttaaaaattcttgagatttgttttgtggcctaacatatggtctgtcctagagaatgttccatatgctgatgagaagaatgtttattctgcacctgttgggtgaaatgttctataagtgtctgttgggtccatctagtttaagtgcagttaagatgtttatttgtttattttctgtcgagatgattgatccaatggtgagagtagggtgttgaagttcccaactattagtgtattggaatctctttctttagatctagcatttgccttaaatatctgggtgctctggtgttgggtacatacatgtttagaattgttacatcttcttgctgaattgatttttttatcattatttaatgaccttctttgtctcattttacagtttttgacttaaagtttgttttatctgataacaactcctgctcacttttggtttccatttgcgggagatatttttttccttccctttcagtctatatgtgtctttacaggtgaaatgggtttctggtaggcagcatataggtggatcatgtttaaaaaatccattcagctagtatgtatcttttaagtggggaatttaatccatttacactcaaggttattattgataggtgaggacttgttcctgtaattttgttcattattttctgttaattttatacatcctttgcttttttcttctgttcttgtttatcatgtggtttggtggttttctgtagtgacaacatttgtctccattttctttctcatttttgtgtatctgctgtaccagtgaattttatacttcagtgtgttttcatgatggtagatattattctttagctttcagatgtagaattcccttaagtattttaggactggtttagtggtgatgaatgaatgccctcagtttttgcacatttggaaaaaaaaatatttctccttcattttttagggatggctttgttgggcatagtattcttggctggcaggtttttttcttccagcactttgaatatatcatctcattatcttctgacctgtaaggtttgtagtgagaaatctgctgttagtctgatggtaattacttgatacgtgacttgacaattttctcttgatgttttcagaattctctctttgtctttgacttttgatagtttgactataatatgcttggcggaggacctttgtgggttgaatctgtttgggaattattgagcttctggatctggataaccaaatctcttgcaagtcttggagagttttcagttattttgttaaataggctttttatatctttacccatcatttcaccttctgggattcctagaattagaatatttgtctgctttatagtgtcccatatgtcacataggctttctttagtttcttttattctttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttagagcagcatgatttatagtcctttgggtatatacccagtaatgggatggctgggtcaaatggtatttctagttctagatccctaaggaatcgccatactgacttccactatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtggtttttggctgcctaaatgtcttcttttgagaagtgtctgttcatgtccttcacccactttttgatggggttgtttgtttttttcttgtaaatctgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcagttgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagaatgatattggctgtgggtttgtcatagatagctcttattattttgaaatacgtcccatcaatacctaatttattgagagtttttagcatgaagggttgttgaattttgtcaaaggctttttctgcatctattgagataatcacgtggtttttgtctttggctctgtttatatgctggattacatttattgatttgtgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctatcgattggaatagtttcagaaggaatggtactagttcctcctcgtatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattctttctttctttatttttttttgtactgactgggttatttaaaaagacttgtcttcaagttcagaaattctttcttctgcttgatctagtctgttgttgaagctctcgattgtatcttttatttcattcattgactacttcagttctaggatttttttgatttttaaaaatggtatctttttgttgactttctcattccgatcatgaattattttcctgatttctttatattgtttatctgtgttctcattgagtttctttaatattattttgaattgtttttcaggcatttcataaatttctcttttttgggattttttttctttttactggagaacttgtgtttctttggagatatcatattttcttgctttttcatgtttcttgcatccttatgctgatatctgcacctctgatttaacagtcacttcttccaattttatggattgactttcttagagaaagactttttcctgtaggcataactgtagtgttgattgggtaggttgctttggttttgattctgggtagggcagtagtgtagtttctgaattatttatgtagctttaattagtgtcagtggtatctatgagtttctcattggcttagactgtgttttttagtgaaggctgtttgaggctttgctagggatgaaaacactagaccagctagtccttgggcaccagtggtggtggcagtgggcaaggtgggcaaggtggacatgtccccaagccactggatggcatgtgtggatgccagcagtagtgatcagggtgggttgattcccaggtcactagttggcacgctcagactcaagcagtggtggtgatgggtggagtgggcttgtcttcagttcctagacatcatatatgtatgtcagcagtgggcagagcagacctatctgcaggcctctggataacgcatgcgggtgccagcatcagttgggtgggtatttcccagttcctaggctcccagatgatgtgcgcaggtgttggccatggttagcagggcagacctcttctcaggcccctgattatgcacataatgcaccaatggtaggcagggcagatcagtcctcagtcatcctgatgacaggcgcagctactggcagcagtggtgaacaagggcaggactaccctcatgcccccagattttttacatggcccctaattgttttatgtgtattttaagatttattagcttgaatagggacccaaataagattcatcatacaatatattgtgattgattagtaggtctcttaatttttcattggtttgtaatgacaccatttggtacagaaggcactagccatatgtagctatttacattgattaaaactgaaatgaattaatctggtccttagttgccctacccatatatcgagtactcagtagcgatatgaggttaggggctaccatactggacagtacagattatttctcttattacagaaaattctgtttgttagagctaatttataggtttctgctgcatctcttttttttcttgaatttttggtttgtctttttacaattttattattgttgttgttattttttgatggaagaaactggcttattcaggttttttgtttttgtctcccagagtctggattttgctgattgtactcctgtggtgcatcttagcatagtttctgttctctttatttacagtaaatttgtagttaaatctagaagcttgtttctattctgactatatataatgtgtgtatgtatttttctcaagaacactataggtgctggatatatatatatatatatatatatatatatattatcagattatctgttttgttactactggtgatcattgcctaaccctagatcttttaattcattaaggtttacaaaatggtgatatcctaatgctcctgtgtttattagccagaattcttctataaagggaaacttccctttgtcaattatttggttattcttacatacagattgtataggaaagatagcataaatgcttaattatttccctttgtttacctttttcaaaataatgttgattctgtaacatttttccaaagatgaccagtgaaacattttaagtgtcttattcaatttgtatatttcaatatatttggtatattttggtacagtgcagttttatccctattaatgattaaattctcatctttggccagtgggagcctattcagttggttttctcattccttttgatagactcttagtatcctattataacttcttttctatttgatattacaaaaatttccagacttgacatatatatttccagcctgggacctccaatcagccatttttccagggactgttggttgtttttttttttttttttttttttttaagtaataatcatggaatcttacttccttttagacaccacatactggacactgctttggaagtatcattgctactgggttattcactgtttcaggctttctgtttcatggaacagaaatgcatgcatatatacactcttataaatataaatgtatatatatattttaggataaaattctttattctttaaagcttaaagtcttagtacactttggatttgacaaaatgtgtctactgtagctgaaaagataaactgcgatgattttaagcattaagtaatactcttaggcatggcaaccacaagcataactttttgggattagggtattgggggtgggggatctacctgtattgattaaaatttcattttcttattgaaggttgaaaggtgaaagattgtttgtcaccttcgaaacagagtgccaattcgtgtttcctgatgagaaattgaccagctatgtgtttactgtaagaggtgcaatcagtgaaattggaaaaggaaattgaatttatattggtgtattatcccatgcagttaattttgcaaataccctaatgcacatgaattttatttgaggttgagatgcctatatttactctgaaacaaagtgttggaaatgtagtgtgattaaatacatttcaaattttctcttgttccacaattgctgtgcagttccaaaatatgttcttattaggttcctcacaaaggaatcttttggccattacaacaagaaaatgagatagttaattttaaaggatacatcaaaataagataatttacattgtaagatttattattttcacgttcctgttttttctgtatgggatcctctaacatgttagcaaaacaatatgtcgtctttctataagactataatttccacttaaggaaaactatgatatgattcactcttgacatggcaaaaaaaagttaggttaataaatttacagcaaagaagaatttttaacaatacaaaagtaacacaatatattaggtagatatcctcagaagcagtttattcgcaatggccatgaaagaatcttcctaaaagtagtagtaagagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatgaagcatggagggttatcactggagaatagttagctgtatggataaagccagcttcccaaggagcttaaataatttaaaaagttggactttatttggtagactagtgtattctaagatttggagttactagtttaatgcagactggatttatagaccttcgtgggttccttgttctgattcagaagtatccataaaaatataggctttgtgctgtcttgaactgattaagtctaaggaatgcaggcttcaggtatggtcccattgagtttccggctctactttttaaaatgattcttacagctgtgtcattatccatgttggagttctccaggtatctgtcagcaacaattagagccatatgctcccttcttcaggaatactggaaaaaatagatgcatgattttcaattagctgtatgacccagaatatgcatagaaatactgtctttttcatgtgaaaattcacataacacaaaataaccattttgattgcatttagtacattcactgttgtacaacatctacatctatcaagacacagaagctttttttttttttccccgaggcagagtctcgcactgtcacccaggctggagtgcagtggcatgatctctgctcactgcaacctccgccttccgagttcaagcaattctcctgcctcagcctcctgagtagctgggattacaggtgcaagccaccatgcctggctatttttttttattttttatttttagtagagacaggattttaccatgttggccaggctggtctcgaactcctgacctcgtgatctgcccacctcgatatcccaaagtgttgggattacaggcgtgaaccaccatggccagccctacagaagcattcttaaatggaatttatttaagctgaaaacagtattttctataaagtaatattttggcatatgtttttctagctaatttttcagtcaatatcagttgtagaaatatgtattttaaaaaagaaatatttacttgtattaagagttaagatttctaattttggagaatcaacaaaaataacggtcagaatagaatttttatcttgacagtagttggaagaatagttacatggtgagaaaaccaggatagatttttaaatcattttttaaaaaacttttaagttcagacttacatgtataggtttgttacataggtaagtttaaatcatggggatttgttgtatagattatttcatcaaccaggtattaagcctagtacccattagttatttttcctgatcctctccctcctaccctccaccctccgataggctagtgtgtgttgctcccctctatgtatctatgtattttcatcatttagcttccacttataagtgagaacacaaatagaatgaagtgcagtggtttaattttaatagtggaattgtttttcaagttatacctgtccctgctgtcctttggacttgagagattctacctttttaaagtacctacataacactatctgaatagggctgtggaatataggcagacccaattctcccctgttcctgtttatagattttgtgttgtgaacctagaaggattgtgcttcctgattttagttttctttttcttgtctttactgcaactctccagaaaacctacagaatgtttattggaaacaccttggtagaagagaagtgttgtttgttgtaaacataaatcctaatcttttgtgcaaaatattttagaaatattttaacttttatttcttagtaagagacctttcagggtcctgattatggttgtggagatctttattatccattactaatttttctcattgtttctttttgtctttttggaggtagtgatattggtgctgaagtagtgatgtgaggatgatggcagtagtatttctaattagcatttcttgttgaggtcttttagaacgcctagttggaaatttaaataaaacaattaggtcaaatgaatttagaaaagctgaatagactatttaggcacaatattcggccaatatgaaaaaactggaaaaaatagatacatgatttttaattagctgcgtgatactgtttttagattaataagtaaaaggaagtttaattgaacatctattacaaataggagttttcagaattttcaggtggatgtaatcagtagccagtggtttttgcctactgtttttgtggatagtagcatctgactctcatgtcatctgtgatttacaagactgcatctaaagaagtatgttcaatttcctgtttttgttttgtttaataaacactttgtaattccttactatgtgtgtttgaggtgatgaaaattttggagataatagtgatgatggttgcacaacattatgaacgtacttaatgccattgaattgtactcttaatattggttaaaatggtagaattaatgttatatatattttaccacaataaataaaaggcaggacaaattttatcagtaaatttacgtttctggaagatttagttctaaaattttttagtggagattttattgcaaggtgatttttttttttaacctatattcctggcataactgactcctatttttagccctaaatattcaaaagaacaggaaaacgtgactctgcatatgactttccttaaatattttttgaatgttttatttgaaatatcatgcaactaaaaatttcaaactctttcataaaggtaatgtttaattttttatgttgtaaagttaaatattgttttttaacaaaaattttccccaaaatgaaatgtcgaatttgcatttttaaaagataatttttaaatctttatcttcagatagctgtagtcttataagcatgtaaagtttttttttttttttgggggggggggggcgggggcggggacaagtctcgctctgtcgcccaggctggagtgcagtggcacgatcttggctcactgtaacctccatctcccaggttcaagcagttctcctgcctcagcctcctgagtagctgggattacaggcgcccaccaccacacccggctgatttttgtatttttactagagatggggtttcaccatgttggccaggctggtctcaaactcctgacctcaggtgatccacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgtactcttgtttgtctggcttctttcagtcaacctaattattttgagattccaaagtagcagtgcaattttacgttcacttagaatgtgtcaatgtttcattttttttccatgtcttcaccaatacttggtattgtcaatctatttaattttagtcattacaataggaatgtggtgttacctcgttgtgtttttaatttacattttccaaatgactaacgatattgagacttttcctatttatttgccgttggtatatcttctttaggaaaatgttcaaatcttttgcctatttgaaaaattgggttgtttttctcctattcttgagttttgagggtttttttttttttaatttttttatttttattttcgagatggagttttgctctgtcacctaggctggagtgcaatagcgtgatctcagctcactgcaacctctgcctcccaggttcaagcaattctcctgcctcagcctccctagtagctggtactacaggcacctggctaatttttgcatttttagtagagacagggcttcaccatgttggccaggctggtctcgaactcctgaccttgtgatctccccgtcttcgcctcccaaagtgctgggattacaggtgtgagccaccacacctggcctgtttaatttagttttttttttttttttaattgatcattcttgggtgtttctcgcagagggggatttggcagggtcataggacaatagtgtagggaaggtcagcagataaacaagtgaacaaaggtctctggttttcctaggcagaggaccctggggccttctgcagtgtttgtgtccctgggtacttgagattagggagtggtgatgactcttaacgagcatgctgccttcaagcatctgtttaacaaagcacatattgcgccgcccttaatccctttaaccctgagtggacacagcacatgtttcagagagcaccgggttgggggtaaggtcacagatcaacagcatcccaaggcagaagaatttttcttagtacagaacaaaatggagtctcctatgtccacttctttctacacagacacagcaacaatctgatttctctatcttttccccacatttccccccttactattcgacaaaaccgccattgtcatcatggcctgctctcaatgagctgttgggtacacctcccagatggggtggcggctgggcagagggtctcctcacttcccagaaggggtggccgggcagaggcgcccccccacctcccggatggggcggctggccgggcgggggctgccccccacctccctcccgaacggggcagctggccgggtgggggctgccccccacctcccagacggggcggctgccgggcggagacgctcctcacttcccagacagggcggctgctgggcggaggggctcctcacttcccagacggggtggctgccgggcggaggggctcctcacttctcagacgggtggctgccgggcggaggggctcctcacttctcagacggggcggccgggcagagacgctcctcacctcccagacggggttgtggctgggcagaggcgctcctcacatcccagacggggcggcggggcagaggcgctccccacatctcagacgatgggcggccaggcagagacgctcctcacttcccagacagggtggcggccgggcagaggctgcaatctcggcactttgggaggccaaggcaggcggctgggaggtggaggttgtagccagccgagatcacgccactgcactccagcctgggcaacattgagcactgagtgaacgagactccatctgcaatcccagcacctcgggaggccaaggctggcagatcactcgcggttaggagctggagaccagcctggccaacacagcgaaaccccgtctccaccaaaaaaatacgaaaaccagtcaggcatcgcggcgcgcgcctgcaattgcaggcactcggcaggctgaggcaggagaatgaggcagggaggttgcagtgagcagagatgggggcagtacagtccagcttgggctcggcgtcagagggagaccgtggggagggggagagggagaggggggagagttctttttatattttagatacaagacctttatcagatgtagattttgcaaagatttttcaaaagtagagcttttaaattttgatgtagtccaatttatcagttcttttgtggattatgtttttggtcaaatcttataattctttgcctaattcaaggtcacaaagattttctcctctgtttgcatctaaaagctctgtagttttaggttttacatttaggtctgtgtccattttgagttaattttttgtatgtggtgtgaggcgtggaacaaaattcattttttatatacacatatcagttgttctaacaccatttgttgaaaagaccatcctgtctccactgtattgcttttgtatgcagtagttgccccttatctgctggggatgcattccaagacccccagtggatgcctaaaactgtggatggtaccaaattatatatacaatatttttctatacatttatacatacatatgataaagtttaatttctaaattaggcacaataagagactaacaataataaaatataacaattataacagtatgtcagcatcattactcttgccctttgtggccattaaataaaataagtgttacttgaacacaagcactgaagtaccatgatagcctgataactgagatggctactaagtgactaaagggtgttagtgttgttccctatacgaagggatgattctcatcccaggcaaaatggagcaggaaggtgtgagatttcacagtgctattcagaatgacatgaaaaaatccctatgaattgtttatttctggaattttctatttaatattttcagacagctgttgacaatggtaaccgaaactgtggaaagtgaaaccatagtttaagggggctattttatttgtcaaaacgtcatgctgggcacggtggctcatgcctgtaatcccagcactttgggaggccgagacagtggatcacctgagtgaggagttcaagaccagtctgatcaatatggtaaaaccccatctctactaaaaatacaaaaatcagctgggtgtggtggcgtgcacctgtagtgccaggtactcgggaggctgagacaggagaatcgcttgaacctgggaggcggaggttgcattgaggtgaggttgtgccactgcactccagcctgggcaacagaatgagactctgtctcaaaaataaataaataaataaataaaaataaaaaaataaatcagttgttcatgtatatgtaggtctatttcttgattactatagctttagtaatagtcttgaaatcaattagcattgttcttattccagctttgttctttttttttttttttcaaagtagttttgtctattctaggtcctttgcattttcttatgtattttggaatactctatccgtttctataaaaaaaagcctggtaagatttttattgggattgtattgaatctctagataaatttggggaaaacgttgacatcttaatatttaatctttcaacctgagagtaaggtatatatttctctttggtcttctttaatttctctcagcagtgttttgtagtatatgggttttccacatctttaatcagatttatttctaagtattcaattttttttgatgctcttgcaaatgatactgtctttccatttcaatttccaattgttcattgctattatgcaaaagtactatatatataaagatttttatatattgatcttgtgcaaatttgctaaactcactttttagttacagtagctttttaaaaatagattccatcagattttctatatagaccaagtgtcatctgccaatgaagacagttttacttctacctttccaagctgggtgcctttttatttcttttacttgcctggttacgctgggctgaatctctaatgcaatgttgggtagaagtggtgtgagtgggcatcccttgtttgctgagagtttttattaggagtaagtagacattggactttgttaggtgcttttttcatatttattgagatgatcatatagcttttctcttttagtttgttaatgtggcgaattacattgattttcacatgttaaattgaccctgcattcctaggagaaaccccacttggtcattacatatcctttttatatgttgttgaattagatttgctaaaattgtattagaatttttacatctgtatttatatgggatattgttctctagaagtcttataatgtctttgtcttgttttggtatcagggtaatgtttacctcatagaatgaggtaaactaatgaaaagaaagaattcttttcattagtgcggaagagtttgtatatatctggtattattctttttaactgtttggtagaatccactaataaagtcatctggacctggaactttcttcatgggaagattttaataggattgtttaggttatctgttttttcttgagtgaactcttgatagttggtatctttcaaggaatttgtctatttaattaaaattgtcaaatttattggcttaaagttatttataatatttccttattatcctttacatagtgatagaagctatagccttgtcaactctcacattcctgatattggccatttgtgttgtcttcgttcccttcctcctccttctcatccttctctagcatcatcattatcagtctggttagagatctatcaattttactgtcttagtcatttccttgatttttctctcatattttttccctgttctctctctctctctctctctctctctctctctctctctgtcgtctgtctgtctgtctgtctgtctcgtctcatcttgttgcccaggctggagtgcggtggcacaatcatagcacgctgtaacctcaacctcctgggctcaagcattcctcccatctcagcctcctgaataattggggctacagacgcatgccaccatgcccagctaagtcttccattttttgtagagacagggtctcactatgttgcccagcctggtcttgaactcctgggctcaaggggtcctcctgccttggccgtccaaagtgctcagattacaggtgcgaaccaccacacctgaccctgttttctttttaattgatttcctcttcgattgttactattttcttccttctttctttgagttaatttcctctttttctagttttttttttaaagtggaaaatgtatttctgttgcgacccttttctgttgtttggcaattttaatcagtgtttttgaagagaatgctgatatacagtagtatgctatttagaatcaatttagtttattagctggaaagaatagctgatattctggaatgttagaatccaagaagctaagatggtagcctaaatatattaagatgtgggctaattaagaaaaatctcaaattctctgctcaataccaaaaaatcatttaggaaaatatgggaaaagggagaacaagatttttagtgcagtattggttaaatgtaggcagtagcatccaaagtgcctggtttggatactactaagtatatggttgtttgaatgtaatatagccccagataatctaatctgatgaaaatattaatgtaaataaagtgttcagaaataaggaaggtaattatctcacacttctttactgaataggctacctcaggaatcttgtatttatttatgagcgtcactctgctgggtttagacacactagaattctgttggccagagtaggcaaatttgtaagtggacagaccatgctataacgaatcttggactcatagaatcttagaatggataaggatcttagagattgccttattttttatcataggaaaccaaagccaggagctgtctattggtttatccagtgttacacaaataattggtgacagtgttgaagattggattttcagtttctggagggcatttcagcattctttccactgaaccatcttgtcatcaaaatatagttcagaagaagattataggaggtcttgaaattatctgtatgggaaaaggtcaatgatcaacaatcaagagttacagagaagttgttttttttttctttatctttctttcttttttttgagatagagtttcactcttgttgcccaggctggagtgcaatggtgcgatcttggctcactgcaacctctgcctcccggaagcgattctcctgcctcagcctcctgagtagctggaattacaagtgtgcgcccccacacccagctaatttttgtatttttagtagagacggggtttctccgtgttgctcacgctggtctccaacttccgacctcagatgatcagcccacctcagcctcccaaagtgctgggattacaggtgtaagtcaccgtacccggctgagaagttgttttaatgaaagcttcttgagctatgtatgtggctctcaattcttggaggtagccatcaagggagtggacaatccctagagtggaatgtcatataatagatagatccatgtatcagataaactttgggctatatcagctacagagttttggggggttttttgtttgtttgttggagccagggtctcactctgtcacccaggctggagttcagtggcgctgcctcgaactactgggcacaagtgatacaagtgggtgccaccatgcctggctagttttttttttctttttgtagtgatgggtctcactatgttgcccagactggtcttgaactcctcgcctcaggtgatcctcctgcctcagccttgcagagttctaggattataaacatgagccactgcatggcctcagaatatttaccgtctaattttcaagcctgtctgatcttgtcaaactaacctgttttggtatcatcacttttctttattgtttacctattttgtattttattgatatccactctttattatttccttgctctgtgctctttgggtttaatttatcctgccttttctggtttttaaaagtataagcttttgtctctgctaaaatctctgttgctttatttttggctcttaccatcagccctctgcaggtataaatttcaggttctaaacttcacacctgattgtcaaattggtaatgttctaggctaagtgtcttcagaaagtaagttcacctctcttaagattcttcccctctggaattaggtcttttacctctagtttttgctctttcagcagctatttgctaccttgaaacaaatgacttaggtatattattcagttttctgtttgtttaacttgtaggtggtagttggcctccaggtcctccttcttgcctggaagtgaaccctccttaaatggattatttttcaatattcagtaatctgctcgtcttctagaagctcatattgattcacagaagcaagccatgccaaacacacgtaattttctttttcctttttttggagatggagtttcactcttgttacccaggctggagtgcaatggcacaatctcagctcactacaacctctgcctcctgggttcaagcgattcttctgcctcagcctcccgagtagctgggattacaggtgcctgccaccatacccagctaatttttgtatttttagtagagaaggtgtttcaccatgttggtcaggctggtcttgaactcctgacctcaggtgatccgcccactttggcctcccaaagtgctgggattacaggcatgagccactgtgcctagccctaattttcttttgaagttagttctcttaattgaataggagaatgtcataggcataaaatttaagaagactgttttttaaaacctgtcatgctgttcttgtggaggaccaaaatatacgagatgaatgataatatagttaggaggatttggagctgattgaacaacttataaccaaagagtattgacagattagtggcagccaaaagtgttttttttctgaacatgtacctcagaactacctggggattgctaaaaatatgcaaataccgagatcccagtctatatctcctacatcagaatcttgggtgtggattgggaaatattattttcaaaatatgtttttagagtctgtgatggaaacttctggctaagaatgatgaattaaatttagtggcacgctggaactgtctcacacaagattatgataattgtctttatctcttctcaaccctgtgttcactgctggtagcttgaaattggccatgataggagtatttacactatagaaattggcaaacctgcccaccaccccaggaaacattttctagcacactactattaggttggtacaaaagtaattgtgttttttgtcattgaaagtaatggcaaaaaccgcaattacttttgcaccaacccaatagttacatttaatagaattgaatagatatgaagtttaaaaaaatctgtaggatagaagaatggtagcatgattacagttaatataatctaagggtttagctgtttctttggtatgagccagtaataagatacaactttaaaaaacattaatgctatgtattaagttttatacagcaaaaaaaggtggtagtactactgtgcagagcattaatcagactgtccttttctggagtattgggtattgatgataggtgctgtgtttttaaaaggtcactgaacttttctagaaatgagccatcaatacatgggaatgggtttgaaaattgttgtaaagataatgattgaagaaaagtttaacatagagtacttaggggatacttcatagctctgataatgaacaaaaattagaatcattttatgtgaccacataaaatagtatttggaccagtgggtatggagtggcaaatttcgcttgttagaactttcacgtagttaaatttgcccccaaataaaattgttggagatgtcattaaattttggaattgaatgttatgtagctaccacatagggacattagggagaatttttgcatttggcaagaagaggactagatcagtgattcataactgtggttgcacattagaatcacctgggcaacattaaaaaacaaaaatcttggacagactgcatgcaccctaagctgactaaatcagaatcttgggacttgagcatctgtatttttttttttttttttgagacagagtctcactctgtctcccaggctggagtgcagtggcgcaatctcggctcaccgcaacccctgcctctggggttcaagcgattctcctgcctcagcctcccaagtagctgggattacaggtgcccaccaccacagctggctaatttttgtatttttagtagagacgaggtttcaccatgttggccaggctggtctcaatctcctgacctcatgatccgcccaccttggcctcccaaagtgctgggattacaggcatgagccactgtacccagccggatctgtatgttttaaagctcttcaggtcatgataatgtgcagcaaagtttgtgaattagattataatgtattttccaaattaattttacaacataattctgaccattcaatggtaacgctttgttttcctggaacagattttgaatgatctgcatttgtaaaatacatagaaaacctgggatatataaataccaaggaaatgtacagacatagatttattgaacctgagaacagagattctaattctggaaacactagttaaatgtttatgtgataatttcataatgattatcagtaatttatttaaagtccaatatgattaaataaaaatgcattttaaaaatttatgaaacaataaagaaaaaagttggaagtatatttagaattttatttcttaggattaaaatgtgactgatgatattggcatcagttgatgacattggcaaaatgttaataattgttgaagcagagcattggacatgttggggcttagaatattattctctgtactttttgctttattagttttgaaatttcaataaaaagttgacctttgttcttgcagcaatttaaagatgctattctgttgctttctggctttggtattttcttttttccgccttcttttatttttagttgatacttaataattgtacatatttgtggggtacagagtgatatttagatacatgtatgcaatgtgtaatgatcaaatcaggatagttgggttatctgttactttaaacgttttatcacttctttgtgttgcgagcatcttaaaaaatcacacatttaaattagctgtaatgtagagaaaatgattagataaataataatcctaccttacataaactgttcagtcatttcatctcattttaagttagatgctcttaagtattctcttttgagcaaataaaacactggacttataacaggatctgacatatctgaaagataagattggatgggtatgttagggctctgtctagtagaccaaaatgtttgaatttgatatttaatgaatattgatgtgttttagcatctttctaatttttttttcttggggattagtagagccaaaatatttagaatggtttacaacaaggtaagtggttctgacagaaagaagaaaagcagggagcagggccgggggcgtgggggtggtgttacgagataggagaggggatgcttttaaaaaagaaggtggtaataaagttcattgggttatctttcagtaattattaaaaataaaaaataattaaaccaaggcagagtgccttggagaataaacctgattatgagggatggcaaatgtaataatatattgacaaagggtagaatttctagactttcaaattccattgtcttaaaacagttggtaatgtgacagttctttagcctttttggaagttttgcttttttggtagagatacaacataaaagacttgaggaaataggtcatggtaattatctgtcatccagtaaaagaaatttgaaaatcattgatgtaaagcagcatttataaattgatgaattagagtaattataaattgatgaattagagatatggttttatatggcatgaaaaatgaatattataatttaatatattactagagtagcgattttcaaagtgtggttcttagaccaacagcatcacctgggtacttgttataaatgctaattcttggacctcaccccagacctactaaatcagaaacttctggggtggggcctggctatcggtgttttaacgaggtcttcaggggatttgaatgcatgcttaagtttggaaaccatggatttagaatactattgccttttgttgtaccagccaataaattaaattttgtgtatgctttctattcaagagttatgtgcccttatcatgcctttatatatatctccatatcagtatgtataaaagaatcagagggtaaaatgagagccttttgtggttaaatgtcattcaaatttagaaggaggccaggcgtggtgactcatgcctgtaatcccagcactttgggaggctgaagcaggcagatcacttgagatctggagttcaagactagcctggccagtatggtgaaaccccatctctagtaaaaacaaaaattggctgggacgtggtaattccagccacttgggaggctgaggcaggagaatcgcttgaaccccggaggcagagattgcggtgagctgagattacaccatggcactgtagcctgggtgacaagaacaaaactctgtctcaaaaaaaaaaaaaaaatctagaaggaaattctcccattttacactgacattggtgaaatccaggttgaatattagtgttttaaataaatttatcatatcattttttctttttggtgccatttgttgacatttagctaacaagtctgagagtgttagatttgacagactgtgggttgactcaggtggttgttcttaattggtctggaatgtcagttgacataaaatattaaagtaagttttgagaaaagggaagaaagaaattgtacctgccttggatttgagccaggattgaaaccgtcattttactcctggctatgtggttcatggtttgaaagtcattgtcctactatatgtaaaacatgtctttctaaaatttacattttgttatacagttgacccttgagcaacatagatgtgatctgtgcaggtctacttatattggatttcctttcacctctgccacccttgagatggcaagaccaacctcccattttactcttcctccttttcctcagcatattcaatgtgaagtcattgaggataaagatttttatagtaaccacttccacttaattaatagtaaatatatttttcttacgactttcttttctctagcttattttattgtaagaatacagtatataatacatgaaacatacaaaatatgtgttaatcgactgtttatgttactactaaggcttctggtcagcagaagggtattagtagttaagtttttggagagtcaaaagatgtacgtaaggccaggcttggtggctcctgcctgtaatcccaccactttgagaggctgaggttggcgaattgcttgagctcaggagttgaaaaccatcctgggcaaggtggtgaaacttcgtgtctacaaaaaatagaaaaaaaaaattagtcatgtgtggtggtgtgtgcctgtattcccagttactctagaggctgagatgggaggatggcttgagcctgggaggtcaaggctgcagtgagcctcccaagtagctgggattacaggagcccgccaccacacccggctaatttttgtatttttagtagtgacagggtttcgccatcttggtcaggctggtcttgaactcctgacctcgtgatctacccgccttggcctcccaaagtgctgggattacagacacgagccaccgcgcccggcccttaaaatgttactttaaattaacatacacactcagttatatgttttgattttatttagaactttcattttaagacaagactaagtgaaattgtagaaattagttgagaaatgagactgtgcatttcatattggcctgtggtgtaaaatgatctgacatataatgaaacttagttgaatacaaatgttattttatcagttttgtttttatctgataagttaatttatagttattaaccttgatttgactgtccttttgaaaaatcttgcctaagaaaactaaatgatcatcaaaacactggtcttaaaatagagttcaggctgttttttagcttgatacagttgtctctcttgctttgctttccttctgaaatgatgtttccattttggggactgggaagagcatgattatttatagactagtgtgttttggacaggtggtatgtttacacagatcagtggaattatttgtcccccaagacctttaatatgaatgcatttcattttatcactttttgtaattaaaagagcaaaataattatgtgggtgagtagagaacatcgtctttaattttgtatgttaatgcagcaggtgtccactatatattaggaatttttcagagatttggggttaccgataaaccacatagctttgtcattgaaaaattttaaagaccatttttgtatcttcttacagagcatacaacttacaaatatctctctgtcctccccgtttcggctttgtttgatagaagtgttctagggagtcaaaccctgtagaaaattggagcattcatacattgctgaaactttctatattacattttatattttaaaaattaaagttataaagtaaccattagcaatactgcataacagaaactttacaacttaaaatacttctgaaatttagcatgtgcacatatttttgagatttacaactattgttatattaattatgtaggtaacgtcaaagttatatactccaattattataccagggccttttttgccataaaaggtaccaaatcaaagcatcaaatgaaattctttcagtcaatctatatatgttagcagttttctctagtaaaactctacataaagaactgctttcttccttatagcaggaactactttcattttattcctttttgagagcccctgcctcttgagaaaatgcttcccatctggttagagactagatgacataatatagtcccattcagaaagatattgataataaaatagtctcttccttttctcttcccttacctgtcttcaactcttctggaacctcctctctgtcctttatctgttatgccctggtgatccagagccatcttaattttaaaattctccatcatattttttattatattgaattaacaattcattctagggtcatccagatacatcatttaccaggagaagcagttagcttgcctcttgagatatttggccgtttcattattgtgtcacatggttgaaaacctttctttttggatgttgtatatgaccattagtgcttttcagtcttttctgttcttacagttcatatttttacctttctttttgcaaacaaagatggagagaagagtaaattaaatactcttctgaatatgttaatacttagtttaataaaaaaccagaattacatcccaatttctggagatgagaaggtagtcaaaaaaatgagtaagctatggtcctataggggagagaatagattagaatacttatctaatgtgagacacatgttctaaaagaaaagagaatcaagtgctgtcagaataaaaaggtggcatactgacttgaggtgagtttgggatatcaaagaatatctagaggaggtgacctttgagcagggccttgaagcagggccaacttacccattaagcacagtaagcacagtgccttgggccgatgctatttatagcagcccataaaattcactttaattttaattaatttttacaggagaaaaaatgagtataatagtaatgaataatgaatccagcctgaattatatttgtcttcatattaatgaagttgtaaaatataatttttaatatacagtatttttaaatggaggaagtgacttacagaggcaaaagtgcctgggacttggaaaagtcgtaatgtaaactgcctataaagttaagtaagggtttgtgggtgtaaggggctaaagttggcaaaatgttaagtaagaaattgataattaaacaacaaattcattttaaggagttaaatatatatggtttcttttccacgtgttgccactcattgaagcacaacaatgaccagataaacgttatttagctagaactaataacacttgatatgctgagcaagaaagatgccttcagtcaatgaaaaagtcattgtattgagaggtaatatctgctttaatatttcctcagttatcaatttaatattaatttgtaaatattataagatgtatacatcattggtaacagaaacatagttaaaatgtggtggtatggagaatatatttttgattctaagaagtgctgcaattttttgtttccacaaacccgtcgccataaaactcataccatagcatagaatgaacctccatggtgaaacaaggattgaacatttcagaccttaactttattcatggttataaacaataacaaagtctataggtggtactgagtaaggatccctaaaggtatcgtacacattcaaagtgtaagttagcaatactgaggcttccctttctcaaagggtaatctgtgaggcatctggagattctggttaaaaatcttaaccatacccaagatttattgtagcatcattttagtggatacatcctggaataatgtgcattttaaatgttatttttaaggactcaaaagttggagaaccagtaagatagtgtgaattttttttgaagatctgactaatcttcctgatgaaggacactgagagagtatagggacagggagtaaagggtaaaaatttgggggaaaaaaaggatgtggagtgatttagtggtaggtgaacactattgcactatcaccctgacatgaataaaaaagccccatctctatccattaatcttttatgacttccaaacctttctagtattgttgtacttaattattttttatccttcactgtttggctttgcttccctcagctgaattataagctaattaaagagaaacatatttttgcattctcttgcaaaagactacacatagtaactgcttaaactgattttactgaataagaacaaattcaccgaagtctcattgaacttacctagatatactatctctcattttaacacttttgttgtaagtaaatctgaatttcccctggcatctcttgctttaagaggggatactgcaaagtagctccaagtgtgggcttcagtgtcagaaaacctggattgaaatcctggccccactccttaattgctatgtgcccttaagcaagttttgtactctttgaaccttagtgccctcaactatgacatggccctgatagtatctacttcaaattattatgagaattaaatgagataatgtatgttaaatgtttagcataatgcttggcataaagtactcaaatgttagtggttctgagaggtgaagccagctggacttcctgggttgagtggggacttggagaacttttctgtctagctagaggagtgtaaacacgccaatcagcgctctgtgtctagctaaaggattgtaaatgcacgaatcagccctctgtaaaaaaacaccaatcagcgctatgtgtctagctaaaggtttgtaaatgcaccaatcagcactctataaaatggaccagtcagcactttgtaaaatggaccaatcatcaggacgtgggtggggacaaataagggaataaaagctggccaccccagccagcagcgcaacctgcttgggtccccttccatgctgtggaagctttgttctttctctcttcacaataaatcttgctgctgctcactctttgggtccctaccacctttaagagctgtaacactcacttcgaaggtctgcggcttcattcttggagtcagcaagaccaagaacccactggaaggaaccagctgcggaaactccggacacagttctgtttcttataagccagcagttatcaaagtgttatccattcacccctcttggggtccctgagactgaaaactgtttacataataatactaagactttatttgcctttttcactctcattttcttacatgtataaagtggagttttccagaggctagcagaagcagatgtgagaatccagcttctattaacccagacagacatcagagagatttgtacaaatgtaaaataatgccactcttctcaccattttggagggaggtagagggaatacttatttttgtaaaatagagtcatttatgttaacatgtaatggatttatttttgtttaagttgataggtgaatatttttaaatgtatgttttctttcttttttttttttttgagatggagtctcgctttggcgcctaggctggagtgcagtggcgcgttgtcggctcactgcaagctccgcctcctgggttcacgccgttctcctgcctcagcctcccgagtagctgggactacaggcgcccaccactgcgccccgctaatttttttgtgtttttagtagagacggggtttcaccatggtctctatctcctgacctcgtgatctgcctgcctcagcctcccaaagtgctgggattacaggcgtgagccaccgcgcctggcttggccgtatgctttaatctctaatatgatgaagaacaagaaataatacaatgtaagtgggatataggatgcctgaagcggttatattgtaactgttaccagaaaggggtcctgatccagaccttaagagaaggttcttggatcttgcgcaagaaagaatgtgaggcaagtccatagagcaaagtgaaagcaagtttattaatataataaaggaatgtcacgcttgtaatccagcactttgggaggccgaggcgggcagatcacctgaggtcaggagttcgagaccagcctggccaacatggtgaaaccctgcctctactagaaatgcaagaattagccaggcgtggtggcagatgcctgtaatgccagctacttgggaggctgagacgggagaatcacttgaacccaggaggcagaggttgcagtgagccgagatcgcaccattgcactgcagcctgggcggcaagagtgaaactccatctcaaaaaccaaccaaccaaaccaacaaaaaacgaaagaaagtaaaggaatgaaggaatggctgctccatagacaagagcatactcaagggctgctggttgcccatttttatggttatttcttgattatgtgctaaacaaggggtggattattcatgcctcctcttttttagaccagataaggtaacttcttgatgtttctatggcatttgtaaactgtcatggtgctggtgggagtgtagcagtaaggatgaccagaggtcactttcatcgtcatcttgattttggtcggcttctttactgcaacctgttttatcagcaaggtctttatgccagtatcttgtgtcaacctcctatcttatcctgtgacttagaatgcttaaccatctgggaatgcagcccagtaggtttcagtctcattttacccagcccttattcaagatggagttgctctggttcacacgcctctgatatcaccagtctttctgtaaagcaaaaggatttacatttaatatgtattcaggagcaattttaaagaaaattaaggtgttttaaaagatatggatgatttaggaaaaagtcttggagacagaaaatatgaatgaaaaagtaacactggtatatggcggtagtgagaaaaaggagttgtttataactgggggggggggtagtaatgaaaactatgttgatggggctacaagctgtgggcagtgagagaggataccacaaactgataccagccagctataaagacttgaaaggaaaatgcaattacttagaggaactgccggaaacaagatcataggtgatatttatcctcaaagtcagtacttttcagacttaattggacagatgtatcatcttggatcttgttaaagcgcatattccgattaactaattctcaggtggttcctaagattctgtatttcaaataagctcccagaggctgctaaaactttaggcatcactcgataagtcatatatgcacattagagtttgagaagcattgctgtatgtcattattttacaggtgaggtaatggaagctcagagaccttagttgacttgctcagtattccaaagcttgtgagaacaaaacctggattcgaatacaaatggcctcatatcagacttcacattgtttccctaatttcttagaaacatggaatgccaaaattaggaattacaataattgttaaattaattttcaggttttttttgtggaatgtttaggttcagagatacatgtacaggcttgtgatatgtgtcataggggtttagtgtacagattatttcatcagccaggtaataagcaaagtatatgatagcagttttttggtccccactctcctgccaccctccaccctcaagtaggccccagtgtttgttgttttctttgtgtccatgtgtgctgaatgtttagctcctgcttataaatgagaacatgaggtatttggttttttgttcctgtgttagtttgcttaggataatggcctctagctccagctatgttcctgcaaaggacatgatctcattacttttcatggctggatagtattccatggtgttatatgtatcacatttttaaaatccagtataccattgatgggcatttaggttgattccctgtcttcgctgttgtgaatagtactgcgattaacatatgtgtgcatttgtctttatggtaaaacattttatattcctttgggtgtatactcaatagtgagaatgatagttctgttttaagtggcaacggtagttctgggtcattcccaatagtgggaatgatagttctgggtcaaatggtagttctgttttaagttctttaagaaaacactgaactactttccacaatagttgaactaatctacattcccaccagcagtttatgtgttcccttttgtcctcaacctcgccagcatcttttattttttgactttttaataatgccatgctgactggtgtgagatggtatctcattgtggttttcatttgcatttctctaatgagtggtaatgttgagtattttttcatatacttgttggccatgtgtatatcttcttttgtaaagtgtctgttcatgtcctttgcccactttttaatgggattatttgttttttgcttgtgaatttaagttccttatagattctggatattagactttggttggatgcatagtttgcaaatattttctcccattctctaagttatttactctgtttatattttcttctgctgtgcagaagctcttagtttaagtcccatttggcagtgtttgattttgttgcaattgcttttggcaccttcagcatgaaatctttgccggggtctatgtccagaatggtatttcctaggttatctcccaggggttttattgttttaggttttacatataagtctgcaatacatcttgagttgattttatatatggtgttaggaaggagtccagtttcagtcttctgcgtatggctacccagttatcctagcaccatttattgaatagggaatcctttccccattgcttgtttttgtcaactttgtcaaagatcagagagtgtaggtgtgcagctttatttctgggctctctattctcttccattgatctctgtgtctgcttttgtaccagtaccatgctgttttgtttactgtagcctcattgtatagtttgaagttaggtaataggatgcctctaagtttcaagttcttgactttcattttccaaaagaaggatttatagagaaacctttatgatgaatttgtttatcagtatattagcaaatatttattgaaactgtgtattctacacatgaaatatatatgacacaaattctgcctccattaagcttactgtttagaagaggtgttaagatttacatgaataattttccccctatattccatacttaaagtttccaccatttcctgaatgtgccagagtctggcagccaggctctatcacagctacttgcatttgcgtattaagcccttctccttttggcaaatttttcccccactgtgttatttctttttttgtttgttttttagatagggtctcactccgttgcttaggctggagtgcagtggcacaatcacagctcacagcagccttgacatccatgctcaagtgatcctcccccctcagcctcctgcatagctaggaccataagtgttcaccaccatgcccagctaatttttttttttattttttgtagagatgaggtcttgctgtgttacctaggctggtcttgaactcctgggctcaagcgatcctcctcccttggcctcctggatcaaaaactttcttctttaaaaattcattgcaaatatccttgctttggtgaatctttgtgtattcaggtgattctctgttccctgcatctgtaacacttcattcattactctagaatttgttacattgtattaatatattaggttattcagataattaaagtggttatgatataccattttactagtgcctagtttagaattattggtgtcgatctgcaccattcaatagaaatacaatgtgaaccacatatgcagtttaaaattttctgtaggtagacttttaaaaataaaaagaagtgttaccgaaacaccagaggtttggtctaggtcctgctgcttgccacacagaaagctaatcactaataaaagtattgctaaggaagaaggctttaatcaggtgctgcggccgaggggatggaagctcagtctcaaatccatctccctgactgactaaaacaaggggtttatatagcagggaaaaaatgtaacaatatgtaagaaaacaagaactagggagtgacaaggaggcctatggtgctgtgatctggtgagtttcagttctttgatacctttttttgagagacctgaaagtcctttcctgaggaactcagataaaacaaatacaagtgtcaagctttaacagcagaagggttaatttctatgtccatccaaaagaacagtctgtgggagtattgggctggtttcagaagcaaggtgaaattaaatttaatactattttatttaactcatatccaaagtatgatcattttaacacataatcaatataaaaattatcaatgagatagtttacatttttatgctgtcttcaaaatctgctgtgtttttaattcttaaagcacatctcaatttgaactggctgccacatttcaggtattcatgtagctagtggctgttgtattggacagcacagatctagagcttttacgggtttttaaaatgccttttgaaatgcctttctaggctgggcgtggtggctcatgcctgtaatcccagcactttgggagaccaaggtgggcagatcacctgaggtcaggagttcaagaccagcctggccaacagggcaaagccccgcctctactaaaaatacaaaaattagccaggcgtggtcacgtgtgcctctaatcccagctactcgggagcctgaggcaggagaattgcttgaactctggaggcggaggttgcagtgagttgagattgcgccactgcactctagcctgggtgacaaagtgagactccatctcaaaaaaaaaaaaaaaaaagaagtaaaataaaatgctttctgaagtaagacatttttttcaatacatcaagtaaaaataactttctgggtcttgatgattaaaattttcccttttactatgaatttgatacattttctcatggttatttttatcttaatatgcgtaactcctagtaagatttttcagaagctcatgtattttttattactgttttgtattagataatattctcataattttaaggtggcctttaattgaatattccagaagtagatcttcatgaaatactggtgtgaaactattgatgtgtgatttttgacaaataaatgttgtttttgaaatggggaaagttcctgtgtccccctcacagggtgtgcaatgggggagtggctcacttcttcagtgccccactgctcaaacttctaggggagcgtacagatggtcacgttgtggggctctgaccccatggcagtgtctaggggtaaatgtcgacaggtgaagccccagtgggcatgtgttaccatgtgctcttttagttttgatgtctataggcggcttgtgttaccagctcaattagaccctttaccttgtcgcaaggacagaggtctttctgtatcccagttcttaccttggtgtacaggaagaatcggatcacacttgggcttggagaataagtacaaggtttgattgagtggaggtagccctcagcagatggggaaagccagaagggagatggagtgggaaggttttcccctggtgtctggccgctcaacggcctgtgatctccctgccacagccaacctctgcatcgttctgcttcttcttgttggtggcccaccggcgtgccggtgcatgtcggtgcattcctctcgacgtccagccgcctgtgtgttccttcactgatgtgctcctttctgtgtccagcgggctgtgtgtctgcctgctacggtcttaggggtttctataggcactggataggggcgtggcaggccaaggtggtcttgggaaatgcaacatttgggcaggaaaacaaaaatgcctgtccttaccctatgtccgtgggggctatttttgttcctagccctagctgggaaccatgccctcctctacccagcacttcccttccccgcttccatatcatttaaaagggccatgctcttcccttcccagtactcccgtatcattttggctctttccaaattacaagttgactatacatttgcagagtttccttgttcatccaacaaatacagtcagtattgtgctatatttggtagatacagagggtaaaaagcactaggtggagatatgcatggagctagaagcttttaactgagaaaggggataagagatatgaaggaagggtttgtcagcaatagattagaagaagtgctcaactggaaacaaggaagacagttcagtatctgtgttaataatctagaaagaagtaaaaggaacctattttgaggtagaggtggtagagatgtagagcagtggatttaagaactattaaaggaactcgggaagacgggattttatttgggagaaaagtaataggaaggaatcaaggataactttccagtttctagtttaggcaattgatagccagttaaggcaactgaattaagaaaaccagaaaaagatgtttttgagggaaggttgaagatgatgataacgttaataatagctgatatttttagtgcttcctgtacatcaggcatttcactaaatgctttacgtacataattttatttaattttcgtaacaatcctttgaggacagttataattattattttggttttactgatgagagaaacagttaaaaaagattagagtatcttcttcagggtcagatatttaataagaaagaggcagagccaggatttcaacccaggcagtctttattcctgagcctttgcttctaactattatacttacaggttactgaatttagtgttggacatgttaagtttaaggtgcatgtgttaccaaaacaccgggggttcagtttagggcctgctgcttgctgcacagaaagccaaccactgaaaaaggagtattggcagggaagaaggctttaatcaggttctgcaaccatgataggagaccagtctcaaatccatctctctgaccaactaaaattaggagtttgtttatatagcaaaagaaatgtaaccatttgtgggaaaacaggaattagtgaggggtaaggaagaggaattggtcaacagcaaacaggcagtgggttaggcaatcatgatgggtgaggggtctggcatcttattgttcaaatgcaatgatctgagaagtttcaattccttgatctgagaggcctgatagttggtttgcagagaaaggaactcagataagacaaatgtaacttgaaactttctcaagtttcaagactgggaggggccatttctgtgtggtacagtgggccaatttcacatgtgggacagcaagtggcagatcttcagtatggcgtatcagcccagtaagtaattggctagagaacaagattttgaaaccttcatcgtataggtgaaagactttagtaggaagaacctaccatgaagattggtatcttggaaacgaagatggggttttgagtggggtggggtgtcaagaactatgagtggtcaggattgtgaaatacagtggaggaggtctcagaaaataagtactgaaaagggaccattgccttagcagcaaggatgtcattatgttacccagaatatgacctcattcggaaatacgatcttggcagatgtgcataattagtagaattctttatctgtaatgagtgagctagtgaggaatcacagaaataaaaattagttctcttgacttactcataggaattggtcttgaatatgtttttattgtggctcttttcaataatgcctttgaagtgcagaaacacactttgtttcagaaatacatattgtcagacagaatgtgtctgttctgtatttaatagtccaagtctatttgaaaactgtctaatcaaatagtgactttaaatggttttaaacagatttgagtattccattatggctcttgctagatgtttaacttgtttagactgaagaaaaaaagatttccaattaacaccagattttataagaaagaaaatattagctaaataattaattccatgaaatgacatgtattccaaacaaaaacagacaacatctgttaattcaattgggaagacaagattgagcttgatcctttaagtttttaattaagtgttcttcagaatttttatttcaaaaatgttttaagtacctttagtgaataatactgtgtcacaccacaacttgaagtatttgatttgtgtacaatcattaaatttaacattttatttattgattaaatagtgaaagctgatcaatctgacattctcttgaactctattaactattcccttcatctacaatttaatgataatcaatgcttttaacaaatcggaagcactacagtttgtaaaacagacttctaaataagatagttaagaataaattatgttcacaagtttcattataatttccaccgtatcctaattatttgacaatttgtaatccacgttatagtaaaaatatcatttttatttgttgacggtcttctagttgcagttcccatcctttacatgaatctcttttatattattactgagatggatggtcacatatccttcttttcccatctctggagttcattacccctcaaggcattcagcaaccagtcatgagtatctatgaatactagacaccaggatatgggatatggcaatgaacaaaatagatactagccctgtcctcatggagtctataacctcattctgattttaaatacataattagaagtatgtaagcaatgtgaagaagaaatagagtgctatagaagaatatgatgggaatgtaacataatgggggtggtcggaaaacactgccttacgacattaatgttttagctgatacttgaaggttgaattaactagggggaaggatggggaagtttttcaagctgaggaaatagcatgtaccaagatctagcgttgagaacatggtatattcgggctacctgaaataattacagtgagaggacattctcctcatttttgcaggaacctggcttggctcttatgaggactaaaggactcttttaagggtttgcagctttggaaggtcagcattagcaaaccttcatagatgcacattagagtttcagatacattgttttacaaatgagataatagaagcccagagaacttagtgtcatgatttgctcagcattccgtagtttgttagtagaatacctggattggaataaagatgtcttcacaccatggtctagggcttgtttctctaatgtcacaaaagaagatagaatgccaaaattctgtttgtatgtcaggcactgagctaaatgatttacatacagtatttcatttaataatgtgttaagtgactttataaggagacatcaacaaaataggaacaagaaatgaagaacacataaacacttgtaagacatcttgaccttctgtaaataactggggttagggttggggttggggtgaggagtggagaccaaaaagagatgagacattatgtgttcaacagtgagcaggtatacgcagatttacccccaaggctgagggagctgacaggccgaaaaaagaggctgacaagtccagtttctcggaaagaaatacttaatagggacttaggaaaagaagcgatgtctcaagcagccgcaagatggtggatactcacacctgccctgtggaaagtattctttgtagagtgagcttttaaggtaaaacatgcatctggtcctatcttcagactttcttgccgagacttgtgactactggggagtttagataagcatctttttgagagttatgtatgttataggcctttgtttaaagactttactgcagaacaccttggtatgtggcaggggtagaagggggtgggtcaaacactagtcatcatggcagttttgcttcaagatggcatcacccttgccatggaataggctgttttcctacgttatgtaagggcaacaagtagcaaacactggagttatcattgaaatacctacaggttggtaaggctggggaaaattcaggctatgtatacctattataacattttctaaaacgtgatatactattttcccttctttattttattttcctctttgctgggaaatggcctcttgaaatagtaatcatataaattggtattgtaaattttttaagttaacatatagtgaaattgacttcttgtacagttttatgaatttaaacacagatgtaaatccatgtaatcagcaccacaatgaagatacagaagagttccatcagtctaaaacattccttgagttattcctttgtagttatacactcctcctatgcataacccgcgccagctgctgatctgtttgtcattactatatttttaacattttgagaatgtcatataaatagaataatacagtatgtaatgttttgatactttctctttccatacagcataaccctctgagattcatgctggtgttgcttttgtcaataattcattcctttttgttgctgagtagcattccgttgcataatggatataccatgatttgtttatccagtaggacatgtgggttgtttccagtttttggtgattatgaaaagaagctgcttcaaatatttgtgtacaggtttttgtgtaaagttaagtttttatttctgtagatactaaggagtgggattgctgggttatttggtaaatacataactttattttatttatttatttttatttttttgagatggagtcttgctctgtcacccaggctggagcgcagtggcacgatcttggctcactgcaacctcctcctcctgggttcaagtgattctcctgcgtcagcctcccgagtagctgagattgcaggtatgcgccaccacgcccaactaatttttgtatttttagtagagatgaagtttggccacgttggccaggctggtctcaaactcctgaactcaagtgatctgcacaccttgcctcccaaagtgctaggattacaggtgtgagccgctgcacctggcccataactttacaagaaactgccaaactgttttccagagtagctgtaccattttgcattcccaccagcaacataagagttggagttgctctgtatctttatcatttgatactgttagtatgttttattttagctatcttaatatttgtataaataggatctcattgcatatttaattttttagaatctttattgaggtctaattcacctaacataaaaattacccatttaaaatgttcagttgtttagtggttttagtatattcagagttatgtaaccatcacaatcttaaggttacaacattttcatcactatggttttaatttgcatttctctatgggctcatggtattaaacatctttttatatgcttctttgccattagtatttcccagtcttttgtccatttttaaatttggcttttctgtgttctcactcttgagttttgagagtgcttatatattctagatacaagtccttttgttgattttgtgacttgcaaacattttgtccaagtctgtagattatagttttttcattcttttaacagtggccttcacatagcacaagtttttttgttttgattaagttcaatttatcagttttttttcattttgatgtcatgcctaagatctttttgtctaacctatggtcacaaagattttctcctttgttttcttctaaaagttttatagttttaaattttcatttcgctctgtcatccattttgagttaatttttgtaaaaggtgtggggtttagaccagttcattttcttagatatggacatccagttgttataacataatttgttaaaaaagagtctctctcccttctcctttgaattgcctgtgcacctttgtcaaaaatcaatttaccgtatttgtttgggtctatttctggactgtctattctgtttcattagtttatatgtctgttcctttgccaaataccacagtgcccactttgtcttaattatgtcttaaaattgtctagggtgatttctctgactttattgtttttcaaaaattttatggctattttcattcttttgtctttctattggcttttgcctttttatccagttattctagttattttgcctttatattttgcctaatataaaatttagactccgtttgtctatatctatgaaaaaatatttctggcatatcaattagaactgtgttaaatctgtagatcaatttagggagaattgacatctttactgcattttggcttccaatacatgattatggaaagtgtctccatttaggtcttctttgataaattttatcagtgatttgtagttttccgtatacagatcctatacaagttttgttaaatttatacccaattatttccttttaaaaaatctgttgtaaatggtatgttgtttaatttcccagttgttcattgccagtgtataaaattatgattgatttttttttccagacagggtctcactatgtttcccaggctggagttcagtagcatgatctcggctcactgcaacctctgcctcccagattcaagcgattctcccatcttagcctcctgagtagctgagactataggcgcttttgatggagatggggtttcaccatattggccaggctggtctggaactcctgacctcaagtgataagaccacctcagccttccaaagtgctgggattacaggtgtgagccaccgtgcccgaccaattttttttaaatatattgaccttgtatattgtgaccctgataaactcacctactatttctaggagtttttgataaattccttgggattgtctacacggtcatcttgtctacagttttatgtcttccttttcaaactgtatgcttttatttctttgtcttatattattgcactgaccaggattttcagtgtgatgttgaataggtgtgaagagtagccattctttctccttgttcccatcttagcctttaccattagttataatgtttgctgcaggttttttcccctctgccgtagatgccttttatcaagtcggggaacttttttcctatttctagtttgctgagagattttattgttgatggacatggagttttgtcacatgctttttatgcgtcaaatcatatgaccatgttttttttttctttacactgtaatttagattacattttttgattttcaaatattaagctagttttgcattcctgagatctactcccactaggttgtggtatgctattctttttacatattgttggattcagttacctaatattttctcaatgatttttacatctctttataagggatattggtctgtagtttcctttttgttctgtcttagtctgattttggtgtcaggatagtattgacgtcctaaaatgagttgggaagtgttctctcccatctcagtccttttggactgctatgacagaatgccacatagactgtgccacatatcaacaacagaaatttaaggttagggaaatttgtttctcttagcactcgaggctgggaattcttaggtcaaagcatcagcagattcccatgtctgaagggcctgctttctggcccctagatgactgtctcctcactgtgtcctcacatggtaaaaggggcatggaagcttcctgtctcttttataaaggcattaatcttgatcaaaagggctctgccatcattacctaattgttcaccaaaggcccacctcctaataccatcacattgggggttaggatgtcaatgtatttatgaattttagggtgacacattcaatctataatacctccttctattttctgagattgtatagagttggtatcactttgttaaatgttggttgatcccctccttgaagttatctgcgtctagagatttctgcttttttttgagacggagtctcactctgtcgcccaggctggagcacagtggcacaatctcggctcactgcaacctctgcccccaggattctagtgattctcctaccttattctcccgagtagctgggattatagatgcctgccaccacgccgagctaatttttttgtatttttagtagagatggggtttcaccatgttggccaggctggtctcgaactcctgatctcgggtgatccacacccttcggcctcccaaaaggctaggattacaggcatgagccaccacacccagccaagatttcttttttggaaggtttttttgtttgtttttttagatagagtctcactctatcaccccggctggggtgcagtggcacaatcttgactcactgcaacctccgcctcctgggttcaagtgattctcctgccctcagcctcctgagtagctgggattacaggtatgcgccaccatgcccagctaatttttgtatttttagtagagatgggatttcaccatgttaaccaggctagtctcaaactcctgacctcaggtgatctgcccacctcagccttccaaagtgttggtattacaggcgtgagccaccatgcctggccattttggaaggtttttaataatgattcaatttatttaatacttacaacactatttaggttatctgtttcattttgggtgaattttggtagtgtatggtttttgaggaattgatctgttttatctaagctgtcaaatgtatgcacatggagttgtttgtagttttctcagtatccttgaatgtctgcaatgtctgtagttcttccctatttcatttttatttttggtaatttgtgtcttttcttttttctctgtcagtcttgcttgagtttttttgtttgttttttttaaatcaattatattactctttctaaagagccatcttttgatttcactgattattagggggtttttttggtttgttttcaatgttggtcatttctattatttctaatatttgcttttgggttcattttgtttacattttctattttcttaaagtggaagcttagattagtgatttgagatttctcatataaacattttatatcataaattcccctgtaagcactgttttagcagtatccctcaaattttgataggttgtatttttattaattcaaaatattttctgatttcccttgatattcctctttgacttatggattatatagaagtgtgttgtttaatttccatgtgtttggagaatttgctattatcctttcattattgatttctaattttgttacagtttaggaggacatactttgcataatttcaattcttttaaatttggtaaggcttattttatgacccaggatatagtctgtcttggtacatagttccatgtgcattttgaaaaggataagtatgtatattctggtggcgttcctgaaattttctttaaaggttaattacatccacttggttaattgatgttcacttcttctatattcttgctgatttgctgtctacttatattcattttattgattactaagagttatgttgaagtctccagctataattgtatatttatctctttctcctttcatttctgtcagtgtttgattcatatatcttgaagctctgttgtaggtgcatccacactttcaaagtaatgattttttttgatgaattgactcttttatgagatgtgatatctctatccttggtaattttgtttactttgatgcttactttgatattaatagtttcatcttccttttgattagtatttgcatggtgtatctttttccatcattttacttttaaacttcactttatattatgtttgaagtgagtttcttgcaggcaacatatatagttggacatttaaaaaactcattgtgacagtccatcttttaattggtatgtttagataggtcatttatgtttaatgtaatgattgttatgtttggatttagatctaccattttgttattattattatttttttgcttttccatatgttttctgttcattttcccttttttttttggggggggagtattttaatattttttgtattttaatgtatcagttgtattttttcttgtatctgtttctacagttatttttaatggttgcttcagggattataatatacatacttcactttaaacagtctatttaggattaatattttacaattttgtatagaacatagaaccctttacaccaaataggtctctttccctttcctcttaagctgtgattgtcttatgttgacatccacatacattgaaaactccattagacaagattatactttttgctttcagttgacaaagattttatagaactcaagaagaatagttcattatatatatatacccagatatttgctgcttctgttgattttccttcattcctgatgaggttttgagtttcctgattattatttctcagctatccaaagaaattcctttaacaatttttttagagtagtctactggctacaaattctcttagattttctttctctgagattatctttatttcaccttcattcctgaaggatgttttcaatggatatgtattctgggctgacagttcttttcttgttgcactttaaaaattttgatctacctccatgtctggacattttgatgaaaatttcacagttgttaaaataagcaatgagttgtttttctctggctactttcaagagttaattttgtctttagtattttacagtttgattatgatccatctggccttggacttctttggatttatctcatttggagtttactcagcttcttgaatatgtaggtttatgtctttcaccaaatttgggatgtttttaactattatgtcttaagattttttatgtactgcattctatttcttttcctttgggaacttggttgacatgaatgttagactttttgcagtccctcaagtcactgagatcctccctcttcctctccccatcatttattcctctgtggcttagattgaataatttctgttgatctgtcttcaggtgtactcactctttgctctgtcatctctattctgtttgctggacccatttggtgagtttttattttatttgttaaatttttcagttctaacttttttatttagaactttttttaatttagaatttatttttattcttcttttgatcgtatatttttgtgccagagcattcctttctattcctttcaagaatatttgcccttccttggtgaagcattttaatgatagtttttgttacataattccaacatctgtgtcatcttggagttggcatttgttgtcttctgccatgtgttgagattttccaggttatttgtatgccaggtaattttagattgtatcttgggcattttggatattatgttagaagattcaaggtcttgcttatatcctgtatagagtgttgagtgacttgttcaggtttaggcacaatttctttcttttttttttttttgagacagaatctcactctgttgcccaggctggagtgcaatggcacgatctcggctcactgcagcctccgcctcccgggttcaagtgtttctccagccttagcctcttgagtagctgggattacaggcacataccaccacacctggctagtttttttgtatttttagtagagacggggtttcaccgtgttagccaggatggtctcgatctcctgacctcatgatccaccttccttggcctcccaaagtgcagggattacaggtgtgagccaccatgcccggctggtttaggcacaatttctaactaaccttgtgtgatttgtgatttcaatattagtgttgttttcaaagcctttgatatgctattcatatatgtcctataagatatgctattcagatatggcctacatgtgaccagatatgtgtcagttgcctggacagcagtatattcatagtttaattttcagagtctgtggtgtgctgcttaggttcagatccgattatgcaagcttttctctctgtgcattctccttgatagttctctgaagtgtcccttttctgttctctggtcagataactagggctttatttattctgctctgcggagcaattcctatgactttgcttgtatccaaagctaagcagtggaacaggagggagggaggggaagagagagagacagagagagacagcaagagagagagcacgagtgagcaagagagtccgagaacgagagtgagcatgcaatatgcagtagggggtcaatttcactctctggggagtactacttcgctgctgtaagaagaaagtttctcttcctcagtgttttaggctcttccaggcccctgttactactgttctcactgccaccactaccacagggtttcatgggagtttgggtgcaagagaatggataaaagaagaaaagggggggatgtttcctcagtgaatgttaagaaatccctttccttctcctcaagacagatttagaggatttttggaactctgtctgcactgatgcctatatcttggttttgggcagcattgagtacaggccagcagatactgaagaggaaaaatacatggtaaactgactgctggtttggtggcactttgattcttgtctttttctccaaaccttaagagtcttcacatagttgctgcatacattttgtttaggttttatggatgaattcactgggagagacaggtggaatatacttacttcactttattcagaaccaaaactttgcttgctttttgttttgttttgtttttagcttagaacaacacaaatttatcatctcatagttctggaggtcagaagtccaaaatggatctcacagaggtaaaaccaaggcagggctatgtccttctggagtctctatctgttccttttttttctttttctgccatacttttattttactatgtttttttatttaaatagctttaggtgtaccaagtgggttttggtttcatggatgcattgtatagtggtgaagtttcagattttagtgtttcctcactgaatgttaagaaatccctgtcacctgagtagtgtgcattttacccagtgtgtagtattttatccctcacctcccccaccttcctctcttctgagtcttcggtgtccattataccattctgtatgcctttgagtacccatagcttagcttccacttacaagtgagaacatacagtatttggttttccattcctgagttacttcacttagaataatggcctccagttccaaacaagttgctgcaaaaaacattattttgttctttcttatggctgagtagtattccatggtgtatatataccacattttctttatccactccagttgatgggcacttaggttgcttccgtatctttgtagttgtgctgcaattaacatatttgtataggggtttttttttgatataatgacttcctttgggtagatacatagtagtgggattactggatcgaatggtagatctacttttcgttctttgagaaatctccatactaaaactttgcttgatttttaataggacatttaaaaaactatccgctgtattcctaaacaagcaaaaaccaaacagatgagcaaaaaatcattaccttgctagaactcagccattcattaatacatccccttgggtaatcttcataaacctttgaaagatcttttttgggggttggggacctgagtacaggaattacttaaaagtttgttgttttgtatataaaatgcgcatctacctacctggctttaaaatatatttattttgtacagcaccattaaaatcctctttgtgatttttatggttaatatttcaaattgaaatttaataatcattttttaatgtcaaatagtggtcttttgttcataatcattagtaattaatacacaattacttaatatttgaaatggttaacatattccccctcttaacatctactttttcacaaccatttagtggatttgaccaaagaagctaagtgttattcagtttcattgactgaatcctaaaacttagacgtaagtatacattttttaaaaagaatactagtaatcttaacaatttagcttcatacggttattgtagttacctgtaactagcttgtatcttttatcagtcttcactggctttcagaaggtgctcagggcatgagaaaaaaaggaaactgattttgaggcacctattgtttcaagcctctaatccatttagttgctaatacattgtttatttgtacttatttgtcactaaaagtttgcagaggagtctattatttgtttgtaatttgccttgttagatttttagtgatcttaagtacagaaattatccgttatttatttagtatttactatttcccacctaatggattctcagtgaataatgataagttgattggaatttagatagtgaagatttttaaaaataagttaatagggaaggctttttactatttaaatattacatgatacagaaaaattaatctgattttaattgaactctacaaggtagaagcaatgagacagcacagatatctgtacagagtgaacagaacatatgtacaaagaaaaatagaggctttatagccataaaagcgaagcaagccagtcagtttctcaattgccatggctttccaattcccatgaagcatgcctctatcaaggtttctgtggtggggaccccagctcaccaactgaaaccattatgtctgtgaaacaaaccttttatttaaagtgattgtctgttctttgaaatcagaagaacaacaaccaaaacaaaacaaaacaaaacagattttccacttaaacatttacaaacaagaaaatcttatgtgaatcatattataaaagtttactataaattatatctttgataacctggtaggtaccatacacatttagagtcatccataccccagcttgaatcactgtgttaccatttaccacctgtgtgatttttggacaaatcattgctaagttttaattctcttgtctgtgaaacatttctatggtgtctagccagtggtatattggagctggcttataccagctcacaagagccaattgttaaattttcagaaatcttgtcggctgattgttaaacacaaccattaataagaattatataagcttataattaaataggttatattaaaagcaaagtcaataaatgctcaaaactcatcacttaattattttgctactctgtgttattatttatgtctttttttttttttttttttttttttttttttttttgagatggagtttcactcttgttgaccaggctggagtgcaatggcgccatctcagctcactgcaacctctgcctcccgggttcaagcaattctcctgcctcagcctcccgagtagctgggattacaggcatgcgccaccacgcccggctaattttgtatttttagtagatgtgggatttctccatgttggtcaggctggcctagaactcctgaccccaggtgatccacccacctcagcctcccaaagtgctgggattacagcatgagccaccgtgctcggccatttatgtctgttatatctgtatggtgaaatactgtataaagatgtgctgcttgcatatctcttcccaactctgtattcagtgatgtcatattggtagcttgaaatctgcagtggtagtatgtatattacggaaattggcaaatatgcaaatcacagtttgatttgttttattgactgtctagatttaagaaattaacaaaactggacgaggtggctcacgcctataatcccagcactttgggagtccaaggcaggagaatcacttgagctcaggagtttgagaccagcctgggtaatatagcgagaccttgtctctactaaaaattttaaaaaattagccaggcgtggagacgcacacctctagtcccagttactcaagaggctgaggtgggaggattgttttgagtctgagagagtctgcagtgagctatgactgcatcactgcactccagcctaggcaacacagcaagaagaccctgtctaaaaaaatagaagaaaaggaagaaattgatgtagaaaatgccaatgaagcagattaaacttaaatttttttatgtctgttgcttattattgtgaatagcacaaaacattgaggacatgttctaaactattgtctaatttagcagagaagttccttatgtcattagtgaacaagtgaagttatgatatatatctttgttgtttcactttcttctttttttaatgtaaacgaaaatatcagacattcagattggacctatactcattcattagttgcaaccttaggttgatttcttatgagttttccaaatcatgagcattttgtaagattcacctggctctatgaagttacaaaaaagagtattgtatttttattatagtttgtaaattatgtgctgtacatcctgtatatcagtaaaatttataataaacacatatacatcacacacacacacacacacacacacacacacacacacacggagctggtggttaaacatttattagcatactactacatctagcacagagtaggcattcattaaatactgctttccccttttctcccatttgaccttttcaaacataatcaaaatgtctgccatgcttaacgtaatcagggttgttgaaagaagagcaacctttaacttcaagtctgttttatgctttaatattatcacttttcaccagtattaaaaacataccgtagttaaaagggcaaatgaagggttgagggaatatggttttcttttgaattcaatatgctgggtcagatctaaaaataccaatacttcattatatttcaaagagggatagtagaaccttgaataacgatgtttattgaatattgaaaacactatgaatcatagcacttgtcagtatttccttgaagatattttttaagaaattgaagtaatttaatttttgcttttaatttggaaactttttattcttttttgtcctttttctcctttctcatgttaataagaaaatgattttataagaagcactgcaacactggatacagtcacaggcccattttctttttatttaaagaaaagaaagagcagctttatttctgtagtgcatagctgatttttttccagctcccaaaggggaagaactaattgctgatcattgaagaaatggaacatggagatccctttccatgtggatttaatatgttactaatcagggaaaagtaagcctttacacgtttttggtcctgtttatttccaaaagaatagcatggagtaatagtgttttcccctaacatgtttgcaaatatattaaggaagaattgaattatgtaggaaatcatgagcattttgtaggaaatcctttgtagaaaatcaattgaccatacatgtgtaggtctgtttcttggctctctatcttattccatagggtttatctttatgcaggtgcaacatttgtcttcattactgtagctttatagtaagtcttgaaatcaaacaatataaatttgatttttttattttcaaaattgtttgactattttaacttttcttaaatttccatataaatttttaaatctacttgtcaatttttgcaaaacagtctcctgggattttgattgtaattgcactgaatctatagattattttgtagaaattgacatattaacattgttgagtattcaacaattctagtccacgaacatgatacacttctgcatttatttaggtcttctttagtttgtcttagcaacatttttagttttccatgtagttttagttttccacatacagatcttgcacatatgttgctaaatttatccttatttcatatattaatgctgtcatcaatggtaatggttttaaattttattttgcagtcatttattgctagtttatagaaatacagttgagttttggatattgtctttaacctgaaacctagttaaattcacttactctagaagtgcttttgtaggtttctgataattttttacataatatgttatattgcctaggaagaaacagttttacagttttcctttcctatcaatatgccttatattttttatacttttcaacccacaaactacaaggcattttatttatgtatcttttgtctaatcattaacaactttaatttgagatcatcatgaccaaattttcttgcctaataatagaggaattctttgttacagtttttctaataaagccagttattcaaacatgctttttatatcagtacctaataaataatagttggaatgaatttattagaaaatatgggtttctgatttttacagaaaattgaagtctctttcaagcttctttgaagccatatcttttatctactactgtttaaaaacttaaggcaaatattttagcaagatattttacagtaaacacatttggtgagcattaacattagttttataaataaaatcacaataaaagggaattcaaacctactgatagcatttaaaatttttgtttcttcttccatacttgtcacagtgcatacttactggaaaatcaaatacaggtcactgcctgaagtagaataatttaaatgaatcaatattttaatttccagtggtagaacctctctcttgtcaagtagaaagagcagatggcaataatcattgaaataaatctcacaagcttgtctataattttaagtatgtaaagggacagtgagctcatctttcacatagactattgaaaattgtttccatcaaggaggaaggagaaaggaagaattaatgtctaaggggaataaacgtgtcgcccataagtctggggatatgaacttggaaacttataatacaaaaaataccaatataatgatatcatcatctatgacacttagtagtggaaacacaagagtgctagaaaatgtgaaaggaaatagtatgagtgaaaatatgattgaagctaagtaaaagttgaatatttatggcatgaattaacactcactcacaggctgggatgctaaccatggctggcagaagatgcaatgggatggaaaaggaatgttggctataaaaacagaagaaatgtgacaaaataaaggatagttgttaacttagaaaactacattttaaaaaggattatttattcttttctttttttgatattatgtggttaaattagttgattctctggtataattttagtatggatgttaaaattatgcatatgaaaatttggatttggaagtttaccataaaactggacagtattggtatctccctatttttatctgtatcttttctgagagctttagcagtaacaactttttaccaaaagtcttagcttatgtgtttgattttcagcatatgaaacttccctgatttttattttctatatgtaagtctccctaccacgtttctttggagattttaggaatttttcctttgttcttcggtggccatacatcttgtttggggtgaagggacttgatgaactataattttaactaaggattatcatgttttgatttaatagatcccagaggaagaatgctcttccatagctgtacctctggaatgttttggttgtacagtaaaattgaacatttggttattatttttagaaatacaagaatttccaaaacacagatcttctggcctgtcacttgtggcctatactctttgaaagtgctcaaaataataaaggtcaggttattgataatgattttagataatagaatttaaaaataattctgtaattttatattgaaacattaagccttagaagttgatagaagtattgtgcattacagaagtaccaagtagttaaaagttgctcttaatgatttaaaaaataagagcagaagatcgtttagccatacatcatgtagaaagaacattgtgttggcagcatgatctgaatttgaatccatattctgccccttagtcaactgttggcaatcactttgagccaactttgcttactacaaaatgataattgcagtactcacatttcaagattgttgtatgcaagttcctagcaaaggacctagcatgtcgtagaaattcagcaaataataaagtagagcaattgaaaagtacttgttaaggcaatcatctttaaagaggcactgtgggctgggcatggtggcacactcctgtaatcccagcagtttgggaggccagggctggcgaatcgcttgaactcggaagttcaagaccagcctgcgcaacgtggtaaaaccccatctcgacaaaagttagctgggcatggtggtgcgcctgtagtcccagctactcgggaggctaaagtgagaggatggcttgagcccaggaggcggaggttgcagtaagctgagatcgtgccactgtactccagcttgggcaacagagtcagaccctgtctttaaaaaaaaaaaaaaagcagtgctgaaaatgttagaactatcactttagttgcattactaataaataagctgaggggaagactaattttctctttttttagtagttttataatactcatttcagttactcaattatgtgacatattaactgtcagtttgatatatatctatatagtatattgtattttggctgagagaaggaaaagtgttctacttatagtcctagcacactgctaaacatatatttgtgtggttaacaaattggtgaatatgtgttttaaattgcacttttactttattttcacaactgctgttcttatagttgttttatagtactatttcccaccattcaaacctatctgtcctgaaacatgtcaatcattctttagagcctttatattttctgtaccttctgctcttacatctttgcaagtctgactccttatctttcaactctcaggtcaaatgccaccttctccaagtttttctttgactaccgattctaaagtcactctctcgacacttgttcaactatcatatcacctagtttcattttcttcattgccatatgactatttgaaagtgtctcaatttatttaattacttaacttctgatagaatgtcagtttcctaaaagcaagatcctagtatgtcttatactattatctattctggctactaggttctttctctgtctctaatttatttgttgtattccttttaattgataggtatatgagaactcattatactttcccctctagttttatatacatgtgaaattttccacaataaaaagtttttttataaaggattaaatggatttatagtatagaaaaatatttaatacagaatgatatgaaacccaagtttgtcctgtactcttctcctttcttgtattttttgtttttattttattttttttgagacagggtctccctgtatcaccctggctggagtatactggtgcgatctcatctcactgcatcctcaacctcctgggctcaatcaatccgcccacctaggcttcccgagtatctgggactgtaggtgcgcatcaccatgcccagctgctttttgtatttttttgtagagacagggtttcgccatgctgcccaggctggtcttgagctcctgggctcaagcaatctgcctgcctcagcctcccaaagtactgggattacaggtgtgagccatcgggcccggcctcctttcttgtattttaaaatatgtggtgagagtaggttttctcctttctcaaaaaatttcatgtcttcctttctttaaaaagtcttttgtccccctcactcccctgtgataatttagtccgaaagccgagcacatggtgttaagcctgaatggtttgaggataatatctgcatgggtgggggtgggtcactgcaaccatgggatattacacacatagaattgatcgaataaggaaatatgttcaaagtaatgggaaccaggtttctaacttttagagaaggaagttaccgatatggagaaggagaaaactagaatgaaccctaatggtgttagattggctaagagatattactataatctcttggttttcaacatatattgatagatgtagcatgtgtcgatgtatacacatatgcttagctctgtccactgagagggcctggaaatcgacatcccaataacagtgagcacactcagtgtccagttgttggtttctaaatataattagttctgctgtaacatttgttttgcatcatgagtttatttcagtgcagttaataagttaagaagcaggtgaaatacaatgtaaattttacatttatttctgcatgattttgtgtttgagaaacactaggtgaactcaggatactgtatgtagctgaaccgagctgtgtagaaatacacaaaatgcatacatgtgcacacctcacacatctaccagctacttcagttactgcttgtgttatttgtcacactcatttacaactggtgtaaactttccctgatttcatatagctagccctctgcactacttcacaataatccataaactaaaacccttctgacacccacttccacaagcaaacttcaggtctttttcaaaagtaaaatgccatgtttattatggtatttatgtatttcttaacctttaacatttataaaactgtgataccatttttattaggttcctatttttttatgtgccctgatgaaggtttgtagttttgtgcttctaaccccacttttctcataagccctgtggttttattgaatgactttgcatagtgcagtgatctttaggaagatgtatgtcaccttgtagatctgactgaacctctcttcattaaaacaaatcagagctccttgaagaaggtactcaggagctcttcctgattccagggctgggagagggtcagagtacctcctcacaaagtgcttattaattacaagaggaaaacaaattaatttatagtggagatgtctcccacttaagtcatcaccttaatcaagagatcacagtcaccagtaatcaaacaagtctgtcatgtgccatctgattaaatgcagtgtgaagaatagagcatcacttctgtgatattcctgccaaagatgcataacttaaatccaatcaggaggaatcatcagacaaacctgaattgaggcgcattttacaaaataactgtcttgcaatcttctgaagtgtaaaggttaaaaaatcaaagaaagattgaagctgtgtttcagattgccacacttgtcattttctaagttttaaaattatagccatcctggaggatatgacgtgatatctcattgcagtttttatttgcatttatcgtctgggtaatgctgttgagcatattttcatatgcttattagccatttttatttcttctttgggataagtctattcacatcctctgcccattttaaaattgtgtagtctttatattattgcattataagagttccttataaatacaagtccttcgtcagttgtattggcaaatattttctcccattctatgtttaccttttcatgttattgatggtgtcctttgaataacaaaagttataaattttgataaagtctaatttatctcatttttctttcattcattgtgcttttaatgtcatatgtaagagaggtttgtcttatcttcagtcatgaagattttcttatttttattttctaagagcaatgtaatgatagcattgtgggtgatacttagtaatgaaaacgatactggaaaaagaggaaggtctttgctccattttgaattaattttcgcacatgatagaaagactctcccttcattcttttgcatatgatattcagttgtcccaccaccatttgttgaaaagactagtctttctcacattgaattatcttgtcacctttgttgaaaatcagttgaacacaagtgtgagagtttatttctggactctcaattctttttcgttgacctatgtttattcttacatcagtactatgctatcatgatattatagctttatggtaagttttaaaatcaggaagtattaattcatcaactttactcttctttttcaaaattattttggctcttttgggttccttgcatttccatatgtattttagcatcagctaaaatttaatctatctttcaaagtaggggtgacatttcaacaataagtaagaaagtatgtttttcaaaagtatactaaatggagacagcactttggaaatgggtatttggaaacgggattttgttgttgttgctgctcctgaaaaatacacacataaatccttctgcctctacaataaaaaatttggaaacaactttttagattttaaaagatctcacaaatgaagaatgtcagtggattttgaatacatcagaaaaaaactaaagatgcagctaatgctattggtttggaacagcaactgatggctttcaaagaagatggaaagttactaggccttttttttttttttttttaaagagttaaggtcttgctctttgtccatgctggagtgcagtggcccaatcatggttcactgcatcactacaacctcaaactcctgggctcaagagagccttccgcctcagccttttgagtaggtaggactacaggtgcacaccaccatgcctggataatttttacaaatttttttgtagagatagaatcttgctgtgttgcccaggctgatctaaaacttctggcctcaagcgatccttctgcctcccaaagcactgggattgcaggtgtgagtccccacccctggcctcactgtctttttgcttattctctgctctgtggtataaagatattgttgaaaatgtaaaaaaaaaaaaaaaaaaaaaaaaaagcctgtacatacccctatgggttatagtgataagaaaaagaggaagcctttatgttgatgttgatatgtagtagagaaagcccagctattggagaaactggatagtagtttaaatgtgaaatgtcttacagaagagtatggtgttggaatgaccaccatacatgtcctaaagaaatagaaggatatatgtatacatatatatgaacatatagaaggatacacacacacacacacacacacacacacacacattattcagccacatttaaaaaagaatgaaatcctgtcctttacggcaatatggatggacctgcaggccattgtgttaagtgaaataaactaagcacaaaaagataaatatagcatgttctcattcatatgtgggagctaaaaaaatagatcttatgaaaataaggaatagatttgtggttaccagagacggggaaggggaggaggggatatgaagggaaaataaataatataaaagtatttattaccactgaagtatacacttaaaaatggtaaagatggaccagccatggttgctcatgcctgtaatcccagcacttgggaggccgaggtgggtggatcatttgaggtcaggagttcaagaccaacctggtcaacatggtgaaaccccatctctactaaaaatgcaaaaattagccaggcatggtggcgcatgcctgtaatcccagttactcaggaggctgaggcaggagaatagcctgaacccaggaggcggaggttgtagtgagctgagacggcgccactgcactccagcctggacaacagagcgagactccatctcaaagaaaaaaggtagtgctcgcttcggcagcacatatactaaaattggaacgatacagagaagattagcatgaggatgacacgcaaattcgtgaagcgttccatttcttttttcagcaccacaccccacctattccaaaattgaccacgtagttggaagtaaagcactcctcagcaaatgtaaaagaacagaaattataacaaactgtctctcagaccacagtgcaatcaaactagaactcaggactaagaaactcactcaaaactgctcaactacatggaaactgaacaacctgctcctgaatgactactgggtacataacaaaatgaaggcagaaataaagatgttctttgaaaccaatgagaacaaagacacaacataccagaatctctgggacacattcaaagcagtgtgtagaaggaaatttatagcactaaatgcccacaagagaaagcagggaaagatctaaaattgacaccctaacatcacaataaaaagaactaaaaaagcaagagcaaacacattcaaaagctagcagaaggcaagaaataactaaaatcagagcagaactgaaagaaatagagacacaaaaaacccttcaaaaattaatgaatccaggagctggttttttgaaagatcaacaaaatcgatagaccgctagtaagactaataaagaagaaaagagagaagaatcagataggcgcaataaaaaatgataaaggggatatcaccaccgatcccacagaaatacaaactaccatcagagaatactacaaacacctctacgcacataaactagaaaatctagaagaaatggataaattcctcgacacatacaccctcccaagactaaaccaggaagaagttgaatctctgaatagaccaataacaggctctgaaattgaggcaataatcaatagcttaccaaccaaaaaaagtccaggaccagatggattcacagccgagttctaccagaggtacaaggaggagctggtaccattccttctgaaactattccaatcaatagaaaaagagggaatcctccctaactcattttatgaggccagcatcatcctgataccaaagcctggcagagacacaaccaaaaaagagaatttagaccaatatccttcatgaacattgatgcaaaaatcctcaataaaatactgacaaaccgaatccagcagcacatcaaaaagcttatccaccatgatcaagtgggcttcatccctgggatgcaaggctgttcaacatacgcaaatcaataaatgtaatccagcatataaacagaaccaaagacaaaaatcacatgattatctcaatagatgcagaaaaggcctttgacaaaattcagcaacccttcatgctaaaaacgctcaataaagtaggtattgatgggacgtatctcaaaataataagagctatctatgacatacccacagccaatatcatactgaatgggcaaaaactggaagcattccctttgaaaactggcacaagacagggataccctctcttaccgctcctattcaacatagtgttggaagttctggccagggcaaacaggcaggagaaggaaataaagggtattcaattaggaaaagaggaagtcacattgtcgctgtttgcagatgacatgattgtatatctagaaaaccccattgtctcagcccaaaatctccttaagctgataagcaacttcagcaaagtctcaggatacagaatcaatgtacaaaaatcacaagcattgttatacaccaataacagacaaacagagagccaaatcatgagtgaacttccattcaccattgcttcaaagagaataaaatacctaggaatccaacttacaagggatgtgaaggacctcttcaaggagaactacaaaccactgctcaatcaaataaaagaggatacaagcaaatggaagaacgttccatgctcatgggtaggaagaatcaatatcgtgaaaatggccatactgcccaaggtaatttatagattcaatcccatcaccatcaagctaccaatggactttcttcacagaattggaaaaacctactttaaagttcatatggaaccaaaaaagagcccgcatcgccaagtcaatcctaagccaaaagaagaaaaccggaggcatcatgctacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagcaatggggaaaggattccctatttaataaatggtgctgggaaaactggctagccatatgtagaaagctgaaactggatcccttccttacaccttatagaaaaattaattcaagatggattaaagatttaaatgttagacctaaaaccataaaaaccctagaagaaaacctaggcaataccggtaattcaggacataggcatgggcaaggacttcatgtctaaaacaccaaaagcaatggcaacaaaagccaaaattgacaaatgggatcgaattaaactaaagagcttctgcacagcaaaagaaactaccatcagagtgaacaggcaacctacaaagtgggagaaaattttcgcaacctactcgtctgacaaagggctaatatccagaatctacgatgaactcaaacaaatttacaagaaaaaaacaaccaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggctgtcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggattataaatcatgctgctataaagacacatgcacacgtatgtttatagcggcactattcacagtagcaaagacttggaaccaacccaaatgtccaacaacaatagactggattaagaaaatgtggcacagatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaatcgaacactgagaacacatggacacaggaaggggatcatcacactctggggactgttgtggggtcgggggaggggggagggatagcattaggagatatacctaatgctgaatgatgagttaatgggtgcagcacaccaacatggcacatgtatacatatgtaacaaacctgcacattgggcacatgtaccctaaaacttaaagtataataataataaataaaaagaaaggtaaagatggcaaattatgtatgtatattttacctcaataaaacatgaagaagaaacagaaatataaactgttgaagttctgtggtgaacgttatgaacagaagttaattaaaaatagaaaaactgcataaagctaaaaatgaattatcttgatcatacattgtaagagtggacccatcagcattccagtgaatacatgccatttaatggtatgctgttcataaaacaagcaaagatctttcatggtggactaaaaattaaagggaactgtgaaccaaaaaattaagggaacaggctggccttaactttttaaagatttgtggtgaatgagcatctgctgatcacaaagcagcagagaaattgactagttttccaagggatcgctgatgaaaatcagataccagaacaagtctataatgctaatgaaacattactgtttggtgttattgccccagaaagacactgactacagctgatgagatagttcctataggaattaaggatgcctatgacagagtaactctactgggatgtactaatacagcagacatgtataactataaacttgctgtgatagtaaaaagcttgcatctttacactttttttaaagaatgaatttcttgccagtctattcttatgcaacaaaaaggcatggatcaccagcgacattttttctgattggtttcacaaacattttacacgaatgacttgcgttcactgggaagctggactgtatgacaaccggaagattttgttattccttgacagctgttcatcctccagctgaaattgtcatcaaaatagtgtttatgccgtggaattcccctcaaatgttcattaattcacccatgtgaccaaggtatatttagattaatgaagaataaatataaaaacactgtcttgaacagcatgctagaaacagtgaacagaggcatggatgtggaaggtttgcagaaggagtttagcatgaaggatgctgtgtatgctgttgccaatactgggaacacagtgactaaagacacagttgtgcatacttggcataatctctggcctgtgactattttcaatgatgatgatgaacaaggtggtgactttgaaggattttgtatgtcaagtgaggaaaaaatgatatctgacctccttacatatgcaaaaagtataccctcggagtctgtgggtaagctggaagaaatggatattgaagacatttttaacatcagtactgagactccagttgttcatttgttgaccagtggtgaaataaatgtttctgaatcaaggtgattgtgataagagcaatgatgaagatgatgatgtttaacacagtagaaaaagtgcccatatgtgacatggcaaaaatatgtgatgggcttattgaaggactagagcagcatgcattcataacagaacaagatatattggtcagcttataaaattaaagagtgacttctaaatcaaaaactgttgctaatgaagcagatgactctggaggaaacactttaaaaagccatccagcagatgtgtccttatccctagaggacccacttcctggtccctcagttgcttccaatattttatctcacctaaaaaaataaaatactgtgtacacaataaccctttaatcaaaacatagaattgtaggttgttgctgttgtctaacagctgatacagatattctggtgatgctactgtgtttttaccgtgaatgcattatttttcactttgttaatggtatgccttaatttttcctgataagtacttatgtgtgaatatgtgtaagagagtgattgcttgtcattatagtgtataaattcaaagttgggattgatggtgatgccaaacaaccacagatcatttacatgggtggctgagctagtgacacctttgctttctgattgttcagtgtacacaagctgtttaatgcgcaaaattattaaaaatattgtataaaattaccttcagccgatgtgtgtaagttgtatatataaaacataagtgaatttcatgtttagacttagattttatttccaagatacctcattatatatatgcaaatattccaaaatccaaaaaaattccaaacctgaaacacttctagtcccaagcattttggaagagggtactaaacctgtaatcttttttttttttaaactgttaaaactttcttgttatttttgtttctgtttttgttttttgagatgggggtctcactctgtcacccaggctggattgcagtagtgcgatcatggctcactgcagcctcgacttcctgagctcaagcaatcctcccacctcagcctcccatgtagctgggactacaggcatgtactaccatgcctggctaatgtttgtattttttgtagaggtggggttttgccgtgttgcccaggctggtcttaaactcctgagctcaagtgatccacccgcctcagcctcccaaagtgctgggattacaggtatgagccaccgtgcccagccttatggataattttttttcttttttttttttttttgagacagggtcttgctctgtcgcctaggctggagtgcagtggcgcaatctgggctcactgcaagctccacctcccgggttcacgccattctcctgcctcagcctcctgagtagctgggactgcaggcgcccaccaccacacccagctaattttttatatttttagtagagacggggtttcactgttttagccaggatggtctcgatctcctgacctcgtgatccacccgccttggcctcccaaagtgctaggattacaggcgtgagctaccgcgctcggcccttatggataattttttatgtgcaggaactgttataagaattttacaagcattgcctcctttaatcctcgcaacagtgctatggatgaggtaagtgcagagagtaagtgacttgtgtgagtgctcagtgaatggaagagctaggatttaaacctggctggtctggctctagtcatttttttatatccacagtatagtctgccaaattccaaattaactttacatttgcctcaatgccagccaatctaatcttcttactaacttgctcatgcattatgctggactgatttcagtattctgttctaagtcagttatgcaaactattttccttatttgtttatatctcttctctctgactactagatctttcttagcctccgaaaatctaggtcaagttccatctacaactactttcaaatacagttgtcctttggtatgtgttgagggttggtttcaggactcccctcagatatctatcaaaatctgtgggtgcccatgttccttatataaaatggcatagtatttacatataacataagtacattttcctgtatgttttaaatcttctctggattacttatcataccttatgcaatgtaaatactatgtaaatagttgtattgtttttaaatttgtattattttttattttcttttttttccaaatattttcgttctgcagttggttgaatctgaggttggttgaatccaaggatggggaacccatgaatatagagggctgactgaatatgctcccttttttctgaactttttagtgtattggtagtactgtgagttttaccatttcatcattctcattttctttatggtgctaacatatttttcaagaagacagtcagttctttggtgcagaaatttaagagacagtaggaaaaaagaaaaaacaaaagacaccgagatatatagagtttaactggctgtggtcttataagttatcattaatggatttaaagtagaacttaacttttcttttcctggtccactatctctgtcatcattccctcctgcctcccaatttagtaaattttgattcagtatttgttgtcttatttaatatctgcatttgttggtaatatagacataccctaatgctatgagaccaatgaggcaataatgtgcacatttccaaaaaaatgcaacctaggcaagtaagagatattttctgtacagattggtgctgatgggaaggattgaaattaatattagcaagaatgaagatagttttggtaaatcacattacttttctgatgcacagagtgtattttgatgtcattaaggaaagaaatgctgaatctggtacataataaacatgcagtagacattatttgggtatgtttgattatcaaatataattctaagtagtaatacacttttgtgcttctagcccaggcttgagatgtaaactaaagggaagaaatataatttcaaaaagtattttagaagaaattgtcgtcacaatcataagtgagttattgtaaagtatttctaacattaaaaaaaaaccttttgtgaaattgtaatttaaaataaattgtggagaataagttcagagttctggtggcttaaaagtaaaaacatgtatttgttctggagaggagaaatgatttcagggagaaaaagtacaaatgaaaatcaacaataagtacattttcattttgtatccctaacttagcatctattttttatgccttattatttcttacatttggggtgaaatagtgaaacagtgatctataaatttattatttttgcttcctaactccatttgacaaaagttttattcataccctggcttaatgtaggttttgttaccagataattacatttgtcccatatatggtgaccatagtcatgatgctacataaaacttctgatggtgaagctataaagacatgctcagctcaaaagacaaaaagtaaattctgaaggacatcctctttttccttcttttctcgctctctccattcctcacttgaccaagttcttgttagagcctacaaatggctatttggatttaaaagggggaggggaatcctactaattgagttccagacaagttctgtttgttacttttcagtaagaaagaagtttttgtagtaaactttccagcttaaaagcaatataatcagaagagttttaataatgagtaaaagctcccactcactcccttcaaaataaaaccattatagtaggaagctgagtttagatatcataggcataactgttagaaaataattgaaattttgttcattagaatagtaacaggaattaattgctgttttcaagcgagaataaactgttgaaggatggatctgttcagtcattttgatagtgtaggaatttttaaaatacataaactggtgatccttagtgcattctcttttcttgcaggattcctatagcatgggtaaaatagtttattctaacattgtctaaagtagcaaaaaaaagtaaattttaaataatatgaaatggaataaactctagaacatgtaggtgaaagaacattatgaagctgttaaaattatgattttaaagagtatataatctgggaaagtatacctcacaaaatattacataaaaggatattttacacacagattattaccctgattctgtacagtacgtacacatgcatatgtattaatagaaaaaatacgccagtatagtggctgagattgtcatgaggattaggagcactgatgtttttatataatgaaggtttattactcttatcacaagaaactttttttttttttgagacggagtcttgctctgttgcccaggctggagtgcagtggcgcaatctcggctcactgcaagctccacctcccgggttcacaccgttctcctgcctcagcctcccgagtagctgggactacaggcgcccgccaccattcctggctaattttttgtatttttagtaaagacacggtttcactgtgttagccaggatggtctcaatctcctgacctcgtgatccacccgcctcggcctcccaacgtgctgggattacaggcatgagccaccgtgcccggcccacaagaaactttttaaacaaattttcagttaaactgaatgagtagaggtttgacctaaaactaagatttactatagagttttttttttttagtttgagtgctgtgtcaattctagagactacatattatgtcctgttcatatctttctaggaggatttgcttcattcatagacgatttataggtttctgaactttatgtaccaaaaataaatggtcagaattgatgcttctgtaggagaccctcaagtcccataatggcatttatttctattataatcttttggggaatgccacgtgagtggcatttagattgaaaacatgagtacaattagatttatgtaattctctgtgactgtgagaaggatttttgtgaggaggattttgtacaatgaaatgataataatcagcccttgcattctgcaggatttaggaatgccaccctttaccaaagttaagtagaaaatattaagtgtagggctagtgagtctgaggagcacataagcacctgaagagaatttcatttatgctaagaagtttactcctttgcatttagctgtaaattgtataataaagttgcctaactaaggttttactatctcaactcccctaaacacatgttgtgttttacctggtaacagatatcctaaatgtaggtagaaattaattcacctccatgtactactttaggttatagaaatgcttattgggttctttcattgcaagcaactgaagttggatgacaaagtaaaatgggcatttattgaaggatgttatggtggcacatagaattgaaagaacagaatattcagatcaattcaaaagaaaaaagtaggtcaactttggtgctcccagcagtgcaatgcatgaacttatttgtggaagaatgtttctcaaattgtctgcagcaaaaaaaaatctatatctgtttttttttaactcaatattttttcgttttttaaaacatacatttttaatttttgtgggcatgtagtaggtgtatatagttatagggtacatgagatgctttcatacagggatgcaatgcatagtagtcacatcatggagaatgaggtatccatcccttcaagcatttatcctgtgtgttacaaacaatccaattatactcttttaagttatttttaaatgtaccattaaattattattgactatagttaccatgttttgctatcaaatagtaggtcttattcattatttctgtttttttgtgttttttttttttgtatcagttaaccatccccaccaccccctaacctcccccactacccttcccagcctctggtaaccatcctttctctctctctctctctctctctctctcagttcatctgtgtccatttttagatcccacaaataagtgagaacctgcaatgtttgtgtttctgtgcctggcttattttgtgtaacataatgatctccagttccatccatgttgttgcaaatgacaggatcatattcttttttatagctaaatagtactccattgtgtatacgtaccacattttcttcattcatctgtcaatggacatttaggttgtttccaagtcttggctattgtgaacggctgcaacaaacatgggagtgcagatatctcttcgatatgctaatttcctttcttttgggtatacccagcagtgggattgctgggtcatgtggtaactctacttttaattttttgaggaacctccaaactgttctccgtagtggttgtactaatttactttcccatcaacagtgtatgagggttccctgttctccacatccttgccagcatttgttattgcctgtcttttggatataagcccttttaactggggtgagtctgtattttttctcttaaataattattttggttttgagcttattactgtgtttatacataaatactggttaattttgatagtttcattatttcattagtcagcatatctctgtagttgtctttgacatagccttttgcttcagtgctcagctaccttcctgtattttgttttatgtttttgtcttctgaaaatttccctttctttcagttacatgtttaaagagatgatgttttagtttgggcttctacagcagattaccatagataggttggcttaaacagcagacagttatttttcatggttctggagtctggaagtgtaagatcagagtgccagcatggttggttctggtgagggcttccttcctgattatgtcctcacatgccatttccttgatttgtgcatgtggagagagatctcatgtgtttttctctttttaatttaatcataagggctctatccccacggcctcatccaaacctaaataactcctaaaggccccacctccaaatctcatcatattggggattaagtcttcaagatatgaagggaggctggggagacacacagtcatttagtctgcagcagatggtttttaaattttatccaacatttttagatgttttgtgctatgaaggttgctcagagtatctaatttactttgtttccagaaatgaaagtctcagtctcttcaacctcaactaaaaataactttgtttaaaaatgcaccagattattttactcccctgcttactatcttttaaagtgttacatggccccttcatctggcggtccctctctcttcagcctcattttacattactttctctttcatttggtattgttaatcactgttggttttctttcccaagtcaaccttgctctcaactcccgcttattattatttttcctgcctcacatccctcagctccttctttatatctcaactgaagtgtttcagagactttctggatctttttataatgggttagtgcctgtcgatgtgctcccctagcattctgtgccttcctatttattacatacattgattgttcttctaattacttctttacgtctgttttctctcaaagcacagggaatgtgtttgcctccttcatcactatatccttagttaataaatagcatggtgcctggcatatagtagacactttaaaaatatttgctgttgaatatataacattgatatttaagattcattattaccctatcgtatgaattaagtagctcaggtagtggtattacaattaagtcattctcttgattaagtttgaattggttttttttttaatttgtctttaggccctagacattttgaattaatctgattttgtatgaaataattttaaacttacagaaaagttgcaagaatattacagaagagttcatatatactctttacccagctttccttaatgttaaaacgtactcaatcgtagtgcaattaccagaactaggagattaacatgttggtatagtattactgactcaactacagaccttactcaagttttaccaggtttttttcttcatgtccttcttggtgccaggaaccaattcaggatctcacgttgcatttggttgttgtgactcttcagtatccttcactctgtgacacttccttagtcatgactttaacactttgatgcgtattgtgctttgataattgatttgtacaatatctaagtttatttctgcctgatgttttctcatttttggattcaggttgtgcctttttgtcaagaataccagagaagtgatgttgtgtccttcatagtgcatttttttcagggggtacctgtagttgctatgtcttattttattggtagtattaaccttgattacttgtttaaagtggtgtctgccaagtttctccatggtaaagttactgtttctccctttggattgataaatatcttcttgttcctcaaactttgacccattgatttctattatctatggatggatcttgctcgcaagggttactactgtggtatttgcctagtggtaattctatatttttctcatttcttctacatttattaattagaattattctataaggaagagctgttctttctcacacatttattcagttatttatttattcatatcaacatgggcctttgaatatgtgctttattctatggattataatctagtactgttactgtcatttattttattgctttggtcattgggagcttcttcaagttggaagaatttatgtcattttgatctgccaccattcttttgggaaagtttcttattttctggtatcttaaggtattccaggctcaccttgtattttccctgacccagccctggaaatcaacttcgtctcctaagacccctgactccttttatttggagaatgttatttaggaaccaagatctgagtgctagacttattgttactagactattattgctgctagactctaccagcagaggagctaagaaatatgtgtgtgtgtgtgtctgtctgtctgtctttgtgtatgaactttgtatacacactgataaggtttggctctgtgttcccactcaaatctcatcttgtatctcccataaatcccacttgttatggaagggaccaagtgggagatgattgaatcttgagggcaggtctttcccatgctcttctcatgatagtgaatgggtctcatgagatttgatggttttaaaaaacagagtttttctgcacaaccgctctttgcctgctggcatccgcgtaagatgtgacttgctcctccttgcctttcaccatgattgtgaggcctcctcagccatgtggaactgtaaatccaataaacctctttcttttgtaaattgcccagtcttgggtatgtctttatcagcatcatgaaaactgactaatacatacacatatctgtatttctatatctatttgcatatatattaacaaccatgagttcacactgttaacctctgattttactctatcactctatcatacaaattttattgtagctccccagggtacagttccccagtaccctttctcctattctgtacttgaaatttacctgatattccttgtatcaagagatagagactagtaaatagtcaatcatttaatgtgttgaatatgctcagggttatgttggtcagtaatgtctctgaaaagggttatttaagagggtggcagatgactagggagaaaatgtgactatgaatgttgggatttgggaaaagagatggtttggggatacttggggaaaaaaaatgttcagacgggagaacaaacatcatgtattaaggtccagagataaggaaagtatggctgctcccaggaactgaaaattgctcaggatagctatataggttgagatatcagatgaattaaagctgaagagaagtagcactgactcttgtaagactttataaactatgttgcagggtatgaacagtatcctaagaacaacagagagttactattttaagctaaataattatattccctttcctttcacaatggaaaaccatttttagcataactctttgttattagacttaaaatgtaaaattgtactcatacttatttgtatctcatataatgctacaaaggttttgacataacattttctttgaaggagagtcccaaggaaaggaatttagtcattcttatgagtcagtgaatgtgtgtcattgaaatactcaggattactttctcccttttctaagatggcatgttttcttttcctttttccctccatgttttgctttaagagcaatgcagctataaagtatgcttcagttgcttagatgataaatttgtctatatgtaattaagagccaaaactgtgattttacattagaaattagttaaggtttattaatcgaatagaatgtgttctgttttcctcaagaaaatagagattttaccacttgtccagatcttctatttaaatatataatcactaaactttttttaaaaattgcattttcatagtcagttgtttccttaatttcattgttttatatacatttgctttgttctgtcatctttctcagtatgattctgtgatgtattttatcaattttcttttagtcattggaagagtgtctttatcagacaaacaagtggctgcatttctggtctaatttgaagaatactgaaatgtcccagaatatagaggaagagagaagtatataaaaccctggctttgagggaatttgagctaagaacttaattttctttatttggttatgttgctgtgaaatcagaataaaagagaatattgcaggaattttgcaacaaagatgtagtttatggatgttaaagaattaacaaaggataacccatatctggattttttaatactttttttaaaaaaagaaatctgtctttcctatctttttttttttttttttttttttgagatggaagtcttggtctgtcgcccaggctggagtgcagtggcgtgatctcggctcactgcaagctccgcctcccgggttcatgccattctcctgcctcagcctccctagtagctgggactacaggcacccgccaccatgcccagctaatttttttgtttgtttgtttttttgtatatttagtagagatggggtttcaccgtgttagccagggtagtctcaatctcctgacctcgtgatctgcctgcctcggccgcccaaagtgctgggattacaggtgtcagccaccacgtctggcctgtctttcctatctttttatatctgaccaatattgatgttcatcataaatgtgttttctctttagctatatgtcttagtccatcctttctgctataacaaaatactttagtctgggtaatatataaataatagaaatttatttctcatagttctggaggctgggaagtccaggatcaaggcaccaacagacgtagtgcctgataaaggcttgccttctgcttccaagatggcatcttgttgttgtgtcctctggaggggtccaacactatgtccttacatggcagaaaggatgaaagggactagggagatttcttcagcctcttttataacgtcactaatcccattcacctaaacacctcttaaagccccacctctaaatactatggcatgggtgattaagctttatcatgaatttggggggacacattcaaaccacaacattacatatatgcttggcagtttggagagaaatgagatggttacctgcctatcattctttgaaagctttttccctggagtaagtcaccagagtagttaagactcttatggttcattgttttactcatctttgcaacagtgagactgagcagtcagggccgagcaccatggctcccacctgtaatcccagcactttgggaggctgaggcagggggatcccttgagcccaggagttttgagaccagactgggcaacaaagcaagaccctgtctctatataaaaatgaaaaaaaattgaaaaaaagactgagaattcagttaagttaataatagtattcatcttggattatcctcagatatcttttgtttgctttgtttattgtaacttcagtcttaataataattttgatctgttgctttgcaagagtgaaaaagaactaggattactaatagtttagttaaaagtggatctaactagatagatttacttaacaaaatgactttaaataatggtatactttgtggtatataaagtgattaattagctaacagaattagaaaataaaaggccttcagttaaaaatacctaattctcttgaaactgtcatctgtatacaaagtagtattttgtcatatttgttaaatggagaagagtgctggaaaaaaaaatcccctttttattgtcctttaagagaattcatttccagatttatatccagatatatgtggatatattcatttacatatgtactaattcctgaaattgattggtctgaataattagtctacagtcaagaagtcctctttcaaattgcctttccttgactttataaaagaaaggcttgtctcttacgcaatctaaattttgctgtgatacgttgttgccattttggatcccaaacaaaggaattctctgaaatactcaaatactcattgtaggtattaagaaagtgagtaacagggtaacaaatcctttgcaagtccagttttttgttttcactgaaactgaaagaagacttaattgtaagcttatttatcattaaaattaattttcaataaatcaccatgtggcttttggaaaatacataggcattcaaagattgacattgctgcaacaaactttcattctgatctacttatttatgttaacaatatttcttaacatttatgtctataagatgaaaccaaatacataaagtagttattgaattaattcaagtagttattgaattattatggcatttaatttccattataattttggaaattgtataattgtataattatacaattggattgtataatggaataattgtataatggaaattatacaatttccattatacaattaaaacaaagtccttgtattttaaaatgtaaataattgcagggtaccagaaattacattgtttataattatttaaatgtgttcaaaatcagttatcatgacttaacaattgcaagatagttattcaaaattattttagaagttacaagggcaaaaatcatttgaaaaccactgttacattcctcccactttactaatgaattatgcccttgtttgaattatttattgatatttcatttattgttgttctttacctagcagacattaggtaaatactcattgggataataaatagcttggattgtattgtatctagtgccagtgagattgatttttttctcaattacatgtcactgttataagtgaaaagacttttttgtgtgtgttctaccaagaatattttaaacacatttagttaaacctcacctgataaaaccttaagatagactcagatcagaaaatcttgtgtagggactacttaagcctagttatattcagaatcattttgcagaaattagcagttttagttagaaatttgcaattaggaaaagacttagagattacctattcaaatgcccttatttttcaaagtgaaaacaggcctagagtgttacttgctcaagctaatataggtagttggcaacagaaccatatctagtctgcactaaaacctactgattttacctccagaatatcttttgaattttttcacttctctgtctccagtgccctcaccctagttgaggctattgtgatctctcccgtggtatctactgtactacgtctcactggtctcccgacaaccttatttagaaagcatatttgatcatactattctctctgcttaaaatccttcaaaaatgtctcattggtctcaggaagaaggctagtcctttattctaccctttgtatatttgtgagattatttgattaaagtttttttcctcagatagactgtagactgtaatgtcaaagggcagaatttatgtttattttgcttatcgctgtatccctacccctgccacattgcctggtacataggagggacttggtacttgttgaatgaatgactcctgatttagctctatttctactacaccagtgattttagagtaacattttttatctttgaaatctttgccatatgctttatataattcatctacccatctgttgatgtaatagcatctggaaaaaaagaatttcaagttagttattctcagtttataaatcacactcttaaaaaaacacacacctttttttggtacaagcatgaaacagtagtgctaaatattctttctatatttgatggagcatggtcatatatttaatttttatttatctgctctcataagcaggagaaactaagaaatcatagaaactattgtgtagggaatataattaaaatgcaaagaggtagtggtgatagtaaagttagtgcctctcaaactggtgttccacagaatactgtttcaggagatcttgtttttttattttaattttattttttgagacagggtcttagtctgtcactcaggctagagtataacgtgattacagctcactgcagccttcatctcccaggctaaagccatcctcccacctcagcctcccaagtagctgggaccacaggtgcacgctaccacacccagctaatttttaaaaaaatttttttagagactgggtctccctaagttgtccagactggtctccaactcctgggctcaagcagttctcccacctcggcctcccaaagcactgggattacaggcatgagccaccacacctgacctattcctgcagattttaataggtattctacaaccctttcctcatctttctgctgtcatatcccctttacaccaaggactatattcttataaataactttgggaaacacaatgtattagttccacttctcatagaataacagtgtatattagcatagtaaagctccttttgccttaaagcagagtttctcaaccttgatactgttgacattttggaccggataattctgtgtttggagcaggtagtgggaaggattgctgtcctggaaattgtagaatatttagcagcatccttgacccctacccattagactctagtaacactaacatactcgtggttgcccagctgtgacaaccacaagtatctccagatattgccaaatgtccctttgtcccctgaaagacaacccacctaagagtgagaactactaccttaaaaaaaatcagtttgatcgtgctttatactcataattcccagatttatttgaggatagaatatttctcctcctccttcatttgcacacctaatttcctgggaattgctattttaaaattatcatttaataaaacagaaactaattctcctatttaggcttccccctaaaactcatcaatattttccatggcacttagaatagagttcaaacttcataacatgggctttgtgcgtgaaagggcctttacctgcctccctgacctcacctcctatcaccacctggtggcagtaacattgtgagctgctttcagttctttaggcatctcagtttcttttctaacatgctgttccctctgttgggaattattttatccttgttctttcttatcctttaggttcagtcttagattaaatgtcatctcttaaaaagagatcttttctgatcatttcttactctgccagaaaggatagccatccatcccagttcttacactctatctcatcaccctatttgttgtcttcattcactttttatagtctataattctttgtttacttgtgtagatttctttctgtctcagtcactagaatgtaaactgtgtgagggcaggacctacatttatctcattcatcatatccctagcatttaatagagagcctggcatctaataggtacaattattatttgttgaataaatacatattattaatataattcacatataaaattcactcttttaaagtgtataattcaaggctgggcatggtggttcatacctgtaatcccagcattttgggaggctgaggcaggtagatcacctgaggtcaggagttagagaccagcctggccaacatggtgaaacatcatctctagtagaaatacaaaaattgggtgtggtggtgggcacctataatcccagctactcaggaggctgaggcaggagaatcacttgaacccgggaggcagaaaggaaagaaaagagggggagggggagagggagagggagagggaaaaaaaggaagatataattcataggtttctaatatattcacaagtttgtgcagccatcaccactatctaattcaagaacattttcatccctccccgctcctcctacccccagcccctgcctgccaaccaccactctactttctgtctctatggatttgcatattctggacatttcatataaatggattcgtacaacatgtgatcttaactatctggcttctctcttagcataatattttcagagttcatccatgttgtagcatggaacagtacattattcttttctgtggctgaattatattcaattgtatggatatgctacattttgtttatccatttatccattgggttgtttctactttttgatattataaataatgctgctctgaacattcatatatgagtttttctgtgaacatatgtttttacttctcttgggtatgtacctagaagtagaattgttgaatcatatggtaatctatttttaactttttgaggaactaccgaactgttttcccaagtggctacatcatttaacattcctaccagtgatatatgagggttctaatttctgcatattcttaccaacacttgttattgcctttttaaattatagctattctagtgggtatgaaatggtatctcattgtcttttgatttgcatttcactaatgactgatgtgttgaaatattttcatgtacttattggtcatttgtgtgtcttctttggagaaatgtctattcagattctttgtccatttttaaaaatttggttatatgtcttattgttgagttagaggagtctttttgacatattttctaaaagagatgcaagagttccatcctggctaacatggtgaaaccccatctctactaaaaatacaaaaaattagccaggcttggtggtgggcacctgtagtcccaactactggggaggctgaggcaggagaatggcgtgaacctgggaggcggagcttgcagtgagcagagatcgtgccactgcactccaacctgggcaacagagcaagactctgtctcaaaaaaaaaaaaaaagagatgcaagagttgaaagtccttttgtattctggatactaaacccttgtcagatagtcctgatatgggtttgcaaatgttttctcccattgtgtttgtctttttacttttttgatagtgcccttttaagcagaaaagtttttaattttgataaagttcaatctatcaatttttttatttgttgcttatgtgtttggtgtcatatctaagaaaccattgccccatctgaggtcaggaagatttatacttgtgttttcttctaagagctcatgtagttttagctcttacatttaggtctttgatcacttttgacttaatttttgtatccgtgtgggagtctaacttcattcttttgcatgtgactatccaattgttggagtgttgttttttttttactttaataaagtatcatatttttcacaaaatatgaacattgtttcaacatttacaattttaaaaatagtgtgtggagcacatactgtgtaccagacattatgttgggtatgtcgtctatacagatttaaaaaaagacataatccccatcctccatgtctcacagatctggaaattaagaaaattgagaatagtaatgaaaatttgaatggaacattaaagatatttgatggtgttgatagtggttttaaataaatggtttttgagaagattggccttttatgtatttaacccaaagattgcatgaaaaagcttgatgacattattagtataaaaataaaaatattcctgaatgttgctgtaaaaagcacttgatggtggctgctatgcaataggagtattttaccttgattggtactctttttttttttttaaacacccctggttttattttcccttcactccaattttctcacttgtttgcttttttttaaaattttattattattatactttaacttttagggtacatgtgtacaacgtgcagacttgttacatatgtatacatgtgccatgttggtgtgctgcacccattaactcgtcatttagcattaggtatatctcctaagaatcattttctttttgagacagtctctgatgcccaggctggagtgcggtggcacgaactcggctcactgcaaactctgcctcctaggttcaagcgaagaatcattttctattaacagtaatttgcggggtggatgagaaagcaattgtctgtcatccacaaatgcaaggtggagataagacaattatagagatgacaaagaaatcagtctctctttctctctctctcagtgtaactgtgtgtctctattttagtataactcactgatttaatatttatttaactcagagcaaaggaatctctaagacagtgttctcaaagtcattctttacctgttttttattttttttctctcgtttgacttccttttttctgttactgctaatcttacaattgttgatatatctttctaagatttgtacttatttatgcttgctctctctgaactaggcttagtcttttgtgactaattattgaattcaggacatatttagcccattgtattagtctactcagactgccatagcagaatactacagactgggtgctttaaacaacagaaatttgttttctcgtatttctggaggcttgaaagtccatgatcaagattcaggcagaattcgtttctagtaaggcctcttttcttctttgcaagcatttccccaaacatggcctatcctctgtgtgtgattggagtgagggaggcagagagagaaagagacagagagagagaaagagagagaacatacgtgtgtgttgggcgggggcagtgggggaatctctggtgtctctttttttataggaacattagttttgtgggattaaggctccattagccttaagtcctcatttaaccttagttgcctctttaaaggccctgtctccaaatacaagtcacattgtggggttagggctcccacatatgattttgggtacacagttcacttcataatacccatgtagcacgtagtagtcacttttatacagttaatatgtttatattccttatttgataataaaatacagtgatttttctataaaacttatattgatattggggtggggaaaactcatgtcacctaggctctttgtacctcagttttctcatctataaaataacaatattgggctcgttgatttttgaatgctgaaattctctgattctccaattcagagttactgatttctaacattattcagcaggtacattataggaaacatcttataatagaaattgatgttctgtaaatgagcattctataagcttctcataactgaagtgaaaggcttaatcattctatatactggtatagataatctatttcctgtggtcccagctactagggaggctaaggtgggaggatcgattgagcctgggaggttgaggctgtagtgagccatgaatgtgccactgcacttcagcctaggtgacacagctaggtgctgtctcaacaaacaaacaaacaaaaactctattcaactagctatgctgggctgtttagtttttattatgtataatttaaaggtctggatatggtatgtttctttttttcttccagttaataatatcctttatttatacagtataatttatcctttatgaataccttttcattttgatgggttcaaacaatttaataagtgaagatagcaaaatgtgagaatccttctcatacctactcccctttcaaaggaggtaaccacaacagattgttatgcatccttgcaatctttctatgaatgtacatatgaatattaacttatgtacatattttccattaatgggatcatgctatatatattctgttatttattttttcctcaacaatgtttcttgattttttatacacaccaggatgtatgtatattattttttaaatgcttaatgttacataatatcataatgtacttaaccactccccttttggacatcagtttgtttctttttcactattaaaaataatggtaaggctgggcgtggtggctcaaacctgtaatcccagcactttgggaggccgaggcaggtggatcacctgaggtcaggagtttgagaccagcctgaccaacatggcgaaaccccatctctactaaaactgcaaaaattagcggggcatgatggcaggcacttgtaattccagctacttgggaacctgagacgggagaatctcttgaacccggaaggtgtaggttgcagtgagccgagatcatgctgttgcattccagcctgggtgacagagcaagactctgtcttaaaaaaaaacaaatggtgaatgaatatccttggaaatacagccatttgtatagagattcctttagaatacatttcctacatgtgggattaaacactgaaaattttaatagctattgccaaattgtcttcctaaaatttacatttccatcaacaaggaatgagtgtgttcatttatcattaccattgccacatgataccactgttttaaaactctttctaacctgatggttgaaaagctatatttccttttttaaaaaagttgcatttatatgacatctggcatcctttcatttgttcattggccatttatatttctttttctatgaaatgctgtaatttacctacttatggaatcaaatatctttttaatattgacttgtaataatttttaaaaatatattttgcatgttaatcatttattttaaatgttgtagatatatatttatgctgcttctcttttaactttgcttgtggtgttttatggaatggaaattttttattttctgaaagtgtcaatcatttcctttatggcttctgtgttttgtgtaatattaagaaggccttccccatgtggaattattgaaatgttctattttttatagtattttatatcatctctttaactccattttgagtttcttctaaattgatggctggttcacccagccctattgatgtataattcattcttttctcactgagatttgaagcctcctttattgtaatctaaatttgtatacattatgcagatttacttctagactctgtattctgttctttttgctgtgtttttctcatttatttactaaaagtatacttttaattacagtagtttaccaagtcttttgaaatctgagaaaacaaaaacattgtccttcatttagcttattttgcacacaattcttgctgttttatttatattttttcgcctgttagtttttttcgtgtgtgtgtgtttgtgtgtgtgtgtgtgtgtgtgtgtgtgtgtgtgtgtgtgttactataaccttactctaccttcttctgattaatggctattttatgtctgaactagaaaactaaacaaactgccagtattttagataaaacaatctctctctctcttttttgtttccttttgagatggagtcttgctctgtcacccaggctggagtccagtggtgggatctcagctcactgcaacctccacctcctcccaggttcaagcaattctcctgcctcagcctcccgagtagctaggattacaggcacgagccaccatgcccaactaatttttgtatttttagcagagacaggacagggtttcaccatgttggtcaggctggtctcgaactcctgacctcaggtgatccctctgccttggtctcccaaaatgctgggattacaggcatgagccaccacacccagccagataaaacaatctttaaagcaaagaaataaattcttaggagactgattcatgggtagaatattcatgctttaacacatgaagtttatgtatattttagtttctcagaggcctggattttttgtttctgaattcttggtgatactataaatagttgatgttgaatatacaacctatgtgaacgttaatatatattaaaaattattttagaagagaagctatgtttgaatcattttgctgaacaattgtatttctattgctttatgttaataaaacttgtctgttaagaggaaaacacagtaaatacgaccaagcccatgttttgcttttgggttttctttcctaacaatagagaataaaataaaaataattagataattaagtagaataagctgttactcttattttatatcagctatagctagatgttagttattataagagctgcatctgttaccatagagcttccttaacgcaaactcagcttttaaaaaaaaaaaaagcaagggaaaaagaaaaagagaaagctgtgacctgcttcatgctttgaaaaaaataattcccggtgaccttgggcagctatagcccttattgtacctagattgcggagtttaaagtggccatcctgttttactctagaatcaatacaacatcctgcattatctgatcaggtctaaagcacatgaaatagagaagcaggtatgtgtaaataaaagttttgtgcagtcttattcaaataaaataaatagattcagcatgctttttagaaccttaagcttttgtttttctttaaaatatctctggtactacaaattataccatgcaataatatgaatttatgtatgtgtgtatgtgtctcacatactacttttggaccattttccttattcctagacagttggattattttaagagtttctgggtctgcactgagttttgggggacccggggctcagaaaggaatctatactttttctacacttttcaatcttagagtaccttagagatccaggaataggatagttctgtattattaattttattagcgtctagagagtctaaatagatctcacttggccgagaaacatacccttttaggcttggggttcctgaagttacatatatctctacatatgggattcagtaggttgataggctatgtgacagaactgagaaagtggatccagcctgcagaaacatgtattgattggcccacacagtgtttttaaaatatctggatttatagcttctcctgaaaaatggaaagatttgacaaactgggcccacatcaccacatggcagcaactagacagacatatgctttccagcttgtcagaatcccaaccactccttctcctgaaggtgtcactttgtcatttctcaccacatttgcacaatcatctacttgcccaacacatttatgttaccttcccagctcctgaaggtttggaacttgtaatttacactcttcagtgcagacttctttctctgtatgtggtacagttaaagtaaaaataaatagccatttaacatagaacaaaatcaactcgtttttcccagaaacacattatacattcatgtcttcatacctttgctttgcattttttccttccctaagatatttattctcttgctgaatgaattctactcagctcagctcctagtaccttgaattttacttgatcaattctgtctacagttttttttctcttctaaagtcttagaacacttgttttctccaacattgtaaatttattatagtagagctttaggaaagtctcattcacttaaagaaggtttgtgtgtggtcttacaaagaggttttttttgttttttttttgttttttttgtttttgtttttttgaaacggggtcttgctctgtcacccaggctggagtgcagtggtgcaatcttggctcactgcaacctccacctacctcagcctccagagtaggtgggattacaggcacccaccaccacacccagctaatttttatatttttagtagagacgtgatttcaccatttggccagtctggtcttgaactcctgacttcaagtgatctgcccgcctcggcctcccgaagtactgggattacaggcatgagccatcgcactcggcctgaaaaggtctttgagtagtcttttcttaatatggttcacagttcactttttcagagaaatacatataaagttgtcattttaaaaactcaaaaagtaatcttagtttttgtttccttagttttctcaattggcctttggacattaaatttaaatattgttttcctgtctttcagttacagatgaggacacagtaaagaggtattttgccaagtttgaagagaagtttttccaaacctgtgaaaaagaacttgccaaaatcaacacattttattcaggtgagtaattaagagacttttttttttgctgccggggaaggataaattgtaccatatcattgtttaaacttctgatcaatgtttttaaattgagtcttgttttccttactatactgcacttaagaggtattttcttgagctgggataagaacacgtctggtttctcaatgtttaagctttctgtggtcattgcctagaaactcttgcagtcaaaaggatattgggacttcgttgagaggcaatacctcggtagagcttcactgtggcccagttcaaagcttgaagagtcagaaacttgattttatcattttggccagagatgaattacacagttccagcttatcagtgatggcagttttataccttttcattgcctagaacacttatacttatttctctaaagcactggcctccagagtggcatctacagtatgccactcgaatgtgagaataaaatattggaacttatatatatatttatgtctgactcttttgaactttattttttgtacatgtatgttgcaatgtacataatatacattagtaaaacaatgtctttatagtgaaaaattttggaaactttagagcactaccgtagacatcaggagtcctgtgagacctagttaataatcagatagtttcatgagtacagaatctgaacaaagtgagttagattcagaaggatatttcatctagactctggaaacgttacacatagttcctgttacaccgccagatatacagcctaatagctggaatacctatcctattgaatgtaatgtatctattccctgagcagtaattgatgaaaaaaaaagtagtctgtaattttatttaatatccaaaatataaaattactctattttttattttcatatttaatatgcacattacatgcctgctattgagaatatattctcatctcttggcaaagactttggaaataccataatcttataactagcacaatcataaaccaggtattagtgtgaattagtctaaagatgaatagtttcatgactttactaatttgtttttcggatgatttttttcctggcttgtccacaacttctggaagcatcttactcagatatcctttttcagcatcttactcagatatcctttttcagcagccccttcaactagaggctgatcattctcttttatagagtattgggagacaggagatggaaaaaggtaaaaagagtcagtgagaaacagctgccagaagacaagagactgagtccagcattctcttagctatcattgttcttccaaatcagtatttctgtgtatttctataaaaatgaatcttcttctaagcatcagtattgttctatttctgccactcctatttgttagcatctactgacctcttggttgctcactgtgaacttagactcctggctcccagtctgaataaatctctatcttaatttttcatatcatgctggatgacttcattgtccttgtggacagtcattttcagttacactgtactttagccccatacacacatagccatacccatcacccagaattcctctcctctaaaatactaaaacctaatacgagtctatgaccatgtctcctagccttttagctttttactcccctactcctttaacatctgtttttccatctcacagagctctagtttcttgactctcccattttatttcagtttatcatacatgtcttagaattatttcctactctttttttgtcttcttttttcctttttttttggagaatggggtcttgctatgttgcccaggcaggtcttgaattcctgggctcaagctgtcttcttgcctctgtcttcctaagtgctagcattatagacatggccaccacacccagccagaattattttcttctccatcaatcattttaaccattttgacccctgtgtttttaatccctttaccctcattgccttatgttgcatctgcctagtaaaactcaaccaattcatcctttaccttcttcatgcctaccccagaggctgcgtaggacaacagcagaataaattggaaccactgtaaatttgttgttgcacctgtaactgtgccctcaaagcttcctgtgggtcctaatcaatatcatttttcatgctccaaagtgcttttgtaaaccttatatcattctccagaattctctaaccccaccatcttccccgtcatgctcattatacccccagctttacaaataaaaataaaggccatcagcttctgttgatgtataataccatgcagatatatggtattatatctgcatctctctcccaaatgcctatagacattctcatccttatttattttcctccaatctttgtagaagagatatccctctttattccacgggagatctttacgactactgactaaatttcaactcttcaagaccttgctccagtaattatttcctctaagaattattaaataaatatatttaacttccctttataccaattcaatctccttagcaagtcattcccttcaaaaaaaaaatgagcaagcaaatttcttaactttatatcctccccctcatctttcatttgtagctgggctttttccttaggcagagggaacagtttatatacaagcaagagccatgaaagaacatggcatatatgcatgtctctttcaccaggatacaggcacctagaagacagagacaaaatatacattttcttttttttgagacggagtctcactctgtcgcccaggctggagtgcagtggtgcgatcttggctcactgcaaactctgcctcccgggttcacgtcattctcctgcctcagcctcccgagtagctgggactacaggcacccaccaccatgcccagctaattttttttatatttttagtagagacggggtttcaccgtgttaaccagggtggtcttgatctcctgacctcgtgatccgcctgcctcagcctcccaaagtgctgggattgcaggtgtgagccactgtgcacagccaaaatataaatattatttaaagccatgcaaacaggtagattttctgtatgggaaaaatatacagaaaggatttcagtgttctcaagaagaaagataatttctataattaggagatagaaagataaagaggaaccagcaatgtagacagagaagaccatatagcaggaggaggaggaggaaactaaaagaggagggcatttgcagtgaaacaaatgtctagattgagaaagcgtattggaaatgatgtaaggctgtagactatgaatatataaaatcaagtttattagcttttttcttttactatgacattttttgaaaaagaaggatctctaagctcaattctaaatggatgatttgtatcacaaagaatagaaaatgcttctttgtttatgaagaaaaatatctactcttggtagtagatactttgttttttttgtttgtttgtttttgagacaggatctcactctgttgtccaggctggagtgcagtgtcatgatctcggctcactgcaacctctgcctcccaggttcaagtgatcctcctgcctcagcctccagcatagctggtactacaggcatgcaccaccacacctggctaattttttatttttatttttggtagagatggggtttcaccatgttggccagggtggtctcgaactcctgacctcaggtgattcacccaccttggtctcccaaagtgcttggattacagacatgtagatactttattttgagttatagtaaaaaaaaatgtacattatgacccagcacacatatacagataaatgtttgttttatatatgtttgtatgcatctatatgtgtgtgactacacaatatatttaaataatttaagatattttttcatgaaacagtacatctttagtacttgtagtatattgttttctatatttttctattctatttgattttttaaatgctaattatgatccactaaattggttttatgacctcatattgggttgcaaccttcagtttgaaacatgatttctttaagttaggtcgcttctcaaaaataattttaggctagctactattaaaaattttggtgctgtaatttgatgacttcctgttttgtgtgtgtattggcagggccagtgaggcacgtctcttgatgtcctcactggtacaaattggtagtctctagagtgactcctgccagatcaggaagtggtaggtaatacgaagaaatgattcacagaaatagaatttgtttctggtcctcaacagtatcttttttccctcatttagccaccttctccccagaagattgtagactgcagttgtcagacactagggcacaagaaaaactataaacaatatggggtgagttgagcttaataactcacctccacccacttatatctcacacattaaatagctaaaaatgctccatttttaagtgagatatttttgactaaaacctttcaatgtccctaaacaaattgctatattttattttgtctgtttctagtcatatcaaaaaggccaaacaatcaaaatatagcatgaatgctgctaaaatttggaatttttttcttgccgatgctatttactgtttaaccttcctaggcttccacacacttgcttataaaacaaacagattgattcccaaccctctagggttccacatgttaggatcagaagctattttcaatattcagaaaacctgatgtaagttactttgttagtctttattgtttattatgtatctttggttaaaaaattgacatttatttagatttatagataaaatcagtatttgaagatcataggaagagaagggaattgtgaaagggaggggtcctttgtggtaaaaacattgctaatccctaacctagaagtctcttagttctcttctgtcactaaaaatggtatcaatcatgaaggctataccgttagaaacctttttttttgtggtgatcagtaatgtctttttccagtggacaagtgatccaactgatcacttttttcaaaccagtttgccttttctctttattcaaaatacttagtttctaaacagtgtttatttgcctaatgttaaaaaaaaagtcagaatatatgtgttgcttctaatatttcacaaaacagtcaagccttttttattggctggaattttgaaatagctaagtgctttttctttgtttttgaataacttcttttttttctggatgacttttttgacttcggttacattgggaagtcatagcagtgttacatcctttttctttactaaaaaggaaggaaaggagggagagagggaagaaggaaggtaattgcattggtgttttattagtaggatcttgcctgtagaatattttcttgtttcatataaatgcaagaccgattagataatagttactaagagctattcttattatatagttattcctgttattcctgtaatcctgttttacaatgtcttgctgtatgtttttattattgatttatattgtttttatacaagaggaatttgaggcactgaatattgttataccactaaatgtgtgcaatgaatcatgagaatcttttacactgaaatagtaaatgttcattttacaaatgatacatgtgtctagtatgcatgtatttaaactatgacttaatggctggttttgttctttgctcatgtgtgtgttaaaatgtagattaagtaggtatttttaatgagagtggtcataggttggtatattgttttaaattcccatgtgttaacgtatcttcctgtgtcatgattctcttgagttcattacagtagaatcagttacttaagaactgtttaaaggagcagggagggtagtaggggaagtgaaattaaagcagccactcttgcttgctttgttgttaatacatctgaaggaaattacaattacaatatttatattgtccacaataaattttcctttctttattttgttaaaaaaaagtgttttataagcatctattaaaaacaagccacgtgaaaaccaccctcattttctttctctcctttttttctctttccttccttccttctgtctctctcctatttttccttttttctttctgagactgaaagaaaggatgaggaatgtctatggtcatgagtaacacaatttccaaatggcatcttcacaaacaaacacaatatcatgtaaataatgggttttttttaaattgtaggtcacaacccaataaattggtcagaaaatgaaaatatagttacgtgtcacttaatgacagggataattctgagaaatgcgtcatgaggtgatttcattttgggaacatcatgtgtacttacacaaacctagatggtatatcctattacacatgtagcatatatagtatagcctgttgctcctaggctacaaaactgtccagcatgttactacagagaatactgtaggcaattgtaaaacaatggtaaatatttatgtatctaaatatagaaaaggtacagtaaaaataaagtattatatcttatgggactactgttgtacatgctgtcagtcgttgaccagaacgttgttctgtggcactacgactgtacgtgggtcatcacaggcattttttaaaaaatatagatagaatatagtagaatagaaagtatcacagtgttatttactaaatacatctgttgtgtgtatttacaaattacatgtactttttaaagtttatgtgcaatatgacatttagtattttacagttatgcaaagtactgtgaaaactgacatgaagaagccttgaatttacttggaggaagaaagtgggattgaggaaaagcctttagaagaagtgaaatttaaattgggtctttgaaaatgtgtaggcattagccaaatgctcttaagggaggttgtttggggatggctgtagggagaggtgggatttagtgctccagagcaagggaaaaaatctatccagatgcacagtggtgttaaagtacatgacatatttggggatgaagacaataacaaatagtcttttgaggctgaagttgtaagatattaaggagtgagttgctggttagagagaaaagtggaaaaattagatgttttattcacatacagatttcagactttggtatttgaggtacacagtttcaagtagtaagaattccagataaaagataaaagcagtataaaaaatgcatgtaatgtaacaaagttaactatcttgaatcatctgtgatgggtcaacattctcataaacttactttatattttgaataacaccaaggtccataaattgaattagcaagatggtaatattgtaagacaggtaaacaaataataaaaatattctaagacactaatttgattttagaaagagttattcttcaattgcataacaacataacagctttgccattctgaagatagcttgtagttcttgaaataactttttctaaaagtaaaagaacgatgaatttggtgaaagcaaaatatattgctaacccttattctagctctttgagggatacataggtgctttgaaaattcttgaatggttattggaaatttttatcaaatatttagtatgagagcttatggcgttaacatattattaaaataataatatttgttctcatattcaggtcacttgatttactggcataagtagaaattgtagtttattggcaaaatagtctgttttcatcaatattataaaattgcttagaaatactgtgtgtaatattttttcagatagcttctaagttgttaggacataaatacttaagttgtttgaacctgactacttaataaatagaaacattaggtatttcttttgtcctagaagcatcatgaaagtattactgagacacaaagtatgccgtgaaccaagaaagaacttagaagttctacactgtttttggtcttgaggataagacagacacatttgcaatagaaatgtttaacatatgtaaaaagagccctgagattcattcattcactcattcacttatttatttatttattttgagacggagtcttgctttgtcacccaggctggaatgtggtggtgcgatctcagctcactgcaacctctgcctcccaggttcaagcaattttctgcctcagcctcctgagtagctgagattacaggtgcccaccagcacacctggctaatttttttgtatttttagtagagacgaggtttcaccatcttgactaggctggtcttaaacctcctgacctcgtgatccactcacctcggcctccaaaagtgctgggattacaggcgtgagcgactgcgcctggcctcatttttatttttgtaagtgtatttgtagattttcatcatagatcaaagtatacacttttatatatacacacacacacacttttccaggttctgtgcagtcccatgtgtttgagctttctggcgatctggctctagaaaactgaagtgtcattgcaaaatagattgggatacttggtgtcaaaagcagtatttcttattctttttaaacctatacccctttgatagatatgaaaatctcataccatagctgtagtaatattgaatatgattttttcaaactacatatggtttatattcccctacccccacctacggattctcataggctcctctacatagttatgcccttaaggaagagagtcattactttaaagaaagtagcaaaatacacctgaaatgttgatttcttcatcatttctatatgggaatgtaggctactagagagaacttttacctatttattcattcagcaaacatggattgagtatactgtatgcaagctctttatggtacaaagataatgatgataggccacgcaaaaacttgtatgagagtgttaacagcagcattatttacatagtttaaaaaactagaaacaattcaaatgtctgcagactgaagatatttaaacaaaatataatcgcttctcggccttttggctaagatcaagtgtaaacaaaatatatatccacacaatgaaatactatttggcaataaaaggaactcagtataacagacttacattatgatacaaaatggatgaaactcaaaatcatcctgctaagttaaagaacccaaacacaaaagattatatattgtatgattcttttacatgaaatgttcagaaaaggcaaatcagcagagacagaatacagatcagtgtttgcctggggtagggggtggaagtggggattgacagctaatggccatgatggaagtataggaggtgacagaaatgttctaaaattggatttttatgatgattgcacaactctataaatttactgaaagtcaatgaattgcatgtttacagtagatgaatcctatggtaggtaagttatacctcaaacaaattatttaaaataaattttcattataaaaaaagataaagattttagaactgttacctttagagttcagtcagtcagtgaagcaaacataaacaaagaattatatgcagtgtgctttggctgcatgtatgtggtcccatacaagccctaaggtgggagtttcatttgtgactgagagagttgttaaatatgaaaaactttatatagaaagcagtgtttgagattagccttgcaaaacgagtaaggagttttccagatggagaggcatttgtgtcttgacttattgttggcacacaggaagtaacaggtcctctttcttttcatttttgggcttcttacatttttaatatgcatgtaatgagaagagtaaatgtattgacagttctgactgaggacattaaacaattagcaaatttatatactaatcttttaacaattaaagttaagcaattttattacatatgatattctgttttctggctagtttacctgcagtttttagtcagcagaataatttatagtggcccttagataaatccttgtattatttcattttatgtttgtgtgcatattgtatgtagtattttttcaggtagcttctaagtcattaggacataaatacttaagttgtttgaacctgattacttaataaatagaagcattagttatttcttttggcctagaagcatcatgaaaatattactgaaacgctaagggcatcatgaaccaagaaagaaccaagaagttctatactgttttgatcctaaggatgataagacaaacacatttacaatagaaatgtttaacatgtgtaaaaggagccctgagattcattttctgttgacttaaataagagattttaaaatatatgaattgttctgttttttacaatatggaagactggaaagaaatcctaataatctcttacttcaaaacactaaagtgatacataaaaaatacaaaattatcaggaaaataataaaaatatatatctaatatgattaaaaatgtaaaggagagcatgaaaaccataaacaaagaagaaatcattaaaattgactaggcattttttttaaaggaccaattagatcttttacaaatgaaaatataatcacggaagttagtatcttaatagatcaatcaaactgtagatttaggtagacttaaagggacaatttataaactggaagatagagctgaaaatttactcagaatgcaacacaaatcgataaagagaagaaaatatgagagttgtaagagacaaagtaaaaaggtcaaggggttataattggtatctttattttcccaagacccgttccatatttcctttgccctcagccagaaccccaactggttattaggtgagatgacctagactttaattcctagaggatctgaatctcagtagttcttttattaattgctgtagggtttttttgtttttgtttttgagacacagtctcactctgtcacccaggctggagtgtgtggtggcacaatctcggctcactgcaacctccacctcctgagttcaagtgaatctcatgcctcagccttctgagcacctggaatcacaggcgtgcagcaccacaccctgctaatttttgtaatcttggtagagatctgattttaccatgttggtcaggctgttctccaactactggcctcaagtgatccacctgcctcagcctcccagagtgttgggattacaggtgtgagccaccatgcccggcctgttgtagttttccattaacatatattattggtcatggaagtaatgggaggtgttccagaatctcctgggttccagagcttgttgctcctattatgtttcagcagttcacttttcccttggtaatcaggatcagtcaaggggtttacttttagccagtaaaccccttctttgccattgtttcattagtacaaagaacccaaaatggccaggtgacagtttcatcttccaattcagtagaaccattgttgtattcctctgatggaagcattttccccttgagaactaaccaacagtcagagtttaagttgtagattgggaagcaaaaattatgtgagtggattattacttacagtattgagaggaaccactcctacttctaccccttgattcctagactggatattttggttatgttggggacttatggcctcattattgtatcctgtaaaacagaaccccatcctttcagagtcttgtctcccaacttttctgttaggccattgatcagcttttctattaggccatctatttctgggtatatagtaaaagaccattttcttccatggctatgagcccattgctttactgtctttgctgtgaaatgagttccttgatcagaagcaaggctgtatagaataccatgatagtggataaagcatttcaggagatggtggtgctggagaagcattatgggtggagaaggtacatccatatcaagaatgcttttattccagggaggacaaatctctgcccactgcctaatagaaggcatccaacacaatcaacctgccagtaggtagctggccagtcccaggggtgactctggggttcagtgctagtctctgctgcctggtgagtagctgcattatcagatgtgtagctgcatgccaggggctagaggttgtattgattttcctcagtgaaaataccatatccggaatagcagctgctatcacagagaccacctagtttacacaatccagttattcaccaagattcatccaacttgcgtaaacaaatgagttaagagaggatgtggtaggtatcctatccctttgtctttaaagtctgtgattgttgtactaatttctgcagttctatcttgataaggaaaagttccaggaactgttatagccctttcttcatcatgttccttccttcatcatatttcttacctgtggttcagaatcactagagagtctaccagtggcctagtaggtctattccaattatacatcttggaactgaaaaaggaatcataggatgaatctgtggaccaactgggtcttttgtgagtctcatctgggctgatatttcatctgtcacctgaatatcataaatgtatagtttgattgctaaaccacagtggtgcctggagtctccagaagtttgtcactcctagggaaaaagattcaaagtatgagagggacttgaaatgagcaagtttctccattgctgactttgaagatagggttaagagtagtctcgaagagctaaaagcagaccacagatgagagccagcaaggaaacagtcttaaaactacaaaaaactgaattctgccacaaccaagtgagcttgaatgtgagcttgagaaagcagcctagctaacaccttgcgtttagccttaggagagcctgacagagaacctagccacatcatgcttggacttctaacctacaaaacggtgagctaataaatggggtttctttaaggcactatgtgtgtggtaatttgttatacaacaatgcaaagctaatatacaaaagccaatgacgagtaatctttgcaaagtctggatatttccttttcctcagtgcacagtcactctagtaaatagacacgaggccctttgaggaaggattagaggaagatctacagtatatacttgtggcagtgctacaggaaccacccgaaagcaaggccagcttccacttcagtcaggggtcttgggtttttgaactagcgttgatctggaagctggtaagaggtagtgactctctgttgtagtgactaatatcaagtatttggccaccagacctggagtttttttctgttacatcaattaagcaatattctagtaggttgcccatttctgtctttcctagggataaccatgatcaattaaccacagccaaaatctctgtgtgcaaaaacatctgtcctgttgccttttatggtaaatgcacccaccttgttttgatagttaagtgctgccatctggcctttctgttccaaggatcattgaatgtgcattgcaatcagggaacccatctcaatagatacatctctcatggccattcctggccttcactggggagtaaacatagagctttttaaggatgcaggtgctctcctcactaacgtaattctggatgccttaatgaagggagtattttctgggccccctcagggggatgtgattggtgttggagaggcgtaagagtggtccctaggagctaaaagcaggtcccagatgggttgacccacataaatggatgaaatttatttggaaagaggaatggaaacatgatttttgttttgaatacagtcttagatcataggaaatacaagaagatataaatagattataaaagttaagaaaatgaaggtcatgtaaaggattaagaatagagatgaatcttggaaacatcctatagaaggaaattctctaggagaaagagagagtgaatcattaagcagtgccagacaggacaaaaatactaaagattgattgaagacaacagcaagacagtatagcagtagataaagcaaggaataggagaattatgagaaagcataagttgtaaataattctttgttattattatataatttttatcattatttattgagtgctatgtcccttggcatttttttttttttgagacagtgtctcactctgtcacccaggctggagtgcagtggcacaatctcggctcactgcagcctctgctcactgcaacctctgcctcccgaattcaagcaattctcttgcctcagcctcccaagtagctgggattacaggaatgcaccaccacgcccggctaattttgtatttttagtagagacagggtttcaccatgttggccaggctggtctcgaaatcctgacctcaggtgatccacctgcctcagcctcccaaagtgctgggattacaagcatgagccattgcacccagccggtcccttggcatttctatgcctcatttaatctttacaaccactttatgagggagttggtatttccatttcatctatgaaaggtgtagaagagttattaaaaaaaaaaaacttgactaaaatcatacagctagttaatgaggcaaggatttgaacccaaatctgcctggttccagtgaactgaattgtgaccttggaagaaaaatacagagtattatttttaaatgtatgtgtagcacaaacacatatattcagatatacctagtatttttaacacataatttgcaagtcttaatctcttgtaatacctggtttagagaagtaatgaagggtagtgggaaatacaggagattacagatctaaagcccaaattctaatcctgtttctgacctgaactgtataaccagaaacatttcttaatggcgtttttaaattgagatatttctataccataaaatttgccttcttaaggtttgtaattccatggtttttagtgtattcacaaggttgtacaaccatcactaccaattctggaacattttcatcatcctaaagacatatctcgtacccattagcaatcactccccattcaccttccactcagcccatggcaagcagtaatctactttctttctgtgtggatttcctgattctggacatgtcatataaatggaaacatacaatattgggtattttgtgtctggtttctttcacttaatgtcttcaaggttcatccatgtcagagcatgaattagcacttcattcttttttagtggctgattctattgtgtgtttatatagacacacatgcatgcacaccacattttgtttatttgttcctcaattgatggacatttggattgtttccactttctggctattataaatgcaagttagtatatgtatgcaagttttcctgtgagcatatgttttcagctctcttaagtatatgcctaggaatggaattgctgaatcatatgtttaacctttcgagaactgccagctattttccaaataccagagaggctgtaccattttgcgttttcactcttagtggctctttacattttatttattcatttgtaaaaagaaagggtacatgaggttttatggggggtaaaatgaaaggagagtgttacacaaaaatattttttcctatagagttctaaatattacatgtaacggttttcttctagaaattctaagggagcaaatgggaattattaaaaattcagaagtcagtaggaacttttttatcttactgatttgacagttccgttctatttcttatagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcaggtacttagattcttaccctagaaaatggcacctttaagtaaatgagaaatttcaataaatggaagtaccctaaagtattaccagtgggtcagttccaaaaaggaaaatccttaacatgttgttattcttggggttcctactggctaaaaaccatgtgtcagaggcagtaaaactgtgttaacaagacttctgtttttgaagattcatattccaaaaactttcctataatatttaatatttagggatagtccacaactcaaggactaacagtttgcttcctgtttttagaggcagctctgatagtcatgaatagaaataatacatctctccagccactgttggctatgtaagggcttttcttttttttcctttcttttttttttttcttttttgaaacagagtctcactgtgtcacccaggctggagtaaaatgacacgatctcggctcactgcaacctccgcctcctgggttcaagcaattctcctacctcggcctcctgagtagctgggattacaggcgcacgccaccatccccagctaatttttgtatttttagtagagatggggttttaccatgttggccaggctggtcttcagctcagtgagctgcctgcctcagcctcccgagtgctgggattacaggcgtgagccaatgctcccagcctgtaagggcttttatagtcctcctaaccaatagcaaaatttctacaaaagctatcagatagttaatttttctgcagctgacactaataaaacaaagaccctgacttttcaacttgcagctgaaagaatctttccaattttactgtccatgggctgcaataaaatcatattttttaaaagttattgagaaaagcatctatctaatctttagagagaccttatgcactattttttttctattttattcttgtgattattacttataatgagtggttaggatcatcataggatgatataccatattaaaactaaagattatgtaacaaaagtattacctggaatattagaattttaaaataaaaagtagttaaagtcccatatctgcagtaatcttaaattgttaatgcatgtgtttatcattttcttctataattctactttgttctttagtgatttaatattctatcatttgaagacaaacctagtaagaaaacaatttagtagaaaaataattacatatatttatatagtgataaattcctttgctttgagatttgttcatcgctttataatttaaaaaacaaaaataaaatgtatttcctctttcctataatggtatagcaacattaccattttatagttcataaattatgtttgtgtgttacatggaaaaatctttgttaaattttattgtattaactttcctagcagcttttgttcggagtcattataaaatgctccttgggaaaacaaaagtaataattaattatgaaagttctgctttatcttctattctttgggggtcatctattctgtaagaatacatttattttgagaatgaaggagaaaggaagattgattaaaagctatctctaagtcatgatgtatgtatgcaccccacacagactttaagatcatacattaaagcatgagggaaaaatatgtaaacaaataagtaaggaaagcctgttctggagtgagtgcacaatttcttactgttggggacatgtaatcagcaaatttgggagacctctggtttaaagatgtaaccttgcaaattgagtttttagcttttttgcatgctgggcaaagaacaacaatttgagatgttgaaatgtatagtattttgttattgtagaaattgaggaaaaatagggacttctacccattataaactgaaccctgtaagtatgatcacttcctcctttctacttactcttcttagcactcccatacccaaactgagaatgagtgaaaggaaaatgaaagttaagagcactagatgatcttccattttccttactggaacatgcatgattgcatggcagggggagatacatactcctgtaccagtccttccaaaaataaagaactaaataaatgtgttcagtgcatgggcaaatgcaaaacattttctgaaaataattcttttgaccaaagcagcaaaataatagaaattagctattttgaaaataattatacatagaaaacaggaaacaaaaacattttgagcttaggactttcattaatttacttgaaagagaaataatagggttcatagttcagggtttctttgtgttactaatagcatactaccttgaaatgaataaaaggaataaaaaagaagagtcatccttttagtagtagatgcttttatgaaagctttgccatttcctagagtacttaatctttgtccagccagctctgtcagtgcttagtgcttattctttttcatcatttttgatggtagtagaaattatagttgtgtttctcatttctttctgtagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggtacaataatctcgtttatttacaacgtattttcagttacacgttttatatttagggaagcaattccttatttctgttattttgtaactagttgctagctttgaatatatatgccttacctgtgattttttttcattttctttatcagtatatattcaccaaaaagttgtcagaatataatatatataaatggtacagaattatttgtgcatcactcaagtttagtataacctaaccaaaatgtaataatttgtctttctaggctgtagtgaccaatgaacttgaagatggtgacagacaaaaggctatgaagcgtttacgtgtcccccctttgggagctgctcaggttagtatttggttccagtagtttgtttggtttcacctatttaataatcaacacagtatttagctggccccattatcttaaaaaaattttcagccaaagtttataagtagttgctatttttcttattttagttttttaaacattatatgctatattttacttcattctgaattataatgtcttccacctttctcttctcatactgtactttcttgtttattcttactgacatgttaacttactggtatcatcaaatgattaagatgtgatttaaaaaaaatgatctggtgggttcagatatactggattgctatatagcttactccaaaaaagcatttattaaatgatatctacacagtagttataaaaaaagaaaatttattaagtgatatcttctgtgtcataaaacaagtctcaataaatatagaaggatttaagtcatgcaaagtatattttcagacaacagtggaatagaaatcaataacagagcttccatagcctaatgaaaggcatctattaaaaaaaaaataaaacctctacaattattatcatactcaatggtaaacactgcatgctttctccctaagacttggcccaaaaaagggtattcacttttaacacctgtattcaacattgtgctggagattatagccagtgcggtaagggaagaaaaagaaataaaagacattcagggtagaaacgaagaagtaaaaccagtggggttttgccagtgacttgatgatctatgtagaaaatctagtgaatctatagaatagctactataactaacaaatgagtttagcaaggttgccaaatacaagaccaatatgtaaaatcatttgtctagatacttgcaagaacaattggaaatcaaaaaatgttaaagcaatgctgtttataatatcatcaaaatatacaatgcttagtaataattctgacaaaagatgtgtaaggcctttacattgaaaactacaaaacactgctgagcaaaattaaagacttggatgagagagatgctatgttcatgggtatattgcacaaacccagtattttaaagatacgttgtttcttcctgaggtgatttatagatataatacgttccagctcagaaatctcagaagacttctttgtaaaattgataagcagatttaaaaatttatatggaggccaggcacgatggctcatgcctgtaatcccagaaatttgggaggctgaggcaggtggatcacttgaggccaggagttcaagaccagcctggccaacatgatgaaaccccatctcgactaaaatacaaaaattagctgggcttcgtggcacatgcctgtaatcccagctacttgagaggctgaagcacaagaatcacttgaacccaggaggtggaggttgcagtgagccgagatcgcgccactgcactgagtgacagagcaagactctgtctccaaaaaaagaaaagtatatggaaaggcagaggacctagaatagccaaagcaactttggaacataaattgaaggattaacattaccttatgaaagcttattaaagctgcagtaatcaagagagtgtggtaatagtgtcatggtaggcaaatgatcaatggaccagaatagagtgtccaaaaatagactaacatattacgaacaacagatatttgataaagatataaagcagattagtggagaagggtagcattttcaactaaggatgctgaaacagttgaattccatataccaaaaaaaaaaaaaaatgagctttcatccatacttcacaacatacagttctaaatgtaccatagatctaaatgaaaactggaaactacaaatttctagaagaaaatatagaagaaagtcctaatgactttgggttatgcaaagatttcttagaaatgacaccaaaagcacctcatcaaaattaaaaaacgtatgctcttcaaaagacatattaagagaatgaaaagaaaagcaagagactagcagaaaatatttataaaacatatctgttaaaggtcttatatttagaatatataaagaactccaatactcaatagaaggaaaacaatcaacccaacttttaaaaatgggcaaaagacctgaacagttcttcacagatgtacaggtggcaaattagcatgtgataaaatgctcaatatcattaggcattatggaaatgccaattaaaaccacggtaagataatacattgtctgttagaatgattaaaaaagactaatcatactaatgatggaggagtaggaactctcttttctaatatgctttggtggaatataaaatgtataatgaataagcacatttgaaaacagtttggaagtttcttaaaagtgtacacctgccatatggtctagctattacactcctaggtatttacccaagacaagtgcaaatatatgttcatataaagatttctacacaaatgttcatagcatctaaacaacccaaatgtctatcagtaggtgaatggataaacaatttgtggtatatccatacaatgaaacactacttagcaataaaaaggaataactgattgataaatgtaacaatgtggataaacctcaaattaattatgtggagagaaagcagaaaaaaaaggtacctactatatgatatcattaacctaagactccagaaaaaatgcaaactaataaatagtgacagaaaggagatcagtggttgcttgtgaatagagtggggtagggtaggctgggaggaaaggattacaaagacacatgggaaattcttgggagtcgtggatatgttctttgtcttgattatgctgatggttttgtagacgtttatgcagtttcaaaacttatcaaatcgtacaccttaaatatatacagtttattgtatatcaacttagtcagtaaagcagtttttaaaaatcctaagcatattattgtcaaactgcttggaaataaagagaagaatcttaaaagcatccagagagaaaagacacaaattctatactttaagtatgtgcaatttttttatgtcagttgtttttgaataaacattttaaaattagtttcaaaaaattagggtgtttaagaatgcctgtagagatggtaaagctaaagaaaatgtggaagtggttatctctggtgcggagggaaggttttgggatcagggaggaatagggaattcaaagttaatggaaatgttcagcttctaaatatggatagtagttatagattcactttattattcatttctaacagtccaaataaattatatgcattcttttgtatatatgataaattaaacaatttttgaaactaaaggtaactttttatctttggaaaagacaaatgaccatcttttggatgctttcagtcagaaactaacaatacagttagaatctgttactctattaagtaataataagacagaggggagtctcaatgctttgtttttgaaggtttttagaaaacaaaatacctgaaatgtactatcatctctaacaacaaaaaattttataacattcacagcaaatatttaagtctataagattatctctctctgtgtttctcatcactttacaatcttaggcacttgctattacatatttattttagaaagcagaagtttcaaaaatcgctttctaaatataaaattaaattataatagataatatttttgagcctacatacacgggagatttggatatatcagtctcttaagaacctctcgtatatcctgaaaaatttactttaaattaccccagtatgggctgcacactgtggcttacacctgtaatcccagcactttgggaggccaaggcaagtggattgcctgagcccaggagttcaagaccagcctgggcaaaacagtgaaacctcatctctacaaaaaatacaaaacttagctgggcatggtggcacacacagtagtcccagctactctggaggctgaagaggggaatcacttgagtctgggaagttgaggcttcagtaagctgtgatcacacccctgcgctccagcctaggcgataggacgagaccatgtctcagaaaaaaaaaaaatgctacctcagtataataatgtaagtactatcagaaagtaagcgttcttgtctccgtcatcgtctctaattttatctgttgtaccaaatgtgcaaactctgagtaatactgactttaaaaatttacaatttcattgtaaaaatgaaattgcatcttaactctctcctatttacaaaactcatatgtatatatatatgtgtatatatgtatatatgtgtatatatatgtatatatatgtgtgtatatatatagtcgttccttagtatctgttggagattggttccaggatcctgtggatagcaaaatccgtggatgctcaagtcccttataaaatggcatactattgcatataacctgtacacatcctcttaaatactttaaatgatctctgggttacttataaaacctaatacaatgtaaatgctgtataaatagttgttaatactcagtgcttttatttgtattactttttcttgttttgttattttttactggtttttgttcctgaatattttcaatacacggttgattcctcgagtgtagaatccacatactataatttaatgcctaagattataatcttgcttatttcatgacacagatttctataaaaaaaagcttgattaattggcaacttgaatagtattataggatgatgaaggttgattctctggttcagatttataaaaatttagaacattaaatattattttcatggtagaactttgagactcattctactattttattacagcatatagtaaatacaatcagtgttttgtcctgtactcaaatactatttttctgtccacagcctgcaccagcatggactacttttagagttggcctattttgtggaatattcattgtactgaatattacccttgtgcttgccggtaagtagtttaaattttgaattaatttattcttaccaatatgcctgtgtcatattctgcccctctgtaaggaattatgcatgcaactaccaaagctactgaaagataaatctatcagggctaagttttttgtccttataaatgtggttttttttagttgtttgttttgttggcgttttttccccatttgggtatggttattctctaaaacattgctcatgtatgacttctttttcttcatcattttccagtttctgtatataacttctatataatttttcagagtttatttatcaaaaaccttggctttcttgatcatagatgaggataaataatgttacaaaactcattcacaaagctctttcactttgcttattggagaccctctcgcatccttttcagaatctatttacaattactttgcatatagtgttaagaagcttggttgtataatttcctattctatagaagtaaaaacaattagaaagagataggaaggattcctaggagcagctgcactcacaacatcaaaaaatgatataacagcaaaggaagcataatcttactaaatctccccaaagaatttgacacaccccacagtagcatttgacattatcagtcaccacttcttgaaacactttgattgttttttctggagaaaccacactctgctggttttcctgttaaattttactggcagtttgttcccagtctcctttgctagctatacttttctttgtgacatcaaaatgttagggtatagtgctgggctcaatccttcaatctcctctgtctatatttgtttcctatctaggcaatcttattcaagactatggctataaataccgtctatatgctaatgactcccaaatatatgttctctcttctgaaagatgtctacttggctagttggatttgtctagtagatatctcaaacttacacagacaaaagataccttgatttttacccccaaatatgctcttctatctggcatcacctttcatccatttctcagtccaaaatcttttagtttctcttgtccctcatatttaatcttcagtccatcagcaaatcttattggtctgtcttcaaaccatgttctaaatgtatttacttctcaccaccttggccagtgccactcttgtctaagcagccatttctttttttttttttttttgacacggggtctcacactgtcgccaggtctggggtgcagtggtccgatctcggctcactgcaacctctgcctcctgggttcacacgattttcctgcctcagcctcctgaatagctgggattacaggcacacaccaccacacctggctaattttttgtatttttagtagagatgaggtttcactatgttggccagactggtcttgaactcctgacctcgtgatccacccacctcagcctcccaaagtgctggggtttacaggcatgagccaccgcgcccggccagcagccatttcttgtttagtgtatagcagccttctggactcggtctccttgcatctactcttgcctccttatagctactagtgtcttttttcccccccccccaatggaagttagatcatgtcactctcctattcaaaattcattcatggctactcttaaaataaaatccaaactccttgccattgcctgcaagaacttacaggatctcacctctgtgggcctttccgatattatattgtcatcttccccccacacttagcttcactttgtttccgaccacacttgtgttagtacttcttagatgcatcaagctcattctaatctaagagcctctgcagttgcctaaagagctcttccccaagatgtctacctagcttatttcatcacttgtctgtattcaaatgctacattcttagtaaagcgttccctgatcacccaaccctaaaataatctattctgtccctttagcctacgttagttttcttctgagtacatatacttacctgacattatatattatatatttatatttcttgtgatctctttttccactggaatataaattttcttgatgcctgggcatttgtctctcttgtatctctagcacgtagaacactgcttagaccatagtaggggcttgaaaagtattggggaagtttggctggaagagaaggagaaagatgaaattaaatgatatttagaaaacacatgcacaaacagcagaaaaacagacacaaatctcaaagcttcttatagtcaaggacttttaaggacagataaccttggtatacctaagggtctatgtaattgtgctcataataataactgaatcattaataaagggctaaattttgttcagtgaagtctgcaaagaaatattaggctggtgcaaaagttgccattacttttaatggcaaaactgcaattacttttgcatcaacctgtatgatttaaaaatagatgtcattatttgaatatccataatattccatttcagacttttagtaatcataataatgcccaaataaggaagctttatgtcactgtcatacttaactattcttgattgcagggactatgtattgttgcattttaagttcccaacacattgtcaagtttatagtagatgttcgagagataatttactgaactaattattcctcataaacattctgcttaagactatcaattgtatattatgaaatgataacctacattgtaatggcttttagagaacatatgaattttacctattaacagtgtgttttcatttgtattgttagagttcttcttcctaccagttactaaaaatcaactctaatagttatggtcaatcctgagtttatgatgtagtgttgctataatttataatcatattttaatctggttctatttccttaggtgaatacagtttacttacatagaatacatgaaaataatacaatttaaaaactcagatctatgttatcaagctagctgtagtggagagaacaaaaggcctgcatgggtttcagtttcagctccactgttagttgttttggctttaaggacatcatttaacttctctcaaacagtttcctcatctgttaaatgagcttaacaccttaaatttgcagggttgtttagggttcattcattcattcagcaagtaaattttatgtgtctaagggttatgcttgatgcctacaagtcttaagataaataagagaatccctttccttatgaaatgtattatgccagggagattaaggcatatattaaagcaatatactgcaagatagaaggtgttaaattttctaagcggttcaaagagacaactgattacttttaaatgagagcatcagggaatacttcatggaagaaataacgtttatgctagacattggtggaatcaaagccatttcgagagaaggagacagttgagcaaagagatttagttggcctggggtggggatggagtgtagaaggagggagtgagttatgaaggagagaagtgataaattggccaaaggtgaaggagaatattagatgataagggtgaaaagatagcttgaggccagctcatagggatcagataagaagtgtaagtaaaacatgtttgtagttgcaaagtgctatgtcaatataaggtatatatggtgggggttgttctttctatagaaaatgccttagtcattagtgggtgcaatttttttgtttaattttcaagatgagcatggtggtattatcatcattaaaaaaagacataaaaaatacatttttccattctttttatgtgaattaattgctacaatttgagggtttttttgtttagtatatacagactatgtttttgtaagacattctgatttgttttttatgtgtgctgtgtatgcatttagtgttacgcattatgttttctcacttcagaacccttctttgtttgatctttgtgtatgttgtagggggagggtaaatatagttaaagccagctgtctatccttatttatcttccagcgggtgcttaaaagataacagtgttgagagtcaaagagaaacacagtcgtagtatgcatgtacaagcacgattctttttttcaaacattcacattaaaaaatgtgcataattgctgtggtttttcaaggggacatgacctagtatttaataatttctctgaaaatcacgtgtttcagataattaatttcattaagatgaaaagttgactgtttagatttttttttcaaacttgtttcttttgcaggttcctactaacatatataacttaatttggtacaataacagtataccatatttcacttactggtttggccatttacagtgggtataaggtgtgaaataggctctggtacactagtggtaagagtactcattgttgctatctctttggaggataatttggcagtgtgtgtaaaaattttaggcaaaattatgttgattaagccgttttgtttctagaaatttatcctacaaacatacttgtacatggttgcaaagacatgtatgctaggaggatagtcattgccattttgtttatagtagaaaaatcctagaaaccactcaaatattcataaattgatagctctttaaattatattacctctgtacagtggaataccatggagatattaagatgaatgaggtaatggtgggagtgaaaatggacacagcactttggagaactttttggcaacaggaatcagttttgtggaagacaattttttcactgggctggcgggtaggagaggggatggtttcaaggtgaaacccttccacctccgatcatcaggcattagttagattctcataaggagcgcgcaacctagagatccctcccatgcgcagctcacaatagggttcgttctcctctgagaatctaatgccgttgatctgacaggaggtggagctcaggaagtaatgctctctcaccagccgctcacctcctgctgtgtggcctggttcctgacagagcacggaccagtactggtccatggcctggagattggaaacccctgtactaacctatgacccagttctaatagaaatgcttacatatgtccaccaaaagacatgtatgagaacacttaagtaatattgtttgtaatagtatccagtcatgtaccatgtaacaatgtcttggtcagcagcagactgcagatatgaaggcagtcccataagattataatggaactgaaaaattgctgttgcataatggacagcatagccatcatagcataacacattatttagatgcttgtggcagtgttggtataaacaaacatattgcactgccagccatataaaagtttagcacttaaaattcatgtacataatacttgatcatgataataaatgacttactgatttatgtatatgctatactatttattattttagagtgaactcctcctacttattaataaaagagttaattgtaaaacagcctcaggcaggtccttcgggaggtgttccagaagaaggcattaatagaataggagatgacagctccctgtgtgttattgccccgaagaccttccagtgggagaagatgtggaggtggaagacagtgatattggtgattctgatcatgtgtaggcctaggctaatatgtgtgttaatgccttagtttttaagaaggtttaaaaagtaaaaataaaaattaaaaaatgtaaaaatagaaaaaagtttatagaataaggatataaagaaaaaatacgtctatattgttatacagtatgtccatgttttaggctaggtattattacaaaagagttaaaaaggtttaaaaattttttaagtttataaagttaaaaagttacagtgagctaaggttaatttattattgaagaaagaaaaaaatttttttataaattcagtgtagcctaagtgtacaatgtgtataaagtccgcaatagtgtaatgtcctaggtcttcacatttactcaccactcactcactgactcacccagagcaacttccagtcctatagctccattcattgtaagtaccctatacaggtgtaccattttttatcttttataatgtatttttactgtgtcttttctatgtttagagatgtttagagacaaatactaccattgtgttacaattgcctacagtattctgtacagtaacatggtggacaggtttatagcctaggagcaataggctcacataactgtaagtaatgagaataacaaactgtagctacatacaagaacatgatggctctcacaaatgttaaacaaaacaagccagacacaaagaatacatattacatgattccatttacatggagttcaaaaaacaggcaaaaatcaggagtttacccttggggaatggatagcaattggaaagaatatgagccggaacttctaggatgcttgtaatatgctgtgttctgggtgctgattcacttcatttttcatcatgttgtatacttatgatttatccatttttctatatgtatgtaacacttaaattcaaaaagtttacattagaaaatgagtgagatctttgtgcactgatactggaaaatctccactccaggatataagtgaaaaaaaaaaaggcctggaatagcatatatagcatgctcccagttgtaattggtgatttgttttttaaaaaatagtatgtgtttctctatgcatcaagaaattcttgaaagataatagacaaattgttagcatggttttcttcagaagatctggagtgagacgaggcttctcatattctttataatatttgtggttcttttcctatacacatacattacttgttaaaatttttttaatgttcctttaaagaaaagtgagttggcaacttaatacagagaggactgtaattttgtaagttttagaacaaacttctgtttgggttttttttttttttttaaacaggtacatatttgcttactaacacaacctagccccattgttaagtgtgcaggctttggagccagattgtagggttattacatccttgtgatcctgggcaaggaacctattttgagtaagccttagtttcttcatgtatctgctgagaaaaaccaatttatagtgttgctgtgagaactaatgaaattatgcatgaaaaacattgagtatattgcttaccccaaaataaatgcttaatgattgttagctgatttttaagttaaaaattcatgaagccatgggaagtttgtgatgggaccttatatatcttttatttttgggactcatggatcagagagatgatatacttattcttaaaaatgatactaatttgttttttgattccctggaattttttatgatgatcttgtctagcaagagtattgtggtttaatcccagtaaatctacaaaagtttgcttcagggagatcatgccaaatgaaggaggtttcattgtattgcttatatatgcccttaggttttagatttatgtgcaattgaaagttttggatctttgatgaataacttgactattaacagttaaaattgccttttgctttttgaaactttttttttccttcagagacagggtctctctctgttgcccaggctggagtacagtggccccatcctagctcactacagcctagacctcctgggctcaggcgatcctcctgcctcagactcttgagtagccaggaatacaagtatggagtagcaccatgcctggctaattttttaacttttttgtagagacagagtctcactatatcgcctaggctggtcttgaactctttgcctccagtgatcctcccactttggcctcccaaaacactgggattacaggagccaccatgcctggtccctgttttttgaaccattttgaaagtaaataagttcattagcttaaatatagtattttcattcagaagaatatatctttagcatttattgttttacagaggtccttggggtttttgttgttgttgctgctgttttggttttcgctgacttttctaacaaattgtggagttcaaggatattttattcagatcatatttactgaaagccttagagattttctagttcctatgttatcaagtagaacttaggtaaatatgtgtttagattttataaatatggattacattttctgttcatggcaattttcttcctatgtaggacagaatactactgttgctagggtcatgaatatttgaaccctaagcaggctatttcgctttcttttatgtatggccacagatattaactagacagaattagaaaattttgatatattagagcaaatctatcaccaccactactaaaacagttcaaaatatatgcctaggccgggcgcggtggctcatgcctgtaatcctagcactttgggaggccaaggcgggtggattgcctgagctcaggagttcgagaccagcctaggcaacatggcaaaaccccgtctctactaaaattacaaaaaaattccctgggtgtggtggtgtgtgcctgtaatcccaggtacttgggaggctgaggcaggagaatcacttggacccaggagggggagggtgcagtgagccaggatcatgccattgcactccagcctgggcaacagagcaagactctgtctcaaaaaaaaaaaaattatatatatatacacacacatacacacatacctaacatagaaattagtaatgacatcttaagatatatttattacttttttccttttctgttttttttaattgaggtgaagttcacataacataaaataaatttcattttaaagttaataactcagtggcattcaagtacattcacagtgttgtacaaccaccacgtctatctagttcccagacattttcatcagcccaaaaggaaaccccactctccattccctctcctcagctgctggcaaccactaatctgccttctgtctctatgaatgttcctattctgggtatgtccataaatggtgtcatacaatatgtggtattttgtgtttggcttcttttagttggcgtaatgttttcaaggttcatccatgttgtagcatgtatcagtacttcattctttttatggctgagtaatattccattttgtgtatgtatcacaatttgtttatccattcattcattgatggacatttgggttatttctatcttttggctattgtgaatggtactgttaggaacatgcataaacatggatttgtttagtacctgtttaattttctgaggagccaccaaactgtttttcacagaggctttaccattttccattcctactagcagtttatgaggattctgttttctgcacatccttgccaacacttgttttctatgtttttgttttcttcattatatccatacaaatgggcgtgaagtggtatctcattgtggttttaatttgcatttccctaatgactaattatattaagcatcttttcatgtgctcattggccatttatatatatattttggacaaatgtctatccaggttcttagccctattttaattgggttgttcattgttccattgttaagttgtaagagttcttcatgtgttctagatactagacccttatattagataaatgatttgcaaatattcctccctttttttttttactttcttgataatgtctactgatgttttaaattttgatgaagtctcatttatctgtttttccttttgtttcatgtacttttgttgtgatacctaagaatctattgccaaattcaaggtcatgaagatttatcattatgttttctttggagttttatggtttgaattcctatattgaagtcatcaatgagttttgaattaatctttgtgtatgctgtgagacaagggaccaacttcacttttttgcatgtgaatatccagttgtcacaggactaagctgttgaagagaatattcttttccactgaatggtgttggcactcatgttgaaaatcaatcagccatcgatgtataggtttatctctggattctcagtgctattccattcatctatatgtctgttttcataccagtgccacaatgttttgattactatagctttgtagtaagttttaaaatgacaaagtatgagtccctaactttgttcttttttcattattgttttagctatttgggacctcttggaattccatatgaatttaaggattgactttttcagttctgaaaaaaagccattggaattttgatagggattgcattaaatctgtagattgctttgggtagtattgccgtcttaacaatattaaatctttaaatccatgaacacaggattcttttctactttaatttctttcagcagtgttttgagtttgtagtatacaggtctttcacttacttggtaaaagttatttctagatgttttattcttttgaatgctattgtagttagaattattttcttaatttcattttcagattgctcattgccgatgtatgcaaacacaagtgaattttgtgtgttgatcttgtactctacaactgtgatgaatttactaattctagtagttttattgtggattctttgggatttgtgttatttttgtttcctgactgttgtaatgcatctgtggtctttgcttaggaatcaggatgtaaaactatatatcattttccatttataacttcctaactaatcttgcctttgtacttgttcccttgtagtctgttcacttaacagctagagtagccctttaaaataattcatgaggtcatgccgtgtatgtacaaaaccttctacaggcttgtacatcagagtaaaagcttaagtcttgacaaagtactgaagagctctgtctgatctactgctgaccagttctttaccactatacctttgtttgttccaatcatagtaacttggctttcttcctagagcaatctatcttaaggccctttgtactttccctctctacaaggagccgtcttcccccaaacatcccaatgctttgttctctatttccttaaggtcatctccttaagtgtcatctcctgagagtcttccctgaccgccctacctaaaataacacctaacatcattctttatctccttactgtagttttccttcaaaccccttatctgactttatgcagaacagaaatttcctgaagataggtattttgtccgttgttcatcactgaattgctagctcttagaatggtgtcaggtgtaataggcacctaatcaatacttgtcaaatgaaggaataaagtttcctcaagtaaaaggaaaaagaaactaatatatactgaatactcataatgagccaaacgttattctaggcatttgatatatgttgttcacatttaatcttcttaataaacttatgagaatagatattatccccattgatcaacaaagaaacagagactttaaaaaaaaataaataatttggcatcgctaggatttgaaatctggtctgtagtacttgattccaaagcaaaggctttctctaccgtgttattttaaaattattaaatcttctatatactacagagaatacaaaggtaaacaataaatggttatttaagtatataaattagtatataggctgggcatggtggctcactcctgtaatcccagcactttgggaggccgaggagggcagatcacctgaggtcaggagttccagaccagcctggccaacatgatgaaaccccgtctctactaaaaatacaaaaaattagctgggtgtggcgtcacgcatctgtaatcccagccactcaggaggctgaggcaggagaatcgcttgaacgcgggaggcagaggttgcagtgagccaagatgacaccactgcactccagtctgagcgacagagcaagactccatctcaaaaaaaaaaaacaaaagtttgtatgtaattaaattccaaatgagcagtactgtcaataaattttatagttatttggaaaatcattagaccaaatggaagtgtttctcatacagtgggcttaaaacgaaatatgttgattcagtgaatttatgaacaggtaaggatccaggatctgtctcttaaatagtaagtagaatttgaattagtggagagaaagaacaaggccattttaagtagagggaacaacataagtaaatgtgaaaaacaaacttattaaaaggataataaaattcatcacgagtcaagagttaatattttaggggtgctgcgagataagtttgggaaaagtgagttggtgattagattatgaagaatttgaattgtgaggctaaggtatctaaagtatttgaacattataattactggcgagccatagaataatgatattgaacatttgtgtggacataatgggcaatagaatgtagtgcttaagagtatgaactttggagcaaaactgggttcaaattctagcttaggtcagtaactaagcaaatgacaacctctctgtgctctagtttcctaatcaaatggagataatggtttttaactcaaagagccattgtgatggttaaatgaattaccaattattctatgtaaaaatactgagaacagtgcttagcacatagtaagcattccgtaaatattaactgttgtcatttatatgacatttaaattttcacactactttcatgtgtactgttccttctcattttcatggcaactctgtgaggtagatattactatatccagtttaataatggagtaaatgaagccaaagagaggttttgtcatgccggatccccaaatgacagaactgatcacatgattctaagccacttcaccatgattctttgtaatctaaaaaactaatagaacaatgggatgacatgctgaaagtcaagttttgggaaattattctagtgacattctgcagagtaaaatgaagacgagaaagaacccacaggcgactttttaaggctcttaaaataatctaggtttggccaggcggggtggttcatgcctgtaatcccaacactttgggaggccaaggtgggtggatcacgaggtcaggagatgaagacaatcctggccaacatggtgaaaccctgtctgtactaaaaatacaaaaattagctgggcgtggtggtgcgtgcctgtaatcccagttactcgggagactgaggcaggagaatcgcttgaaccagggagtcggaggttgcagtgagccgagatcacgccattgcactccagcctggcaacagggtgagactgtctcaaaaaaataaataggtagatagatagatagatagatgatagataatctaggtttaggttttatttatgaaaaatttctatgccagggctatatcattgagaatgaagacaaaagattattaattcaagggaagttatgaattttataactgaccaatatcttaatattctttcagctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgaggtaatcaaagcaagacataacacctcatgaatatagtttgcattagctatatagctatctggtttagtgggtacttaaatccatcctctacttgaagaggattattagcttaataactaatcatgtttcttacttttgttttattaaagatattttaagtaatggtaaaagtaaaaataacaatttttctctatctttctgtcttccccatcctttactagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctggtaagtccagaaacttgtgtaccacttttagagtggcatattggttattgacttcctctaagataaaaccaaggctgctaggttgtacaactgcagaggccgtggttcacattatagtttatgtgagtggaggccctgggaaaaagtactcacgtatattttcctcctgagatcgagtatcaggtggccaaatattgagatgattttgtaaattataaacattttttacttcgcttaactagctgtgataagatgtagaactttgtaagtttccttcccccaaaaaaatgtggtaaaagaattattttcctgttaagttgatgtgagtatcaaccgaacattttattttaggaaagatttgttctctaaaagcagtaggaatatcttaccagattatcaagtttaatttgaaaaattgactttgggctgggcgcggtggctcacgcctgtaatcctagcactttaggaagccaaggcgggtggatcatctgaggtcaggagtttgagaccagcctgaccaacatggtgaaaccccgtctctactaaaaatacaaaattagctgggggtggtggcccatgcctgtaatcctagctactagggaggctgaggcaggagaatcgctagaaccccagaggtggaagttgcagtgagccgcgattgtgccattgcattccagcctgggcaacaagagcaaaactccatctcaaaaaaaagaaaaagaaaaattgactttgattcttgtttataataagttctttttttcttccactttacctgtctcttaatgatctcaaaatcatttagcctcagcagtgaaataaaatttcctgcaaaactgtaaagctttcttctgtaaagataactccggaaggggacttctgtttacttgtaaattgagccagctctttttgaaaatcatttgaggccaggtacagtcgctcatgcctataatcccagtattcgggaggctgaggtgagtggatcccttgagcccaggagtttcagaccagcctgggcaacatggtgtaaaccctgtttacaaaaattaaaaaattagctgggtgtgatggtgcacacctgtagtcccagatacttgtgacgctcaggtgagaggattgcttgagccaggaacgtcaaagctgcagtgaaccatgttagtgccgctacactcccagcctgggcaacagactgagaccctatctctaaaggaaaaaacaaagaaagaaacaaagaaagtaaatcaattgagaaaactttcatatgattatttcttaggttatgaattacagctaacaataaagattagtgattaaattgaccaatctctataaaaactttcagaattgctctattttctcacctctttttcactttataagtatacgtccttgaaaactgcagttcctattgtttttcttttgtatgccccttatgttagcaaaggtttttttgttcttagccaaacataacaatttttttttaatctgaagacataaaatatggctttctattaagaaaaactgtagaaccaggtgcagtggctcacgcctgtcgtcccagcactttgggaggccgaggtgggtggatcacctgaagtccggagttcaagaccagcctggctaacatggcaaaaccccatctctaccaaaaatataaaaattagccgagtgaggtggcacgtgcctgtaatcccagctactcaggaggctgaggcaggagaatcgcttgaacccaggaagtggaagttgcagtgagccaagatggtgctgctgcactccagcctggacgacagagtgagactccttctcaaaaaaaaaaaaaaaaaaaaaaaagggggtctcctttgttgcccaggcttgtctcaaacctcctggcttcaagtgttcctcccgccttggcctcccaaagtgctgggattacaggcatgagccactgtgcctggccataaaattatttttaaatgagactttggaagattcagaaaactcaggttttactatgattacgtaattacagtaacaggataatatagttgtgtacattgtgtgctaagtgggcatttccccagtgtatcctttgtttaaatagcaagctgtgattcatgcatgactagttactcctattagcagaatgattgcccattgagtagatatttatttgtgcatctgctgtgtttttgctaataaatgaggacttgttgatggaataggttgacaatggtataagcagtaatagaataataaaatgtactatcagatacactgaaatatagaaggaataatttccttctatatttgtggtttgttgtttttgtagtaactgttataaacagaacagtgttatcatttgtagataattttagtattaattgacctgctgacttattttaatttaaatctcactgggaaaacttacccttagactgattcctagtgaattaacaagaatgtgttcactctagttatgtttttctgataccgctttttaaaagcttcatcctaaagtaaaagtacatttctttctttttttctttaatttttttttttttttgagacagggtctggctctattgcccaggctgaagtgcagtggcgtgatctcagctcactgcaacctccacctcccaggttcaagtgatcctcccacctcaacctctccagtagttaggaccacaggtgtgtgccaacgtgcctggccaattttttgtatttttggtagagatggggttttgccatgttgcccagctggtctcgaattcctgggctcaagtcatctgcctgccttgcctcccaaagtgctgggattacaagtgtgagccaccacacccatccttttctttaatttttagtgagaaaagcacataggtcataatggtaggcactgggtgccatttatatccatatttatattggaatctatggaattgatatatgctatgctcctaaaaacaaagctaaaaaaatttataagaaattgatttattttgatatgaatattgtatgtcaaattagtatagattatttacatccattaggttatactttctctccttaaatctatatttacctcaatcagaaatctaattaggtagcataaacagtgcctcagattttctaaacaaaaatataaattttaactcactatattaaaagtaagctaattaaaaattttaaattatagtcctttgttacataatttagacatcagtttttaccaacagtctctttagttctatagtaaaaattttacacatttctattataagaatagagaggtgttgtcatttagtaactactttatgtattttaattttaaaaataacccacaagttggagctgctattaatccctattttataaatgaagaaacctacattcagagaagttaattaacttgcctaaggtcacatagccagtgaagtgatgaagatgagttatgaacccaggcagtcgtttataatctgtactcttaaacactaacatttaacacttagccctattagtcacttatgttagatgtttaactttgatctagtggatcaaactagtagaatataaaaatcaaatttgaggccaggcacagtagctcatgcctgtaatcctagcactttgagaggcggaggtgggaggatcgcttaagcccaggagttcgagaccagcctgggcaacgtggcaaaaccctttctctacaaaaaatgaaaaattagtggggcatggtggcacgcatctgtagccccagttacttgggaggctgagggaggaggatcgcttgagtccagcaggttgaggttgcaatgagctgaaattgtaccactgcactccatgaaaagtagaaattaaaacttcatcttcttagctatttatcagtattaacttaaaagaggatgttaacatgttctttgtaataatttagtggcttttttgtgtaggtggtaaaatatcagctatccagaattgtctctggctttcataatactgttactctaggaattgtcactttaatcaaaatcacagggtagaagtggagaagttgaaaggccttatccagattaagaagagaaggaggagtgagttacagaattctctcccagaaggcgatatcagataaatctagaatgaatttgactgtgtgtaaatgtcagtgagttgagtatgatgtttatgctctccctctcacccggcctctgacagagtgacttcttcttttctctgtatttccagggtattttgtgtgtatctctataatatggtgctataattatacctttatgtatttatttgcccaactagactgtggatcattaaggcctgtaagccgcagtgcctgacatttaataaatacttgataagtctttgttaaatacatgaatgactgtaattatattcttcccttcattggttgtattatataacatttactactcccttctttcttccttttttcattttctctttttgtaaattttcccttcttcccagttttttttttaaattttcatgtcagtcctatcctttttcagtcccatcccaccatcccttttttccttatttaatgcattatctccctcttctgctcttatggagattttctgaattagccaggttttgaggatggggttggcagagtatgagagtaatgatagtctgtctcatgtcagttataaagaaatttgtcctaggctaccagtttcataatagttcatgattagagatggatttagacttcctgatcttttggtgttatatcctaaattattctatatttctgtcactttgaatcctttaagtccattctgcacactagagtttcttaaaatattacagaaactggtgccagagcttcttcgtgcatagatgactaccatcctacagtccccctcttcctcacaaaaagtttgctttatcgggcgcttatggttgcaaatggtatagattgtctctctggtttgttggactcatggaaagattatgagagtggttaagagactgagccatggaatgaaagtatatcagcaccagaaaataatgtctcaaagcctgtatgatgtcccacagacacctggtctagcttccaaagctccaagaaagtacccgtcataggtagttgacatccaggattgagtcataatgtgaccatttatctccctgacataataaaaataaatatttagagaaacagaagacagatccagccaagtctgagaagagagttacagattcccaagtagaatatgtctatgaaatgaatataactagataatcagagctagagattagattcattttctcaaaacttctacttactcggaatttcttctttcaggagtcacatttcctactgtataagatagaaaggggtcctttaggatgaggattaaggcttccttcatcccatcttcacttcacacagcgcttatcaagacaatctgcacaatttgagcctatttctggtaattgcattggtacctacttcccttctctgcaatgccaagatttccctttgtagtgataaacaggcttccacagaatatgttaggaagagtctgtgtcggtcttctgtaaaatggggatatgaatagttcctagctcatggaattgttatgaagatgagttaatgcttgcataaagccttgaggaaaatacactgcatgagttactgcccaatacatttaatacatttatcatgtgttcagaacagtgggaagagggctgatttttgtggtataatttcaagatgtacacagtcattaccatgtcattagtgaaaagaaagtggctttggttagataatgaggcatgcctcagatggagtaccatcctttcctacttatcctctgtaagcaaagaagagttttgtattcagttagctaagatggagaacagtctagaaattatagcacttgcctctccagcaaaacttcctaactttagagcctctcagtgcttctatcttttgctgctctgtgctttcaaattcaactcttcccacctctttgctttctattttcttttctttttctttttcttttttttttttttttttgataacatgggtgaatttcttttttttatatatactttaagttctggggtacatgtgcagaacatgcaggtttgttacataggtatacatgtgccatggtggtttgcagcacccatcaacccatcatctacattaggtatttctcctaatgttatccctccccctgccccccaccccccaacatgccccagtgtgtgatgttcccctccccatgtccatatgttctctttgctaaactcccacttatgagtgagaacatgcggtgtttggttttgtgtttgtgtgttagtttgctgagaatgatgctttccagcttcatccatgtccctgcaaaggacatgaactcatccttttttatggctgcatagtattccatggtgtatatgtgccatattttctttatccagtctatcattgttgggcgtttgggttggttccaaatctttgctattgtgaacagtgccacagtaaacatacatgtgcatgtgtctttatagtagcatgatttataatcctttgggtgtatacccagtaatgggattgctggttcaaatggtatttctggttctagatccttgaggaatcgccacactgtattccacaatggttgaactaatttatactcccaccaacagtgtaaaagcattagtgtttctccacatcctctccagcatctgttgtttcctgagtttttaatgattgccattctaactggtgtgagatggtatctcattgtggtttgatttgcatttcactaatgaccagtaatgatgagcattctttcataagtgtgttggctgcataaatgtcttcttttgagaaatgtctgttcatatccttcacccactttttgatggtttttttttcttgtaaatttgtttaagttctttgtagattctggatattagcccttcatcagatggatagattgcaaaagttttctcccattctataggttgcctgttcactctgctgatagcttcttttgctgtgcagaagctctttaatttaattagatcccatttgtcaattttggcttttgttgccattgcttttggtgtttcagtcatgaagtctttgctcatgcctatgtcttgaatggtattgcctagattttcttctagagtttttatggttttaggtcttatgtttaaatctttaatccatcttgagttaatttttgtgtaaggtgtaaggaagggatccagtttcagctttctgcataggctacccagtttttccaacaccatttattaaatagggaatcctttccccattgcctgtttttgtcaggttcatcaaagatcaaatggttgtggacggtgtggtgttatttctgaggcctctgttctgttccaatacatgctgttttggttactgtagccttgtagtatagtttgaagtcaggtagcatgatgcctccagctttgttctttttgcttaggattgtcttggctatgtgggctcttttttggttccatacgaagtttgaagtagttttttacaattctgtgaagaaaatcaatggcagtttgatagggatagcattgaatctataaattactttgggcagtatggcattttcacaatattgattcttcctatccatgagcatgagtgttttcccatttgtttgtatcctctcttatttcctcgagcagtggttcgtagttctctttgaagaggtccttcacatcccttgtaagttgtattcctaggtattttattctctttgtagcaattgtgaatgggagttcactcatgatttggctctctgtttgtctgttattggaagcactaaacatggaaagaaacaactggtaccagccactgcaaaaacataccaaaatgtaaagaccatcgacaattatgaagaaactgcatcaattaatgggcaaaataactaggtagtgtcataatgacagcatcaaattcacacataacaatattaaccttaaatgtgaacaggctaaatgccctaattaaaagacatagactggcaaattggataaagagtcaagacccattggtgtgctgttttcaagagacccatctcacatgcaaagacacacataggctcaaaataaagggctggaagaagatttaccaagcaaatgtaaagcaaaaaaaaacacaaaaaaaacaggggttgcaatcctagtctctgataaaacagacttcagaccaacaaagatcaaaagagacaagggcattacataatggtaaaggggtgaatttatttcttaagatttgagtgcaaacttaaaaacaagaacaaagcttttcatcaagaataaacacaaaagctaaacaattcttcaggcgtgcatttcaacagaaagtacaaatatgaatacattataatttttaactgcatttaaaaattaaaatatttctctccaaatccaaaacagtacagtctttaatctgttctcatcttttttagatgaattataaacatttgtcatatgctatctggaaaatatagacaagaattactaatcagttctttatgatcaaagaaacattattctccttaactgtgagtttttgaatcatttatctgtatttcagttcagaaataccatataattacacctccactctagacaaaaaaagaatacaaatatcaaggagtaggaacgttcatagaattaaagcagaagtcacaagtgtttgacttagaaatgtacatattgtaataattttttttttttttgagatggagccttgctctgtccccaggctggagtgcagtggcatgatctcggctcagtgcaacctctgcctcccaggttcaagcaattctcttgtctcagcctcccaagtagctgggactacaggtggccactaccatgcccggctaattttttgtattttaatagagatggtttcaccatgttggccaggctggtctcgaactcctgacctcatgatccacccaccttggcctcccaaagtgctgggattacaggtgtgagtcaccacacccagccctgtaataaatttttaaagtacaactttagttaatggctgacatgtatgtaataattgtgaacaatttaggtataaaaatgtgagatcaaaatctttaggctcaaatacttgaaaagtcagtatgaatatggaaagatttgtttacataaacgtgtatatttttagatgaaaaatcagggggtagtggcatctccctgatcccttaacaatatttggatttttgcaaagaattagcagcatccatgctgttttctaactatagttattcctgctttttttcctcctttacttcctttcttagttatccattcagctcattcctttcactgctaattctcaacctagccactgttgccaggtctctgtatttatgattggttctttggtttccattttatcaactaaagtaatcatgctgaatggtcagacatgaaatggagacatttaatacgacttttcttgtttctgtgttttctgattttttttttctttcagtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaaggtagggtatgaatttgcatctatactactaaatcgctggtgtaaaccaagatatattgggaaggataaatgagaaagttaaggtcatgatgaaaacttacccaataatattataaacttaatttaatgtacttggcattctgttagcagtctccttatctgatataatttggcttttaaattatgcattaggatttcgtctgtccatttgccaagatatttacaacttacacttaaagaattctaaaactttcttctagcacattggtagttatattgcaagtgctttcatgccagcaatttgttgtctcactattgctgtataatgtaacatatataccagtgatcagaaatactaattatttagaaatagatcaagtgctttgagagtaactacagattgctttttaattcttacttgggatgttatttttcttctggccgttttcgcaccccccccttagtttatgccagcagttcaagttattaaggaattttgccttcatgacaaagatctcattgagatagaatatgtaacatgtgactaacgaaagttgatgaagccgatgctgacacattcttattgattgccagtggatcacagttctgttgtaggttgatcacactcaattctgaatttcagaattcaaggaaaagttgatttaccaactccattcttatttaaacacacagtttgttcttggtttaaaaaaagaggggaggtgggtgtacaagagaatgtgctcttgggtgtcttgtgttgtggtggtttggaattcacaaaattgtctagaatcactggtgatacttgtaggttttccagatgtttcaaattacagagccaacccgttttttcctccttctattagtatactcatcttctaattttcttacagttttatcacactccaaagaaagtgattcctggacagatatccataaatctgagagagcaaatttccccactagttcccccacaacatattttaccttctctccttgacttatctatcactaaaaagcttgagaatagactgggcgcagtggctcacacctgtaatcctagcagtgtaggaggctgaggtgggcagataacttgaggtcagaagtttgagaacagcctgggcaacatggcgaaaccccatgtctactaaaaatacaaaattagctgggtgtggtggtatgcacctgtaatcccagctactcaaaaggctgagatgagagaatccctggaaccgggaggcagaggttgcagtgagctgagattgtgccactgcactccagcctggaccacagagcgagactcagtctcaaaaaaaaaaagaaaatcttgagaatataatagttgcaaagaagaaagtgattctgaaggttttttgcttttttagacttggtattagctacactatatggctaaatgatgtgaacaagttactttttttcaatggtaatttttcttctttgaaatcttcacagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaaggtattctgtgattgactctgaagagatttttttaaacctggatttttactacctgactctatttcttactctggctacttttccatttgtcatgctcttttttttccactgaaatttcagttccttcagttatatcagtttgttcttgaatgcagttttagtctcattccagtatctactgataaagtaccattgaaaagaagcacagtcacccagaataataatttgtgataatgtttaaaattctgaattatgtttaatgggttcaatctatggatatcttgggtttccatttgtttttagacttccttgttcattaatgaggttgggaaatgtcttggtgaaaaaaaattccctgtggcaatcaagtatatttttaatcgctttccttcaccaagtagtaagaattgtttccagcccatttaactgcaaattgagttctctgattcctctagtttctcatctccatggcaacgtattattacttgagactgctcttctgttgagaagagaaaaggcttttaagttctgagccacatgcagccactccttttgaatttttaacctttttccaagaactgtcagtcaacaatctcacttccttttagtaaaatgcgttccatctttgtctttttaagtcaacatcaaccaacaccttagatgctgcactttctcatctgtaggttgtaaagagatgttactaattgaaattaatagttatttttaaatactttgcaaaattttttttcagtgatttttttttcttaattgagagactatattttaggagctttggccagtgctacaaaattgctgtcaatctaaagtgtgtctaacggtcataaaagatcagaacattgcttcaataaaccttgagatttgatgcagcagatgatatttataatataattccactttttgcagtagattctgtggttggagtaggattgataaatgtagccaataattttaccaccatgtaggcattcttgttaaatgatataatttaagtatgtcagtgaaggaaacacatccccaaagttcccataattttaactcatactgtggaatgctgttgttaagtccaggcatatatcataattcaggaggttgttactagagaatttataaattgggcaactgatttaatacatggtatttatgactccatttactaagttataaagaaccctttacttttcttccatcccaggtaaaaatgagtactgttttttggtcgaatattttagaacataatatacctttaactgcagttgacgcctgaacagcttggagattagggacaccaacctctcacacagttgaaaatccacagataacttttaactcccaaaagcactactaatagttaccattgcctggaagccgtactgataaagtaaatggtctattaacacatatttggtatgtcatgtgtattatatatactgtactcttataatcaagtaagctagagaaaataaaatcttattaagaacatcataaggaagagaaaatatctttcctgttcattaagtggaagtggattatcatgaaggtcatctatgtcatcttcacattgtgtaggctgaggaggaggaggaagaggaggggttggtcttgctatttcatgggtagcagaggcagaagaaaattcatatgttaagcggacctatgaagttcaaacccatattgttcaagggtcaactgtatactgatagcattcagtaaaaagctgaaaatccaaattcctcaaatctgtgaacagtccaaatctaaaacaaatctaaaacaaatctaaactaaaaaagtaacagtttagatagtattgtgggcttaagacatttcttactgacatacttcttgaaagaattttataaaccgtattacctttcggacatttttaagtttacaactgaaatttttcatcttaagtttaaataattacaaaagataccgtttcagtgtattttaaatgttcacattttaaaataaaactgctaaatatttctattgtgcaatagtcagaaaatttccatctctttgctgttgaactataatgtatctttattttaatgtaatatatttttgttttaatgacttgtctgctacataaacatgtaaattgaaattaaattatttctgtcactaagagattaatttgttttctgttctgggttgtaattactattaccctgattattacctacagttgatcaaagcaacattacaaatgtattacacatttaatttttataagtaattgttgcagataaacatttcttaatgagataaatttatgttattactatttcctttttcagtttttatataagtaaactcagaaatcttgtggctatgcagatgagaataggagtttcgttgttgcagtatcccacagttttatgagttcagtgagttatttatgggttatttacccaattctgagttatttgttcaaaaaattgtatagtgatctgtcatcaataaatatttttagtaatgaaattttcttggttgaaagcaaagagttgaaaataaataaagcaaataattgaacatgaactgaatgaaaaaggatttgataaccagccattggagtcattaactttctaacctagacagtagaccatcgtatgattattaattttagaagctctttgtctaatgcaacatatgcaaataattgttaggaaaataaaaatattgttaatttcagtacacatttaccagtgcaatattttatgatgaaataattttatcatattctttaaatgtgcttttgcaaaaaatctggaacttcagattacactcatctgagctatggaaaatatctgcaatatacctgtaggtgaggaaaaacttactcctctaccctcttaagtaattggggcctgcaaatgaaattgacaacagatagattaataaaagaaatggtttgttatgtacacagaggtcttcatagaaaggaagacccaaaagaagtgtttagactaggggttggagaggggcttatataccatttttacaaagaatgataaattgtgaaaaagtaagtttagacaaaagtaggggattgggcttctggatggtaaattgtgaaaaggtaaatatatggagattctaatgaaagaaaaggattatttagtaaggtttgttatgcataccaaagttggtgtcttctccattgataagcgtcatctctggtaaagaagtgttgccctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggagcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaagaagtgttgccctcctcttcctagtatgggagtgacagcgtcacctttagaaatggaaatttatattacatttacaaaaggaatttatgccctgcttttagacaaaaagagggagggcagatatatttcccttcatctgagggtttcttagttaccttcagctcaaaataatccttatgccaaagttacatatttggggtggcatactctgatcctcttcataccctaattgggaaatcagtcagacaagtggaaaaaattttgacttcaggttaacatatttgtgtgtgtgtgtgtgtgtgtgtgtgtgtgtgtgtgtgtgtgtgtgtgtgtgtatatatataaactggacaaaattttttgcccacagtaaaagttttttaaaaaccagaaacaaaaatattttttagatggaccgttggttatatatcttaatcatattgctaaaataaaaaaaaccttatagttacatgttaaatattcatatcactaaaatttttaactaaaaagcttaaaacagagaggaaaaaattgaaatatatatatatgtatatatgtccatgtgtaagcacctcgttccttcattctagttctgagttagatgcatgaccaggtagataggtagacagggaggcagagcaggcatacattcagcaagtacttactaagaatattttatgtaacatgccgtgctaagcactaaaaaaaatagcaacaaagcacaacacaattcttgcccttaataatttataatctagtgggggaatagacaaagtaaaaaggcattaattggttcttaatagtattgttaagtgtactgttttagacatggcttaaaatggtaaattttatttgtttttaccacagtttttttttaaaggcataaaaatagagtataaagagataagcagggtaccgaaagaacccccagcacaggtctctaactcagtctcctaggcctcagaatgggaggaagacttctggaggtaacatctaagctgtatcctattgtttatattaagttaaggaggattctagttaccctgttatgtgccttgctcaaggacatgtaatttgtgagtggtggaggtgtagtagttctcagttctattcttcagcctagggattttttttttttccagacaaagcgacatctttaaagtggagataatggtacctattctgtttgtttcacaggtttgttttaaggagtaaataatagagtgcacatgaaatccccttagactcttaacatgctacgtaaagggaatttatgataaaatgaaatattttctttgctgactagagctgctatatgtgtgtcttcctttacagccttttaaagagaaacccttaatgattgtcttggccaggggacttgcacagggcaagtatcgattagaaatgtgtttggctttttgcccaagtaacatagctacttactcaccgaacactattcagtactcactgtcaaagttttttaaaaaccagaaacaaaaacactttttagatggaccattggttatatatcttaatcatattggtaaataaaaaaaaactcatagttgctacatgttaaatattcatatcactaaaatttttaaccaaaaagcttaaaatcgagggaaaaagattgaaaagacaactcagaggaaccattgacagaaaatttgacattgaatattgatcagaagtagaatttgttaaagaacatgggaaatgggaaaaataaaaacatcaaataagtggaatttgatttctgttattttcttggataatattccaagagaaaaggcactagaaaacatggactttagaaataatcattaagccaaaagaaaagattcaatatgattaattgggtagatacttttctatgaaatgtatgtgtactgttacaaaggataaattttagaggggcaaggagtaaaagacagtgaggtaaccttgtttggattcagagatctgagtcttttcaaagaactagcctgcaagagttaccatagcaacagcattatattaggggcattttcaagattgtttcagagtgtctcatgttttgctgcatgatttgtaaaaattgagatgtaagagtaaaccgtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtagccagtctccatattttaagaattcacatttcattacatggctaaatttgaaggcaattcctacaagtgttttgttggaattgggattggaggaggcacaaacgtgttttaaatggtttttgtgtgtccttgaggtttcttggctttggcaaagaaaagcctgtgggaggtacaataatagaaaaggccattatgttgttctttctaagtggttgttgagggaaagcatttcattagattttctatttttcatttacagtttctaacattctaaaatatttgtaaatttttagtgatttagttagctctttgttactctttgattttgtattttactttagactttttgttagtgtttgctaaaaagcatttgctactagactttataaaatacttggaacaaagaggtattctcggcacaattaagagttcatttatgtctgtgtggttgttttccaatgcccagatctttctagatcccttcttgtttaacgttctctaagggctgctgtgcgccctaatgaggattcctcagtaggagctcagggccttcagcgcctatcattgtttgagtgagcacacatagtcctgaagtgcttcctccctggggtatgaccagtttattaccctctgtctaccctgagtaatagactgttatgccaaaatgtccacattttagtcttcttatgctataatagaaacactaattgtttttcattctctagggaaatttttgtttcattaactttaaaaaaaaaaagatatacacacatttttaaaaactgatttggataaatgctctcattcttggcttactattaaagtagctcaaatttttaactctttcaaaattgatatatttctgctgtaatttcctagcctaactaataatgcagaaaataagcaaattatttgggaatttatcttggcaatatttgcttaagaactgacgatgccgtaaagccaaatatgagacttttttcctgattattaattttactttaattcaacaaatatttcttgagtggtttttatctacttggcattgttatttttaaatggttttataattatatcccatcttaaattgcttttaaaatattaattatagctttgaataaatttcctttgcatcttctttgttacttaaagaaaagtctttaaaaaaaaaaaaaagaacacatatgcttacacccaataccattttggtagtcttatctctagtcacctttgttttcttaattgctcttaaaactgatagatgtaattggcatttctacataaattatgttgcatttgtaacactcgtgtacaaaagtttaaagtttaaaaagtctctactattttattgcttagaaattgagagaggatctgtggtgtttaaaagaaatagttgaccgggcacagtagctcacacctgtaatcccagcactttgggaggctgaggcaggtggatcaccaggtcaggagttcgagaccagcctggccatcatggtgaaaccccatctctactaaaaatacaaaaatgagttgagtgtggtggcaggcgcctgtaatcccagctactcgggaggctgaggcaggagaatcatttgaacctgggaggcggaggttgcagtgagccgagattacaccattgcactccagcctgggcgacagggcaagactccgtctaagaaaaaaagaaatggttgaaaattttttatacaggagtttgtctaattgaagagaaatttgaagaccaattgcttgaaagttgaatttttaattttcattttaatttacatactttatattatacataattttacatgagaaagctatggtgaaaagtataaacatcagaaaatgtcatatctaggtatttacagcaaaaagaaaagaaagagaaaaaaatgagcaggcaaatgtacttacagaccttgagttcctgctaagtatatggtactctaaggaacataataaattgtatgtgactctctttcccttagagttttataatataatacagtaagtgtactcatcgactattaacagcataataaaccaacccaaaactcagtagcttaaaaacagctttaatccattcttgcttatgcatctgtaggtcagctgggaattgactggactaggctgggctcggctggatagccttcaggctgctattctggcagggtttggctcctcactgcaggttgggtttgggtctatttcatgtgtgttcattctggcgcttcaattgaaagagcagccacttagccaggggaaacttcacatggcactgacagaaacaagacctattacacaaattttaagcctctgcttgcttcatatctgctatcctccaaaggccattgcaactgctaggccaaagcaagtcaccaaaccctacattaatggggcaagaaagtatacttctgccatggaaacagggatgggctgaaagggagagaagagttttaaaatgtaatctaatctactgtgatacagaaaacaatttaaactgatttgtctaaagtggcaaaggacttaaaacagttaattttgtagaataaacataactaataaacatgaaaaattttccactttggtaataaaaacagaaatataaattaaaataatatttaatcaaagaagtgatgatgcctatcactggcaagggtacggagagatgaaaactcattctgttggtagagtataaatttgtaagcaatttgggaattctctcgaatcttaaaatcattcataccttttgacctagtaagtacctttccacaactttttcctaaatagagaattgggcaaaaatgaatgtatctttgtaacattatatagtaaaaaactgaaataatctaacaaatgttcagcaataggagaatagcttacttacagtaactgcatagtatatgaaatattatacagtggcttgttaaaagtcacacagtggacctgcaaatagtagatgaagaataatgactgtgtgtgtgtgtgtctgttttcacagatggtcttgctctgtcacccaggctggagtgcagtgagtagcttggtcatatctcactgtagcctcaaactcctaggctcatgggatcctcccacctcagcctcctgagtagctgggactacagggtcgtgctaccatgcccagctaatttttattattgtttttagatacagggtctcactactgttgcccaggctagtctcaaactcagtcttccaaagctgggattgcaggcctgagcctgctgacacacttaaattaagagcaatgtggactcggccaaaatacgaaaataatttctctctgccagaaaatcgaaagtcattcttgaattggagggaaacaaaactaacatattaatgttgtttcaagtgatggcagaatcatttgacatgattaatttgcttagtgttgtatccttttttaggtcttaagaaatatcaagggggctgggcacggtggctcacgcctgtaatcctagcactttgggaggccaaggcaggcagattacctgaggttgggagttcaagaccagcctagccaacatggcaaaaccctgtctctactaaaaattataaaaaattagccaggtggagtggcatgcacctgtaattccagctactcgggaggccaaggcaggagaatcgcttgaacccaggaggcggaggttgcagtgagctgagatcacgccactgcactctagcctgggctacagagtgagacttcatctcaaaaaaaaaaaaaaaaatgtcaagggtagttagggtaatttgttaaagctggctagcaattttctcaatttatattgttaataaataaggaatgttgtgagcatgctttttagaatgtaatgaacgaaagaccagtgggctaatgttgaatttcttgtttgtttgtttttgtttttgtttatttatttattttttttttgagatggaatctggctgtgtcacccatcctggagtgcagtggcacgatctcagctcactgcaacctctgcctcccaggttcaagcaattctcctgcctcagcctcctgagtagctgggattacacacgcccaccaccacacccagctaatttttgtattattagtagagatggggtttgaccatgttggccatgctggtctcaaactcctgaccttacctcaggtgacctgcctgcctcgggctcccaaagtgttgggattacaggtgtgagccacggtgcctggctaatacttaatttcattgatactttggataggtataagatacggttttcatgaaaatattcagagtgaagaaacttttcgtacactacacacaatattttcttcacatagtaaaaaaaaaaaaaaatgatgccacttaataggaaggaaaataaaacatctacctaaatatctcattgataagtagcatttgtatttctacttgttcctctcctgtgggctcctcaggcctctctctaaatactttttagttgcttctgaataataccccagaacatctttcttttaaaggtagaattgtactacttgtaactattttatccttaccaggaatcttctcaaacgaagtaaatatctcccaaagtagaatgttgaagtctacacaacacatttcatagctggtatagaaaagactgaatcactgaagaaaattaggcagaaactctaagatctgttatatagtcttctcacttatgaatattagactaattctgtttcctttctcaactgaaaaagttgatatttgaaattaatttttaaatctgtcattaaactttctattgcagaaagtagtatttcttacctaaagagcaaaatacttagctcttctcaatttaatcaacccttcttccagtaagaattttaaaagcaccatcttagtgaaaggcacgttttcacattgagaactagaatgtgggctttggagttaggactaggttaatttagccacttactaattatgttaccctgagaaagtgactagatttctttgatttaaaattagtaaaattgagagaataattcccacctcataagtttattataaagattaagttgtgtaaatacactataactggtgttaattggtattgatatcctctccaccatctgtgatgaaagcgtgaaaaaactcacatgcaaaatattagggaagggattttcattatagatgtggaagaatttaaaataattatgagtaaatgtctagataaaatggaccatttatttttaggaaattagaaattaacaaaataaatgcaagaaggcagacactctaaattatggactaagaactattgcaggaatagggaaagttgtctttgaagtgtcagaccacagttttttcacaagtgaaactttgtaaaacctttcaaaccttcaaggaatggtttgtgccatttaaaccgtttggaaacgtagaaggaaagcatcttatttctctttacaaaactagcataattctgaaaaatatcacactcaataaagctgtagtctaatgttacttattaatatacatacaaaaattctttaaaaaaattgatacaagataattatacatatttatagggtacatagtgatgttctgtatatgtgatcagatcaaagtaattaggatatccatctcaaacatttatcatttgtgttggtaacactcactatccttctagctatttgaaactgtatattattgttaactgtagtcatcctactgtggtatagaacactagaacttattgctcctatctagatgtaattttgaatcctttaacaaatctctccctatccttctctcccctatgcttcccagcttcttgtaacctctgttggactttgtacttctatgagattaacatttttagcttctacatatgagtgagaccatgtggtgtttaactttctgtgcctggcttatttcacataatgtaatgtactccagttccatctgttttgctgggaattacaggatttcattcttttttatggctgaatagtatgccattgtgtatatacaccacattttctttatccatttatctgtggttggacacttatgttgatttttttatcttggctattgtgaatagtgctgcagtaaacatgggactgcagatgtctctttgttatactgatttctttttctttggactgaaatgccaagtagtggaattgctagatcacgtggtagttcctatatgcagctttctgaggaacctccatactgctctccatagtgactatactagtttacattcccaccaacattataaaaagtcttaataaaatgtttgcagctagaactgagcagtatattaaaagaataatataccatgactaagatattttagtaatgcaaaaaataattcagtgttaggaatccttaaaaattaaatgttaccatatcactaaaccaaaggagaaaagccatgtggtcagctctgtaggtgccaaggagatgtttgttaattttttaagaaagaatataagaatacttcctaagtatagcaaaatactatacacacatgtgcgtataatatgtcactctgtatcttagaccaatgactagaatcacgattaaaggtaaaaaaaatttttaagttgttggcctagactttctaaggcccctttagctctttacattctattagtctgatagagctatttgcaaatatgtcatgtgttggcagacattatgtcattttgaacctgataccaactccgaaagaaaggaaacaggtgttattctcattttgcttgcgcaaggtcacatgacagtaagtagcaaaaccagaattttgactctagattcattcctttttttaactctaaaaagttatttcctacaaggcagcgtgctataatgttgtgatcctcaaattttggtgtgtatctgaattactttggatgcttgctttaaaatgcattatcttgggttttaccttcagtctaattgagtaggattagggcgatccaaaatttgcatttttaccatgtcttctgctaaaggtgattcactgaggacacattaagtgcatgcaaacaacagatgttgtaaacagatgtggtgttgagcaaatatagagacaaataaaagtagatttgaatactacttcctcctactgaactatttgtaaaatcttagcagtcaagtgatgaatggtacataggcaataaagcatactgggtgagagtgtgggctttggatcaatgaatcttgggcatgttgcctgatgataatggtactcacttcataaggaggttttaaggacatatgtgtaagttttcatagagaggaatgagaaagcagagcagagacagtcaagtgttagttatacttcagtggaagtctcaatacaggtacatgcgtgcgcacacccacaaagcacatcaagaaaggggacccaggagttccccaccaacaaaaagattttgtttctcccatcagcttttattctgctgaaagtcattagagactattgaaattttttatttttaattatatctcaaagtggattgatactgcagttggtgaagtagattccacagtaaatatgtgagtaggtgtttcagaagtactgactttgattttttggtagcatttgagataatacaggttttactctacttctaaaaatattttatttaaaagaaaaatgaaatgaaggtttatataaaaaggcatcacagttttggactgttttactctgatatttagaattgtttcagatggattttttagatctgatatgttttactggtgtagaatattggcaggctgtatgaagaaaacgtggaagagattttggctttccttctctctgtgcctatctcctattatatttcttctcactccctttttaggtttgttaactaaccataatatggaatacatattgttatttctcacatttctagaatacatctttgtgatctgcatttattttatattcaattctgattactatattctgtattatagctgcttaaagatgtactccaatcttatttccatttttaaatgactataattttagcttatgtttatcacttttttcagttcaattaagaaaaaagtttctgcccatatgtatgtactacctgaagctttcataaaatgagcacttgagacactgtgtaaaatgtatagaatcctggccaggcatggtaactgacacctgtaatctcagcattttgggatgccaagttgggaggatcacttaaggcctggagttcgagactagcttgggcaacatagtgagacctcatctctaaaaaattattttttaattaggcaagtgtcgtggtacacacctgtatttctagctacttgggaggctgaggcaggaggatcacttgagcccaggagttcaaagttacagtgagttattattgtaccaatgtactcctgcgtgggcaacagattgagaccctgtgtctttaaaaaaaaaaaaaaaaggattatagtatccttatatttcttttaaagtggttatagttgttagcatttcatttagttaaataaatgaaattgtgtcttttccaggagagaaggcagaaacacatagtttatctgctccagaattgttatttggttatagaacaaaaggagtggggaaaagcagaaatagatattttttaatgtaaaaacaccaaacttctatttaactcatgaattaaagaggaaaccagccagttgtcactactggttcaaaggagaggcaatatattttccacatgatggttagttaacaaacctttactgtggagtaaaggaatgctgatatccatttacaaatggacacaaaatttgctttttctactggaggtggggtgtggtggaggagtagagggtaagatggaatctgttggacctccgtcagacagaatttatttgtgtgcctatagacagaattattggcatttatccacaatttatacagaattataaaataactccaagaccagaaaaggcacaaactccatagaaacataacctagaaaggtatggtgtaaacaatgcataattttccattttagtgcatagtaattatttttgcttattccaaagtcttaacttttccttacagcaataacctactacaagaatgtttccaaggctgttgatcaaatgtgtaacagaaagggatttttaaaaataagcctagacacacatacataagaaagatattggaagaggttctgatgatctgatctgggaaggggtatctgatacagcagaagaaaagttgctaaactctgtcaagaaaggaagtcctaaatggtgtcattgatgcttttataatcactgaagaggtaactttgttattgaggagccagtaaataaggatctatatggataataaattgaatataaatagtttaataatcaaattactttcttgattacatcagtcacatccagttttattcaacaaacatttacaaaacatcttcaatgtatcaggcactactagatgctaggcatacatagatgaacaaaacatatcttgcctttaaaacctcctcttggagctcacggtttggtaagggaaatagactaattacaatagaacatggaagtgcaataatactatattatcagtattgtatagggtataaggtggtttcaaagaggaagtggttaactcagtgaaggttttgaggaacagtcaagttctgtggtttttttttaattaaacattttgttttgagataattgtagaatcacatgcatggcaagaagtaatgcagagagatcccatataccctttgcatagtttccccagtggtaacactttacaaacatagtataatatcacagccagaatattgacattcatacagtcaagatacagaacatttccatcaccacaaggatcccccctgttgccttttttgcacagtattcccccgaccctatccataccttcactttctgcagttttacttatcggtggtcaaccacagtctgaaaactttatgctattttgagagagaaagagaccacagtcacataactcttatggttttcgttttgttttttgagacagggtctcactctgtcacccaggcaggagtgcaatggtgtaatctcagctcactgcagccttgacctcttgggctcatgcagccctctcacctcagcctcctgagtagctaggactacaggtgtgcgccaccacactggtttaattttgtttattttttgtaaaggtgaggtctccaactcctggactgaagcaatcctctcacttcggcctcccaaaatgttgggattacaggcgtgagccaccacgtccagccttccacataacttattacagtatattatgattgttctgctttattattattgctagtctcttgctgtgcttaatttatagattaaactttatcatagcagtactatccatggtttcaggcaccaactgggggttttggaatgtatcccccacagattgcaatggtgcaatctcagcttactgcagcctccacccgttgggttcaagcacttctcatgcctcagcctcccaagtagctggaattacaggcgcacaccaagcccagttaatttttgtatttttaggagagacgggtattcgccacgttagccaagctggtcttgaactcctgacctcaagttttccacccgcctcggcctcccaaattactgggattataggcatgagccactgccactgcgcctggcttcttttcattttttaaattcaacctattttctttcttgttcaggttaggaaatttctattctatctttcagttgccagttctttcctctgtcccttctattattctgttaacagtgagttttatttcagttattgtatttttggcttctaatatttctatttggttcttctttgtgtttcctgtatctttggtgagactgtttctttgctaaggcatttttatcatagctgctgtgagatctttgtccagtaattccaacatctctatcatctcagttttgacatctttgattgtcttttcattaagtttgagatcttccttgttctttgtatgactagtgatttttttaattgaaaactggacagtttgggtattttgttattagactatagacacacacacacacacacacacacacacacacacacacacaccctacctcttaattatcctttggattgagaacatttcctgcttttgcatggtattgctagctgctaactgagagctttggcagccttaccttctgtggcacaaataatagtgcattcatgtggtttttttttttttttttttgtattttgttgtattttgttcgtttttcttgaaatcagtgggaattatctgtggtgatattacacacaatttttttaatgtctcataagtgtaatacagttaaaacagctataggaatcattaggcatgcagaaagcagcaacttttaaacatcattgtgacactcattgaattaaaagcagctgtgttttgttgtaaaggaaaaaaatgatgtctacaaaatgttagaacaatgccgttaaaggttgtatctaaaaggcaaggaaagtttaataggggttttgctttatctatttttagctctcaggaacttatcctcatataagtctgttgcttaactttttcacattcaacttattaacaaaagaccatgagattggcagaggaagcaaaaggaaagctttatttcctgtaaaggattacaatctgcaggtcaggaaactaagcttccagccaaaaccaaatacataggcttcagttacaaaggggagaggttggaatttatccccagtggggttagctccgcatacatatttagcaggttataggagaatttatgaatatttatgagggaaaccaaatgtgtggtgagtaaacatatatgttacatatgtcccatgttcacttcggagtaggcagttaacattaaagtgaagtgaaattcggctctttgtgtcaaaaggtgaaacacagagcagagcacagaggcatcttgtgctcagtctctgtggaccagccagaacgagtctgtgatcagcagtcatttatcaaaaaggaatgctttgtaaggctagtcacctatcgtggcaaaagcacgataagggaggggagtttggccacagtgtcagatggtctgttgaggttggggaagaaatcttgcacacattgtttttagggactggtttctgtttaattataggaaagaaagtcttggcggctgataatgagataagggaatgtggaggtgtgactgacctcctgcctttgtcaaagccttagaatctggttttaaagttttctgtttgccacagctgtccatttcattttgcctggagggcctaggagctacaaacttaataggtgttttcagggacacattatatgtgtaggctgcccagagactatgttgcctttcccaagtatttgttggaaggtaaagcattgtgcagaaaatacaaaaatgagtgaaacatagcctcaattcagtttggcaaatattaattaagcccctactatgtccagcatggtacatgggccctagaaaaatgctgatgtgagatctttctgtgaaagacattacaatttaatggaaaagacaaatatatattcaatttgctctactctaaagttaaattcttttcacaatgctagatagaatacaatattacaggaaagaaaaaaattgtgtatatacagaatgaaagacagtataagcacaagcaaaatgttttgtgaaaagaatgtcataggaaggagagattaacttttttctaaactttaatgtattttgtcctttgttaacatattattaaattttttatctcaaaaatgttaacttgaaaaggggtttttacagctgggcacagtggctcacacctgtaatcccagcactttgggaggcccaggagggcagattatgaggtcaggagatcgagaccagcctggccaacatggtgaaacctcgtctctactaaaaatacaaaaattagccgggtgtggtggtgtgtgcctgtagtcccagctatttgggaggctgaggcagaagaatcacttaacccaggaggtagaggttgcaatgagccgagatcatgccactgctctccagcctggcgacagagtgagactgtgtctcaaaaaaaaaaaaaaagtggggggaggggggacggttttactataactttcattgcttttctcagctcctaactcagccttttcctctttattcttacagaccaccttgtctcctactagcttaagaaaattgaggctatcaggaatcattttccttcagctaccttctccctacatgcttatttaatctaaacccctttttactgtattttccccagtctaaagtaacaaggtgtccttcctcctgtgcactgctctcatttccccttgtcccaggatctagctctggcagttgtcccttgtttttcccaaatcttcaaactgtttgtcattactggctccttccttctagcctatgtacatgcttaagagtcccctactctaaaaagatttcccttacctcattaagccatctggtctagtcttttttccttttctctatcctacatctcaaaacagtaatctatctattcttattcttactgtctccattcctataaccacaataactctatagtaattaacacatatttagaaaccttgaaatgtaaacaaacatagaattagaatttaaattttttaagagataaagagaagctctgtaacatttcagagagttctcatctctttgagtctttggtattaaaaaaaaaaactggaaataaactcaaccaagtgtagtcaaacacagtgtgattccccttatagatggaagacttatctctcattgtagcctgtccttttcatagaaagagcttctaaattattttgatggttgcaaccactgtctgtgtgactccccagtctgtatccgaagctttttagttttttccagttgttttctgggcttcctccacctcgatgtttcgtaagtaccttaaagtcaacacgtcaaaaaataaactcattttttttcctaagcatgcttcaagccccatgttctctaacctagtttatggcaccatgccactcacccaggttaaaaactaggagttatttttgactgtatccttcatctcaccttcaaaatttaccaagtcctgccaattttagttcccaagtatttcttaatttttgccttacctctctgttccttaaacttatactcaattctagtcctcattgtttctcactgggctgttgccacagccatattaatacactgctttcaatctttacacctcaaactcatctccccaaagatacctagagctgcactgttgcataatttaactaccagctacatcagtctgttgagcatttgaagtgtgcctaatctaaatcgaaatgtgccgtaagtataacatacaaactggatcttgaagacttagtttgaaacaaaaaactgtgaaggatatcaattttattttgactatatattaaatgtaaaagtgataacattttaggtatagattacataaaatatattattaattttacctgtttccacctttttgaatatggttactagaaattttattattacatatactctttctccaccttcacatgaaaatgtggctggttccttgtcagtacccaagtcccaacttaagaaaccttctctgcctgaacgctgtttctgcctgaatactgtctgaaggaattttgtcttatcatcctgttctgttttcttcatggtatttttcactgtgtgaaatcatcatctttacttatatatctgatcattgtctacccctacgaaataggaggctttactgaggcaggaaatttgtctgaccattagtaaataagattcactgttgtgtacctggtacctagaataatatctggcatgtgcaggtactctttattgaatgaatggtttctattctgcttgaaatggttctctctgccccataaacttgtttaactcaagtcctttcatgattcagctcaagtagtacctccttcaggaagattttcctggctatttcccctcctggcttattgattccttttctatgcacagttccagaactgtacctatacattgtgtttttgactaaattctctctcctcttttagacttggcccttagtagttcttcagtatattctcattccctagaatgtacctagttaggttacccagtagacattcagtatttgtttgctgaatatacaagcaagcagatgtttttttggagttagtctttagtattctagttatacaataaataatgcaggttatagtatatactcagtagtaaacagttcttgaattagtaaaggaattcctatgtactatttttattataaaaacaatatagtggccgggtgtggtggctcacacctgtaatcccagcactttgataggccgaggcaggcagatcacctgaggttgggagtttgagaccagcctggccaacatggagaaaccctgtctctactaaaaatacaaaattagccgggcgtggtggcgcatgcctgcagtcccagctactcaggaagctgaggcaggagaatcgcttgaaccaggaggtggaggttgcggtgagcctagattgcaccattgcactccagtgtgggcaacaagagtgaaactccatctcaaaacaaaaacaaacaaaaaatatagcaaaattaaagtcttacttaaatcatttgtataaccaccctaataacaattattttcctcagcccactttcttccttaatcttacttccctcatctgagataaccacttctgtttttttcccataaacataattttatatacagtatgaaataagcaataatatgtgtaataacttttaaattctattttcccacactatgttagaaattttgtaatgttacttcatggttttatgaaactacttttttcgttttaaagttgagatggacttagagaagcaatgctgtctagtacaaaatgttccttagatgaggattcctcattctggttcccccatttagccttaggccctatgagttccttttttgtctcaatcattttaagaatgtgaattttctgtaaccacaaagcttggaagaggcagtctatattcaaacccaggtctcctaactttaaatctagttatctttccatttattaactatctccctcaacttcagtttccttaactataaaatgggaataataatgtctgtcttgtctgccctaaggataaagatgataatcacctgagggattaatatatgtgatctcacatgtaactaaaacacactaaagatcggggaatatctatatttgttcattttttggaggacagtattaatctgacaattcaaaggtttgatttttcttttttttggtaatagaaatagatccaggatttgctagatcctaaactcagtcataattcagtttacctttataggtttgggctttgaaaactaggtccagtctgttgtgttttcttattttatttcaaaccatttctcttttcacgtggtgccacatttttcatttttgaaatatccaccctgaaacatgattcaagttgatttccatatgtaatttttctgatttctctctttagtacttttccttctctctttttaaaaaatcattcccacattgtccctttagtattttagtccttttccttttttcttttttaatcattcacacaatggctatgggtacaaaactgtaagaaatttatttttatttttatttgttttaaattcatggataccattgccataaatatgtccaatatgaattatgctgcgaatgtggcaggcgtatactggatagaagcttagagtagaatagcaatgacttgattttctgtgattctgaatatcactaaagtgtgctaccagggttagccaagagagaataagatgtaattgcttgcctaaagtgataatatctttccaggacatctcctgaataccaatgaaggcagatgatttcagggagagaggcattcttcacttgagagatgggaaagatcaaataatggtagtaattaaaatgagaccaaaatgtagcatttgtagaccaagtgtgtgctaatcattgtttgaagaagttcatcagataaaatattacttactctgaaatattctgtaagaatatttatttaaaaggcagtaagtcctcatgtatgtttcatagaaattgcatagaaatgatatggacttctaatataaaaaattagagtgtgattcagaaaagaaagatacttttaaatggtttttaatcaaaattgtcttaatcaaaattttaaagttgtgaataaatacattcaaaaatgttgtttggaaaatgaaaagacaagccacacattaacagaaaatatttgcaggaaacctatcagaaagagaactggaatacagaataaattttaaaatttcagacaatgcaataataataagacaagaaattccccctcaaaatttttggccaaatattttaccaaatccatcaccagaaaagatacacatatgacaattaaacacataaaaagatgcctgacatcactagtcatcagaggagtaaagattaatatcacaactagatactacaaaatgtctattagagtagctaaattttttttaatgacagtatcaaatactgttgaagaagaggaggaactaaatttctcttacattgctggtgaaaatgcaaaatggtacaataactctttaaaacagtttgaaagattttcataaagttaaacatccacttaccatacaacccaacagtctcactcctatccaagggaaatgaaaacatattacataaagtcttgtgtatgaatatttgtaaagtgacttttttggaattgtcaaaaactgaaaacagtctgtatgttcatcagcaagtaaatggataaacaatttgtatacatccttacaaagtaatactatttagcaagaaaaagaaataagccactgatacatgcaacaacatggataaatctttaatatattatgttaagtgaaaacaaccaaactcaaaatgctatatactaagtggttccattttatgtgactgtctcaaaaaggcaaaactaccagaagagaacacagactggtggttgtccgtggggctacaatggagtgtgtgggaattctttggagttatggagatggtctgtaacttgattgtagtgatgggtacatgactctgcgtttgtcaaaatgagcaggatgtgactaaaaaaaaaaaaaagaaataacatgggcttgcaagagagaaacaccagatccattgtaccactgtaagaattacactctaaggataagatttacatttaaaatctaggagaaataccagaaaattagcacattgcttttagtttcattattaattcctttttcatgtaacatttttactcctcttcacaatctccttttatgtaataatttacacttgattatttcttcagtaattagtaaagaaagaaagaaaatcagctttctgtaataagactccatatcacctatactcacttgagaaatactcattttgttatctcctactaaatgtatctattactctattctcatgtccttttactagcagacaaaacaatagcttattattaggaaaattaaatgagacaatatttgtaaaatacctggcacataccttacattcagtttttttaagtgttgtaaatataaataagttccttgcctttttatctctgtgtggatcttgttttgaaaatatgaggagtgaattttactaagttgccaaatttgctttattctttgtgaaccttagtagatgaattgtagtatcttttttaatgtagccatgatgtgaattattgaatgacacttctcagctagaccctatatctgcacatagaatgaaataaatacatgtcagaacacacgaactatacctagatagtaagtaaataattttttaggcattttaagttgataatttatgacataatgttgtagtataaatattcagctcaatttgtttttaatgaagaaaaatttttgtggaaatagtttaaatgtgaaaatgtgattatatcagagctgggctattcatgagaatcacatgtggaccatttaaagaaataccaatttctttccctaccactgcctttctaagagaagcagctaaacagtgatgtgctagtatatgttcaagaaaccagctcttgggtgggagtggggataaggagcattgattcctagtgtttgctgatttccacggtgtaaatacttccactatagccaatttcaagctactaagatgataacactgaatgtggagtgaggaaaagatgtacagtagcacagcattatacagtatttccatcatgcaagtacaataaatacatccaacctcgagaataaaagcaaaaattaataaaattaaaaagtaatgaattttgagtatgtgttacctttgttttaatatagctatttataaagttatgtaagttaatttttaataatgactgagtttgacaaccagcttccagagtttctgaaaatttaacaattggcctctcataagctgatgagaactgatgttcacacaacactgaagctccaaggcaactattttttttttaactaattgattgcaagtaatttgccaaccagttgtttttctaaaatacagatctgatcctaaagcccacgaaggcgttccacagtcagacccagatgagtctttttcagcctcattttaaatcataccatttctctcacatcttctatatgtcacctacactagatgtaggtaacttgtagcttctcaaacacacctgtacttccccccaccttctcattatctgccttctcagtatcttccttcagcctcgaatgacctcaccttatctgcctgacttttgcaatactatttatttatccttctagaactaactcaaatgctgctttctcttacttcctactgttggaaacattcccatttgccttggtgctctcatagccctttgtttatacttcattttgagctcaaatttatcaatttataatgaatgaatgtttcactctctagattataaacttctaaggggtgcctttaaatcatactgtacttattaacacattaatataacctaaaagtggttaatgaacacttgcttattttaacagaaaaaaattatgaacgatgcatgatatatccttcactttctatatctttgagaaactgaccaaaatttaaacttttttgaattagatttgtacgcctttttttcctggtgatgcagaaccatattagtagttatatacctatagcacacctagagacatttcacaatggactctagagcttaccaaagaagaatttcattagatagtatatgaagcagaaatgattaaattgtataactatatttgtgaatcattattctcatttagtgtgccttataataagtattttcagcataaagccaaaggttactttatagtgttcccagcaaattaggcctttgtatcaataaacaccctctaagaaaagctaaaatatcatactttgctttgtgacttgagagaaatttgctttcatacatatccttaagggtaaaatccttatcactctgttgttttcgggcattttatctagacttaggattatctggttgccatcatgataagtatggacaacatctaagtgtatgaaggaaatgttctaaagtaaaaacaatccaagaatttcttgaagcaaatgcacattccttgttagtagtgtttcaggaatctttttcatattttgcactaggctgccacctgatggcaaaagttaaaattgcatcttttgtaacattcgacgccttcattgcaattatacagatttttatgtattcagcatagagcctccaaaacttttatacatttgtgtaagtgttatgtattcaataaatgtttgatgattgctttggacctcagggaaatcatatttattatttaacctttgttagacagtgatcttcctacgatctgtttaaagctttgctttcttatggagctattttaagaatctgttttaattagtgttattaatgaaaaattttacttaaatgtagtaattttctcttttctctttccctcttctttcttcagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagtatgtataaagagtgtgtttgtttaaaagaacaaacttaggtataccactagctaatcctgttgcagtacagacccaacctctaattatattactctaatataattagaaaaataattaacaaaaatactaattcattcggtcagcaaaaatatattagatgtttactatatgctaggtactataggaaatcaaaacaaagtaaaattctcattctcaaggaaagccataaactatgttcagataagtaaacaaattgcaatacaatgcgataaagactggaatggaagaataaataacttactgtagtttatgatttgtttttgaacatggaatgccctcagtctgaaacactctctctcgtctgctttgtaaacacctgttcctcctctttaaaagtcagtttaagtgttactttctccaagaagcctttctttatttttcctagcatagtcagctattcatcttaatctttttttaccctatataaactaccattatagcagttatcacactgtattataataatgtgcttaggtgtccatattcttcacttccaagcataattactggtctatagtagacttaatgtttctgggatgaatgaataaatacttgactaaatgaaaagtgtcatgaaaagacaaaggagaaggagtggctgactctgcttgattgcatcaagaagacttctcctttcatttatttcatctaatatttgttaaaatcaagtgccatttcaatcagaaaacatagataattctttaggaataattctttaggaattattttaggattttttctatgtattaataaaaagacaagaggggctgaattaaaaagtcaaaaaatcaaaaatatctgtactcagatattttagtaaaggataaataccatgattagaccttgaaagaaattaaacaatgaactggtaatcctgaatgtgaatgtaaattctaatcccagctctttcactaactagctatataattgtctgcaaccagactatagtggattcttgtttatgaggtaagtatgttaaactagattatctcttgatcttttcccagtctaaaattctgtgatggagagggaagtgtagattaggtcactaacattttatactctatcagcatgtcactagaaccttaaaattgtatttggaaaagtgtatggatgtgtaatattcaattggtaagtagggaaggccattttcaggtgtgaggaatggtgaattcaaagaatgatatgtagagtaacttcagatgaacaaataaaggggaaaaggggagagttgttgacagtgatcttttttacctaaactatagcaatacccccaatgtgagaaattagaatatatgaccaagatattagacatatttttataaatctaatttgaaaagaaaattaataatcagagagtagataggagctcagttaaaaatggcccttttgtgctcaccaaatatgtgtgttttatttctgtttacattgttcttgccctctgagagctataaaacatttgtttctttttttttttttttgagacagagtcttgctctgtcacccaggctagagtgcagtggcacgatctcggctcactgccagctccacctcccaggttcacaccattctcctacctcagcctcccaagtagctaggactacaggcgcccgccaccacgtccggttaattttttgtagttttagtagagacggggtttcaccgtgttagccaggatggtctcagtctcctgacctcatgatccgcctgcctcggcctcccaaaacatttgtttcttattatgataattgcttagataaattgtttgtatctttatataaatgttgatccattcccgcttttacatagttctaacatagtgatttctaggtaataaaattagtgaatataatttttcacttagtttctttgctgttacatattttcatgactctaaaaaacaaaataaatactttcctacattataatttgcaaacttataagaaagatgttctgctggatcaccacattcctttaattttaaaaaatactggccagacgtggtggctcacacctgtaatcccagcactttgggaggccaggacagaagaattgcttgagttccagaccagcctaggcatcatagtgtgagacactgactctactaaaataaaataaaataaaaataactggatatggtggcacacgcctgtagccccagctactcgggatgctgaggcaggaggatcacttgagccctggagttcaagactgcagtgggctatgttcatgccactgtactccagcctgggcgatggagcaagaccctgtcttaaaaaaaaaaacaaaaacaaaaaactaaaacaaaaggcagatagttggaataaaattcatccagcttgaaaagtgtggaatccagtggagcttcattaaaaatttagaacacaggtatatgaaccttaaaatcagttcttagggattaacagttcttaaaatcagttcttaggaatgcataatattaagcaccacatcccaggtccaggaacaatttttgtcatctttatattcacacttaatttttctgtgtctcttgacctcaaagataagtgtattcctcctgaaagacttccacatttttggtgacaccagtttccacattggtcatggtgaatagcttaagactgactctgaaaggcacatgaaattgcagttcttcagttaagcctaataataaagtgaatgtggatttacccaaaaattgcattatcactatattgcgaggaaggagagggaacagtgagccatgtgaatgtgttaaaatcctcataataatcctcattaaatttatcataatcatcagtcagtgaataatatctaaaattgagtaatcaagatataacactatacacatattagtttattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttccattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttagagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgagtttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattacttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagatgtccttcacatcccttgtaagttggattcctaggtattttattctctttgaagcaattgtgaatgggagttcactcatgatttggctctctgtttgtctgttgttggtgtgtaagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggttggccagtattttattgaggatttttgcatcaatgttcatcaaggatattggtctaaaattctccttttttggttgtgtctctgcccggctttggtatcagaatgatgctggcctcataaaatgagttagggaggattccctcttttctattgattgggatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagagtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatggagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatactctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgccccctcccccagcctcgttgccgccttgccgtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccggattattcttattacacatattagtttaatacatggaggctaagtagaagaagtagctacaaattttgaaaatgttcggtctctagggatggaaagagaaggtggccaggggactttttttttttttagaatagcattctcacaatgactagtattactttgtttaaaaattttttaagtaaaataaatattatggcttaatacatagtagttcctcttcccaaaaatttcacattctttaaatacatatatttaaagagctgatttccttgagattaataatgagcaaatctatgaattatatagttctgctctattggcaatttgtgtacttaagacttttgtgtagctaaaactggactggactcctaaatcctgggtgctagtacctgcaagtattacttgagcaccgtcttccccatgtaaaaatagaacatttcttaaattcaaccacggttgtgaaatccaagcttaatttcattcacatcaaaaagcaaggcaaaactttcttcaaatacagggtaaggcaaatggagaataaaagtacaaataacacagtgaataaatctgctaatcttttctgatattagctattaagtctactgtacctgttagaatgtaatctcaatcaatcaaggatcttaaccagcttatatttctgggccctagaagaaagcctggtatacagtatggcagtgaaatatatttgttaatgattactcaaattcagtaatacttcatactggatattataccatttaagaaaaaactaaattggtagaaatcattctaaaatataatgtgtacttccctgcaaaataaagtacaactttcctcttgagcctgtgcttattcgtaggacatgtgtgagtcttgtttgtaggacatatgctcattggtatgcctatttatgagaaatgtgatagaaaacatactcaatttctttattatttctcaggcctactactactgtgccataatagaggatgtgattctgcgctttgcttggactatccaaatctcgattacctctacaactttgttgcctcattctggggacatcattgctactgtctttgccccacttgaggttttccggtaagcaaactactgaaaagtttattaaagattctttttaacctaaaagacacccaatacttacaaattagaatttattataacttgtacttgaaaacctttaattttccaacttttctcaaatttctcctcagccttagaattggaaaaccatgttggccaggctgatctcgaactcttgacctcagttgatccacccacctcggcctcccaaagtgctgggattacaggcgtgagctactgtgcccggcccagaggttaattcttacaaagttaaaataaccattgatgatgacttaaaagcttctttagaacggggttccattgaaaggataagtggaaattgggaggtaaaatggcttaaaacagaaatcaatcattttttgcaatttggcagtctgagttattcagcccagccttctcactgaaaacaataaaaatgctagataaaatgtgtttaaatctggccaggtgcactggctcactcctgtaatcccaacactttgggaggccgaggccggtggatcacctgaggtcaggagttcaagaccaacctggccaacatggtgaaacgctgtctctgctaaaaatacaaaaattagctgggcatggtggtgggcacctgtaatcccagctactcgggaggctgaggcaggagaatcgcttgaatccaggaggcagaggttgcagtgagccaagactgcactgttgcactccaacctgggcaacaagagcaaaactccgtctcaaaaaaaaaagtgtttaaatattctaaaaaaaaatcagacaagataatccaaaatctaaatgaaaacaggagccccaagataaacagagcactaacactacctttgcactatagaaatttgccaaatctgtagactttgaaattcacttgtgactgccaattaaaatttgtatgcacctaataaaatgccttaaaattttgtaaagcaaaagctggcgttgctacaagtaaatttacaatttcagattttaacatatttccttcagtgatagataaataacgggtcagttaattaattaaacctgaatgacatacgtagagaactgcatccaactactaaatacatattcttttaaatacatgtagaacatttaccaaaattaaccttacactgtgccataaaggaagtctcaacaaattgcagggattataatcacaaaaagataactcaaaagtcccaaatgtttagaaattaagcagtacatgtctgataaccccaggtcaaaattgtaatgcaaattttaaaatattttgagtagccaggcatgatggtttatgcctgtaatcccagcattttggaaggccaaagtgggcagatcacttgaactcaggggtttgacactggcctgggcaacatggcaaaacacatctctacaaaaaatacaaaaattagctgggcatggtggtgcgcgcctgtagtcccaggtactcaggaggctgaggtgtaagggtcacttgagcctgggaggcagaggttgcagtgagtcaagatcatgccactgcactccagcctgggtgacagagcaagactccgtctcaaaaaaaaaaaaaaaaaaaatttttttttgaacagaatgtaattgaaaatgtgataaaagagaaaaatgtaaaatgcagctagggccatgcttacaaggaaatgtgtaactttacatgtatatatcagaaaagtatatagctcaggaaataagaaagatttaaaaaacagcaaatcccaaaagaaagtagaagtaaatataaagaacgtaaattaatggaacagaaaacaaacacacaatacagaaaattattaatgataaagccaaacttaatttccttaaaatgccaaatactgttgataaagtacttaagactgataaagcaaaaaagaaaaggaagtacaaattatgaatatcaaaaaacctaaagacatttatttaaagagtaagactatcttatgagcaactttatatcaataaatttaaaaatttagatgaatggacaaattactgaaaaagcagtgtgccaaaaccaataaagaagaaatagaaaatctgtattaaagaaattaaattcatgttaaaatactttgcacaaagaaaacgccaggcccaggaattctttcaaatatttgaggaagaaatattaaccaattttatacaaaactcttccagaaaaaaaaagagcataaaaggaaacactttctagtttgttctctgcagccagcataactttgatatataagcctacaatgacattttaataaaaactaatctgtctcatgtacacagttgtaaaaatcctgaatgaaatattagcatatgaattcaacaatatataaaaagggtaatacaagttaggttcgttctaggaatgtaagatttaacattcaaaaatcaatcagggccaggcacggtggttcacacctgtaatcccagcactttgggaggctgaggtgagtggatcatttgaggtcaggagttcaagaccagcctggccaacatggtgaaaccccatctctactaaaaatagaaaaattagccgggagtagtggcgcatgcctgtagtcccagctactcaggaggctgagttgggagaattgcttgaacccaggaggaagaggttgcagtgagccaagattgcaccactgtactgcagcctgggcaacagagggagaccctgtctcaaaaaaaaaaaaagaaagaaacctgtctcacttatattaacagaataaagggggaaaaagaacctctatatttgtagaaaaggccattgataaaagtcaatacctgttcatgaaaaaaatgttttctacaaaaacacaatcaagaacatatttaacagtgaaacactataaactttcccttgaaatcaggaatgagacaagtgtgtctgctgttcccacttttatttaatatcatcaaagtatagctagcgcaatgaggaaaaagaactatcataattggaaaggaaaaaataaaactataattattcactgatgacagttacacagaaaattcaaaatagtttacaaataattagatctaatgtcacagttctgaatacatggtcaacataatataaatcagtcatttttaaaaacagtcataacaactagaaaaagaacattttaaaaaccatatcattttgaatagcatcagaatatatcagatatatacctaggaataggtttaattaaagctgtgtagacgtgagaaaatcgacaagccagttctgtaatttatatgggaatatgaaaggtcaagaatggccaagactatcctgaaaagaacaaagttaaaagacttatactgtcagatatcaaaattgattatatagttacagtgagtaagacagtatatggtgttggtgaaaggatagacaatccactggaacagaatagggagtacagaaagaaatccactcgtgcataccttgatacttcttgatttatgacaaaggtggctacataacagtggaaaaagagggcctttaataaatgatattgagtcaactggatatccatatggaaaaaaatggttcccagctcctactgtatactgtgtgtgaaatcaattccaggtggattgtagaactaagtatgaagagtaaatcaatgaactctctggaagttaacataggaaagaaccctaaaggtggttttcagtgtatggtaatgtatttcatatttctggatggtaattacacagtgagtccctttatgataattaagctgtacattttttatttgcatactttatgtgtgatatacttctgttgaaatgcttatcttaaaaaaaaaaggcaaattagccaagagaaagaaggactaactttcaacagcaacagtgaaagtcagaaattattaaaatgaaatctttaatgtgctgaaagaaaataactgcttacctagactctgcccagtgtagatatctttcacaaataagacgatataaagatattttcagataggtgtataacattcgtctaagtcaagatcgacaaacactgcctgttaaaataagacagaagctggaaacggaagataaacctgagagagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccatttaaaacaaacaaaaaaaccatctttagatcagctttctctctccaactactgcccatctttctgctgtcctttatagcaaaactcttcaagaggcgtctgcacttgctgtctccactctcacttctctcccattctctttttcattcaagtatgtattcccaatactcaaactaaaccacttttgttaataatctataataataatattgtagtgcctactatgtagctgacagcgttctaagccttttacctttattaaatcctcacaacaatcttaggaagtaggtgctgttatcatgtcttttactgatgacactgaagcataggttaagtaactcatccaaggtcattacagctagcaagtggtagagccatgatttgaatctagacagtctcccagagcctgtgcttttagatcgtactgcccattttgctaaatccccttgtcagttctctgtacttatttaccttactttacttcccagcaaagcactttcttcacttgacttctcagaaactacagtctcctgtctcactagctattccttgtccactcctttactggttcttcctcctccccccaaacttttaagtgttagagtgttccaggatttaatcttctgccctcttgtctcctctagttgtattattcctaaacctattatgtgaaatactgtctttatgctatctccagccataaactttcccttgaactgcagactctcgtccacctctctactgaattctcccatatctaatgattagctctaacctaacaggaacagccctgcatctctgatcttagtaaatggtgtcacctttcccttagaccaaaaaccctaagacgactcacatcgcatgtcagtaagtcctgtcagctccatctttataaataaatcctttgtctgtctgcttctcatcacttctgttattaccacctttaagtcaccatcatctcttttctggactgctgcaacagcccttctaattggtctgtcttcagctgttcttgtctccctttgatctcttcaccattcagcaggacctttttcaaacaaatcacttcattctcctgttgttctctcattgttctccattagacctaaaatttaaactatgggttataaggccctctgtgggtgggccctcttccacccctccatcattatctcctgctattttaacctcacttattcttagcccccactgaccttgctgttgtttccaacttgcctttttatacttgccattttcctctgcctgggatgctttcctccaggatttttacatgacttgcttctttgtatcagtcaggttttcaatagctgccatgtcttcaaagaagctttccctaaccagtcttaatgatggcatactctattcccttgtcctgctttattttcttcacagtagttatcattagccgattgattgtttacttgctcattgtctgtctccaccactagaaattacaccccataagggcaaaaaggctttgagtcattctgtgcctttactgccttatggcagacattcagtaaatatttgtcaaataagttgaaagaatgagcactctaaaactgcattgcataagtccctccctttttcatagtctagtcttgtttcccttacccccccaccaccacctccccgcaacaccatctttccctattttaatattcaagcccttaattctttgtttttgtttccatgagtggaaacttgatacactgggaggtttacaggtagcagaagtatgttacaatttcataagtactttgatctaccccattttgctaaggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcagtatgtatggcttctacttctgtgaggcatatttcctttgagttttagcattgggtagcatgtaagctaaaaagctatcaggttgaaccaaatgaaattgccaatactcagccatttttcacctacaaaaaaacagtaataagcagcaattccatatgatacaacctatgactgtctaaatgagcacatagagtaaatgtcatcaatgcataacctagtaatttggcactaaagatccactgtctggaggaaaaggttgttggagagtgatttattaatacttgactcttctgtgtgttgtgtatgcaaataatttttatgttataaactttaggaatcctgccatctatgccttgaccaaatgacttaatttctgttttctgcccccatctgtaaattgaaattaatatggttcttgcttatagggaggttaagtggattatattcattattacatagaacttggaccagttccctcacagaaagagcctactaagaataaactattactatttttatcttcttattaaatacctacaacaatatttttatcagtcattgactacgtatgttgctaaaagttaccataaatgtacagtatatggtgactgcatatgaaatttagagacaatagatagcacagtagattggaatgaaggaggcttaggttgaggatgaacggttttctaaaggataagggagtgaatagactagagacacagtaaagaacataaaggtagaaatgaagtgcagaaagaaaaaccatgtgactagaattatagtaagaataattttgctgaatagatgaagtatgattgtaaaaggctgaaaatgcaaacttgatcttgtaggcaggaatgagtcacagataattttttttttttgagatggagtctcgctctgttgcccaggctggagtgcagtggtgcaatctccactcactgcaagctgcacctcctgggttcacgccattctcctgcctcagcctcccgagtagctgggactacaggcgtccgctaccacacgcagctaattttttgtgtttttggtagagatggggtttcaccatgttagccaggatggtctcgatctcctgacctcgtgatccgcccgcattggcctcccaaagtgctggcattacaggcatgagccaccgcacccagccacgagtcacagagaatttttctgtagaagaatgacattgtgaaagtagtatcctaggaagttttaatagcactgtgtaagatatattaggcaagggaaaaactgaaggccagaaagccagatgaaaagctatgcagtacttcaatgtatggggcagtgaaaattcagatcaggatgcttactgttggaccagaaggaacataaggagatgttttgaaggaagtaagaaacaggaggtagtatcagtaactcattggatatagaggagtagagtagaacctgctgaactttaaatagagatttggaagttctctgaagaaggcagagaaaagcagagagcagggaactgagtcttaatccctggctcaaccatagtagccagggaacaaacacagacaagagaaaaaaagaaaataaacaaaagaggtaggaatagtcagggaggtaataggaagagcatcaaaacaaagcatggttggtgctgtgatcccaaggaagcagagtttgaagaagctggggcaggggagcactgagtgggtcagtgagataagtgccacaaagggctggaagaaaatgctaagtgtgattggtgacctcattgagctcctgattttgaagtctaattatccttgttagttaccagcagagggcaatctaaacatatactatttctgcttaaagaaggggctctttggcaatagattattctgttccatttcaggtgtttaacggagaaactctgggaaaccagattgcaccaagagtaagacattaggaatggaacagttggtgtacagcggagagagcagggaatccaaaataagatctgagtttcagtactgactttatcactcatgcaacctttagcatatccttaatgtgtgtggtttttttgtttgtttgtttttttgaaacagtatctcgctccgttgcccaggttggctcaatgcagcagcacgatcatgactcactgcagcttcaacctcctgggttcaagcactcctcccacctcagcctcccaagtagttggcactacacgcctgcacccctctgcccagctaattttttattttttatagagacagggtcttactatgttgcccaggctagtctcaaactcctagcctgaagaagtcttccctccttggcctcccaaagtgctgggattacaggcaagagccaccacactcagccacctgattttattgttggtatttatagtggtaaatggtttatgttgggctgaaatgtgcttcactgtaatttcactataactttaacaatttgatcctatttgggctctctcacataacttataatgagtctcctccctcttctgcattgtatgttgtcaactctttgaagagaaataactgttatgcctctccttaggtcttctcttctgctggctaactcttttggtttctcatgtatgcctcaagtggtgttttatcttatcctcatcatccttatcacaatttcttatatttgttttttgggggttggttgtttttttttggagacatggtctcagtctgtcacctaggctggagtgcagtggtgtgatcataccttactgcagccttgaactcctgggctgaaatgatcctccttcctcagcttcctgagtagctggggctacaggtttgcactatcatacctggctttttttttttttttttttttttaagacagggtctcactgtgatgctcagactggtctcaaactgccgggctaaggcgatcctcttatgtcagcctcccaaggagctgggattacaggaaccagccagtttcttaagtttgtttaatgcttttttcatccatgttctcacttgatatgcatactgtctccatgaggtgaaagtggtattcagtgaaatcggtgttaccattcctgccttacagagatggaaacgggcactcaaagggttaaatagatgcatcataaaatcaaagtcaggtggccaggtgcagtgactcacacctgtaaacctaacactttgggaggccaaggcgggcagattacctgaggtcaggagtttgagaccagcctggccaacatggtgaaagcccatctctactaaaaatacaaaacttcgccaagcgtggtggcacatgcctgtaatcccagctactcaggaggctgaggcaggagaattgcttgagcctgggaaacggaggttgcagtgagctgagattatgccactgcactccagcctggcgacagagcgagactctgtctcaaaaaaaaaaaaaaaaaatcaaagtcagtactcaaacccagatcactaccttctgcgttgcacataccctgccattgttcttgttaccttcctctggttgtgatctagtttcttagtgtttttccaatagtatctgaaattgaataggaaactctagaataatccgtctggtacagcagatagtccctgtttaggatgtatgtttaatgatggtaagactggaaatgtgtctaatactgtgaaagtgtttatatttgggtaatggactaagtgctttttgtcccccttgttaccactagatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcaatgatagatgtaatccttttctgaagtgtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggc

SEQ ID NO: 13528 - DNA, 24740 bp, Human
cgacagagcaagactccaactcaaaaaaaaaaaaaaaaaaagaaaaaaaaagaaaaaagaaaaatagaatggaatattcacacaatacccatgagaattgttcctaataaatttgaaggcatcctttatgtgactttgggtcattaatttacaaaaatttgtactttatttgtatatttaggatgtatatatttaaactcaaacattcatggccattggataaggtgagaccaaatggaatctatttggagaattttactcatgttttttggacaacaattaattgtccccaggaacaatgatagcaagaggtatagcaatgaggacctgtaatgcaaaaattggagtcattactacccttaaaataaatatctattcaaaagaacactattgagtacatgccatgtggcagatgttgtgtttaggcacattatcctatttaatactcatgacaaccccattagataagtgcaattattatgatcattttacagagatattgagggagtatgtaattttccccaaatcacaaaaatctgaaagttggccaggcgtcgtggctcacgcctgtaatcccaacactttgggaggctgaggcgggcggatcacttgaggtcagtagttggagaccagcctggccaacatggtgaaaccccattcctactgaaaatacaaaaatgagccgggcgtggtggcgggcgcctgtaatcccagcttctcaggagggtgaggcacgacaatcgcttgaacccgggaggcagaggttgcagtgagccaagatcgcaccactacactgcagcctgggtgacagagtgagacacagactcaaaaaaaaaaaaaaaaaaaaatctggccgggcgcagtgcctcacacctgtaatcctagcactttgggaggctgaggagggtggatcacctgaagtcagcagttcgagaccagcatggccaacatggcgaaaccccgtctctactaaaaatacaaaaattagccggtcgtggtggcgcacacctgtaatgccagctactccggaggctgaggaaggagaattgcttgaacccgggaggtggaggttgcagtgagctgagatcgcgtcaccgctccagcctgtgcggcaggagcaagactccatctcaaaagtaaataaataaatacataaatctgaaggttctatcagacttcaaagttcctgcctcagcctacttcagcatctttatcttgtaccccacatctctacaacccaccccctactggtctcattggcctcctttctgttcctggaagtgagtcaagctttctacccacaacccccaccccactccactccaggacttgcactgtttgtttaggttttcttcagttgttgcaaggctggctccttctcatctcagatatctgttctagattaattcttcccaccatacttctcaccgtgttttaattccttcacagtatttgttaaactctgaagttttttttattattatttcctatcaaatgataagcagatctacctttaatacctcattcactgactgaatggatgaataaaactgtctacttctccagcacgtggaggtcttggacagtactgtgttataacaaaggccatctgtgttgtgtcgacaggccatcggaactcctttgaggtattacacatttcctacttcacttccatctcagtttattacagagccttttatacttccgggacagcagtgacttaatactgaggcctctcaggggaagaccgggataactgagtcctgctttacctatctcggcttgcaagaaacggtataggtggaggcctctttcagtgtatgccggcgctctaggtgaaccgagacatagaggtggaagtggagtagaaagacggggccaaccggaaggggagggctcatgggcgaacccacccctccaggcagggtttcgcccctcgccccgccccttcccccgcccggacggccatggccattcccggcatcccctatgagagacggcttctcatcatggcggaccctagagataaggcgcttcaggactaccgcaagaagttgcttgaacacaaggagatcgacggccgtcttaaggagtgtgagtgcacctttctttccatttaatcaagtgcctcgactcgcttctgcctctgacaaagcagaagcctttcgccgagcccggcaaccgagccttagagatgaccaggcctagggccagggacaaggcgctttgtcatccggccctgagcttgtggagcagcactccttcgggtgtagaaatggcccagtccagcccgggtgacagaacatcggcggccttgaggtgaaaatgaaaaagaagtagaggaggagtggggaagtgggccgaggatgtttcccaggttagggtgcaagaagggcagtgttggtggagtcccgggacttggagaggggaaggcgcttgagtcaagtaagctcaaacaagagatgagactcagggagtcggcttgttcttggagtcgaaagacggccgcggagcttaagagagaagtgttccagttgtcataataacccatatcgtcttgtgtttcgtgttgtactgtatcaggcatacaaatttcccttacctcctgagtgcttaacttttttttccagtgcattttcattgaaaagcatgagtagtttaattaaatggaggaccataattacatgattctgtggagaactgcatttgttgactttatttagggtagaatgtcagagaacaatccacgtgggtaggtgaagaggtgaggaagggtctaagtgattatcattcggatttgtagtcgcaaatcctaagtgtcagggtgtcaatatcttctaagactataacttaagatgtgcttaaacaagtattgccgatcaacaaagtaaaagtatggtgctttctctgtaacattttgttgttatacatgccacctactcattacaaacagcattatttcttttatggtttgaaacagtggatgtgaaacttaggtaaagtgaagtagacttacgtaaacagtaaagtgagacgtagcgacttaaacacactaagattactgttcaattaaaaatgttcaaattgtattatttcagtaagggaacaattaaaagaacttaccaagcagtatgaaaagtctgaaaatgatctgaaggccctacagagtgttgggcaggtaggtgatggagtttggggaatagggggtgatggtaatttgcttttttatttagctgttgccaaaaagtaatgctttttattttcttccttagatcgtgggtgaagtgcttaaacagttaactgaagaaaaatgtgagtgatgaattagcttattaattagtaaagaaacagtccacctctctctcacttttgaaatgcttattattttaatgacaataatgcagagagagagagtatttttgaatagacttaagttttccttcaactaatgtctccttggaggacagaaatacaactaaaccctctgtcaacgtgggtatgtatttttttactttctatttttcaattagttcttttatgttttttcttctagtcattgttaaagctaccaatggaccaagatatgttgtgggttgtcgtcgacaggtaatactttatatttgtatagtgcctgatgattgacaaagcagtttcatgtaagttattgtctctaattcttgaggcaagcaggtggagcatttatgcccataactcacaaggatgatttgttcagacatagctagttattaacaaagcctgaattcaaaccatgggctttgactcctggcattccgtactttctactgtattacattgtctcagtcagatctgttaatagccacttagaaataaaagtattttagaactggaaaacagacattttattttaatgtcatttttaaagaggacttaaaagtgttagatatcatcagttacctgtgtttatatttagacattcagaactgttacttatggactgtaccatggcctaagttaattttgtatgaggtcatttagattagggtagggcaagttgaaataattctaaattttattttacagttatcaaagatgccaacaaatgacctcaagtcattcagtagtgtctgaaatcaatttatgtattattctttaggaagtgtccttagataattcttttaaattcattggaagagttttctctgtttaattgtcatttcaggttcaggttttaaaacattcacagaacatggctgtaagggagaatttaatccaggaactataaatctcctattaggattttgcctagtatataagcggttgacattttctaagtcaaaatattagatacctaaactgacaagggattttcatgtccctttcagggctctgtggatgccgaaagttggcatttctaagatatttcaggttgcatgaggacaagactgtatttgaagactaaaaaacattagaaaagccgaagtatatataagttgagtatcccttatccaaaatgcttgagccagaaatgtgttttagattttggctttttttttttcaggttttagaatatttgtgttgtactggttgagcatccctaattaaaaaaaatcaaaagtttgaaatgctccgatgagcattttctttgagcatcatgtcagcattcaaaaaatttcacattgtggagcattttggattttcagattaagaatactcagcctgtatttcctatagatgtaaacattgaaatagcttcatattgatttctcctcttattttttcaagtaacctcacttcttagccgttttttccttaattgttatattaatcctagtgttttgcctatcttcctaaatttgaagctctttgtaaaatcctgtgacaagtggtcagtaatttatatgattccgaaattgtattggcacgcagttttttaaactattaaaaagtaacttgggtcgggcggggtggctcatgcctgtaatcccagcactttgggaggctgaggtgggcagatcacgaggtcaggagatcaagaccagcctgaccaacatggtgaaaccccgtctttactaaaaaatacaaaaaaaaattagccgggcatggtggcacacacctgtaatcccagctacttgaggctgaggcaggagaattgcctaaaccagggaggcagaggttgctgtgagccaagatggcgccactgcactccagcctgggcgacagagtgagactccgtactccatctcaaaaaaaaaagtaactttatctttgaaaagtaacaacatcctgagagtgaggcagatctagtagattctaattttagccagataagccaagaaattatttagtatgattcaacctaatgtgtaatgtgttcagcatgtgcctgtcatgtagcaaaggcatgagtgatggttgctgggttttggggctttaaatttaaagcattttaataaaaatctctaaggggaaaccgtgcatttttctctactctcatgagcatttaacacattcttcccagaagctgtacatttcaaaataaatctgatgagcacacctttaaaatgcttccctttcctttccctaaaatgttcactaagggatttttctataaatgctttggtagcaattcccaaagtcactgtaccattgctgcctcaagctttgtgtgttagtcatttcacattttacactgagattacacaaaggggcatgcttttaaggagcaggtggaaatcactttgaattacttattttataagccattttgttagcatagagtttataatctgatatttgtgttctctctggagggtaaaaatgagtgttattccgtttttaagtgttgatgtaatatcttttgttttacaaaactagcttgacaaaagtaagctgaagccaggaacaagagttgctttggatatgactacactaactatcatgaggtgggtttcttattctatttagttcaccttttattttcacaaagggtggtttttatctgagatatatgcttcttgagatcactgaatattttggcactttttcccttttactagtttctaattaagcacatctttatgagatcagctacaggtgcttgcttgagcaagttatttatatgctatctgtaggctaagagaaaatatatctttcaaaagaaaaatacataccttttcattctagatatttgccgagagaggtggatccactggtttataacatgtctcatgaggaccctgggaatgtttcttattctgagattggagggctatcagaacagatccgggaattaagagaggttggtactgtgtgccttgttctctgaacttagctaataaatactactagttttaggattcttaacaggagaaacaggatgaaaaagtactttttgtctaaatggtagttaagaatattatgtatttactattcttgctaagaagaatagcactgaatttctagctgtgaaaattactgtttttttttatttggagataatttggtgttagaaaaatcctgctctttttgtggcaaaggaacggagaaaaagctaaaaataattgatgtaatctgatatcctgtggttttgattatcataataagttacttgggtcagagcatatttggataatgtgtgtgatgagttttttccataacctcattaatactagcttcccactcttacagaagagtagggtacctgttccttaaatattttattttgttaaagctgtttgctgccattccagaaaaccactggctttaggattgtcttaaatcttgtaagcttttaggtgaacaatcaaatcaggattgccttacttcatagcacagacagcttcttaactgttatctgtaaagcaaattacattgtcctatggattttatcctaaattaggctgtgaatatttaggaattaatgggaataattggaatgtcttacacaatctgatttaagctttaagccagttctcatacttcagtacattaattttttttggaacacttattaaaaatacacattactaggccctctgagtggttttgatggactagattgggggtaggcacaggaattagcatttaaacaagcattccaagtgattatgaaaccaaatttttctttgacaatacttgaggaagcactggtctaagtgtaaaaaaaaaaggcagttctcacctgtattaatgaaagggcaacagaggaagaacaggtgcttcataaaacggtgaaaacttgctttcaacagtgatttgctgcattagccataggagcagaaagaatcccatgtatacatgcagtatcctttactgtctgcagatactttacactttagagtattgatttctctcacttctggcttttcccagtcacgctttatgcacatatggacacaacttttttttttcttttgagacagggtctggttcttttgcccaggctggaatgcagtggtgcagtctcagctcactgcaacctctacctcccaggctgaagtcatcctctcacctcaccctcccaagtagctgaaggcatgcgccaccacatgtgactaatttttttattttttgtagagatggggtttcaccatgttgtccaggctcttctcgaactcctgaactcaagccatcctccagccttggcctcccaaagtgttgggatttacaggcgtgagccaccgcacctagcccaacacaactattcaatagaaatttctctctcggtcaggcatggtggctcacgcctgtaatcccagcactctgggaggctgaggtgggtggatcatctgaggtcaggagttcaagaccagcctgccaatacagtgaaaccccatctcttctaaaagtacaaaaattagccaggtgtggtggtggcgcctgtagtcccagctactcaggaggctgagacaggagaatctcttgtacccgggaggcagaggttgcaatgagccaagatcatgccattgcactccagcctgggcaacagactctgtctcaaaaaaaaagaaatttctctcttaagttactggtactataagtaatttaaattggactttcagatcttcaatttctctagtctctacttttcttccttgaatcagtcttgagagcagaacatactgttctttaaaagctgccgtggcaaaatgccaacagataaaaattgtatataccttttctcttggtatgttgtcaaatccatcccccattttagaattattttgtgttgtattttcaaatgcaaactagtatagatcttttgagttgtgttttttgtttatatgttcatttgacttaactgatttttttgtggtataatttttcattgaggtataattacattaaaaaaatgtagattcttaagtgtacatttcaaatatgtttggacaagttatatatctgtgtaaccatcaccccaatcaagtgtgtggtttatttaaaaaacattatttgaaattttttagatttaagagatcttaaatctacctggagcaaaacctcttaatataaatggttttacctagcatggaagtctaggtctattaagaattatgatgtgtacacctaactaaggtgatatttgacttagagtatttgaaagtacattaaaaatcttgactaactttttaagaaagatttaacttcttttctaggtgatagaattacctcttacaaacccagagttatttcagcgtgtaggaataatacctccaaaaggctgtttgttatatggaccaccaggttggtattgaattatttctactccaccaataagataaatgaattaaggaattaaaaaaaaaaagacaatttttttatttttatttttttgagacacggtctcactctgttgcccaggctgtagtgcagtggcacaatctgggctaactgcaacctctgccttccgggctcaagtgattctcccacctcagtctcccacgtagctgggactgcaggcgtgcatcaccatgtctggttaatttttgtatgttttgtagagaagcaattttgccatattgctcaggctatctcaaactcctggactcaagcgatctgcccaccttagcctcccaaaatgttgggattacaagcataaaccactgcgcctggccataaggtggaaatttgatgtgggcagttccaacttctcctctcttcagagtgagaatgagataggatatttatgtctactgttctttgaggcatgcttagtgcatttgtgcctcacagtacatttatcttaacaggccatgtgattctagtgcaacagtcctcaaattgtggttcacagacccagaggtgctttcatggactctgtaaggtcaaaactactttataatactgaaatgttaagccaggcgcagtggctcacacctgtaatcccagcacttcgggaggccgaggcaggcagatcaccagaggtcaggagtttgagagcagcctggccaaccaacatgatgaaaccctgtctctactaaaaatacaaaaatgagccaggcgtggtggcgtgcacctgtaatcccagctactcgggaagctgaggcaggagaattgcttgaacctgggaggcagaggttgcagtgagccgagattgccccactgcactccagcctggctgacagagtgagactccttctcaaaaaaaaaaaaaaaaaaaaaaaaattttttatataaagcaaatgtacctatagcatactgcttgacatatgtagccccacaatgacacaaaacaaaaaactaaaatgttgtttggctcttccactgtgttgacatttgtgctgatggtgcaagagcaccatgggtaaaattaaattacttgcactgtagtgtgaatcagcattagtggcatgaaacggtgctagttagtagccattgcgttcttgactgccacatacttgcagtgtaaaaaaaaaaaaagtcagtttcactataaagtccttggtgaaacagtaaaaattattaattttgttaaatcttcatctttgggtaatattttgtgttcttcatgataaaagggaaaataaatataaagtactgctgcatattgaataagatagttgtctttaggaaaagcacttgtgcagttatttaagttgccagctgaattcattgctttttatggaatactatttttgcttgaatggaccatttacagatatgctgtgattatcagactggttattggttattagttattgattactcaagactggtttttggttatttggcgcacattttttccaaagcgaacaaattaagcctgtcatgttaaacaactgacaccatctattgccattgataaaatatgaaatgtcaagtgaaaattagaatttttagaaacatatatctggcactatgtggttgaagctttttctttttttcttttcttttcttttttttttttttgataaggtgttactctgttacccaggctggagtgcagtggcgtgatcatcctggctcgctgcaacttctgcctcttgggctcaggtgattcttccacctcagcctcctgagtagctggtactacaggtgtgtgccaccatgccaggctaatttttgtgtttttagtagaggcagggttttgccatgttgcccaggctggtcttgaattcctgggctcaagcaacccgcccacctcagcctcccaaagtgctgggattacaggcatgagccacaatgtccagccacggcagctttctaatatattaatacttaaagacttttctgatgagataagtggtgagaataacaaaaattttttataatgtgtggtggaaaatgtcaacatttggaagatttgcataactcaaccagtagtttccaaataatcaatgcttgatattaaaatattcataagtaaaagatccagtcagtgcacaggatagaccaatgtattttaatgtaacagaagtttctgtcatagtccatgttgtaagtagatagctattataaaaaagacaaaagtgtttgcaagatgtagagaaaagagaaagaacccttgtacactactggtgggaatgtaaattagcacagccatttttgaaaacatggaggttcctcaaaaaactaaaaatagaattaccatatgattcagcaatcccacttctgggtttatatctaaaggaattgaaatcagtgtgtcagagatagctgcactcccatgattatttcacaatagccaagatatagaaacagcctaaaaattgcccatcaatggatgaatggataaagaaaatgtggtagccgggtgcagtggctcatacctgtagtgccaacactttgggaggccgaggcgggcggatcacctgaggtcgggagttcgagaccagcctgaccaacatggagaaaccccgtctctgctgaaaatacaaaattagctgggtgtagtagttcatgcctgtaatcccagctactcgggaggcagaggcaggagaatcacttgaacctgggaggcagaggttgcagtgagctgagatcatgccattgcactccagcctgggcaacaagagtgaaactccatctcaaaaaaaaaagaaaaagaaatgtggtaaatacacacattggaatactattcagccttaaaaaaggaaactctgtcatttgtgacaatatggatgaatctagaggatgttatactaagtgaaataagccagacacagaaagacagttaccacataatctcattttcatgtggaatcttaaaaaattgaactcgtagaaaccaagagtagaatggtggttaccagaagttgtggtggtgtatggggataggggagatgttggtcaaaggatataaagttcacttagacaggaggaataagttctaggtgacatattgcatagcatggtgactataattaataatgtattagctatttcaaaattgctaaaagtagattttaaatgttctaaccacaaagtaatgctaagcatgtgaggcgatggatatgttgatttgcctgatttaatcattcttcaatatatacatgtatcataatttaacccataaatatacaatttatttgtcaatttaaaatagattttaaaaattataacattttgattaaaattttaatgttgacagcagaagtactttggaatttttttttttttttttttttttgagacagagtcttgctctgtcacccaggctggagtgcagtggcgagattataagctcactgcaacccccacctcccggattcaagcgattctcctgcctcagcctccccagtaggtgggactacaggcatgtgccaccacgctcagctaattttttgtatttttagtagagacggggtttcactgtgtttcgatctcctgaccctgtgatctgcccgcctcagcctcccaaagtgctgggattacaggtgtgagccaccacacctggccaagtactttggaattttaaatgaaaattctatttaggatttagctttcattttggaaaatttacttgccaaacgattatattcttaaaaggattttaaaaatttgtttcacataggccgggtgcggtggctcctgcctgtaatcccagcactttgggaggctgaagtggcaggatcacctgagcccaagagttcaagaccagcctgcgcaacacagagagaccccgtctctgaaaaacaaacagacaaacaaaaaacttagctgtgcgtgatggcacatgcctgtcatcccagctacttgggaggctgaggtgggaaaatcgcttaggtctgggaggtcaaggttgcagtgagctgtgatctcgccacactccagcctaggtgacagagtgattgcctgtctcaaaacaaatttttttctaccttaccatctaattaagacttcttttgtcattcttaggtacgggaaaaacactcttggcacgagccgttgctagccagctggactgcaatttcttaaaggtaaagggaagattattttgtacttattgaaatttaattttacttgaattatcttatatttaccttactgtttttcctttaatcaggttgtatctagttctattgtagacaagtacattggtgaaagtgctcgtttgatcagagaaatgtttaattatgctagagatcatcaaccatgcatcatttttatggatgaaatagatgctattggtaagaataacacccttgttgaaagttttaggacttttttttaaatgtaaaagaacctttttccctctcttaatctgtaattgtgacttgtatgaagtagataccacaatgaatcagatgttagtttaaccaattttaataaataacctttcatggccgggtgtggtggctcatgcctgtaatcccagcactttgagaggccaaggtgggcagatcaccaggtcaggagatcgagaccatctggccaacatggtgaaaccctgtctctactaaaaatacaaaaattagctggatgtggtggcacatgcctgtaatcccagctactgaggaggctgaggcacgagaatcgcttgaacccaggagacgtaggttgcagtgagccgagatcacaccactgcactccagcctggcgacagagcgagactccgtctcaataaataacctttcactttaacaaaatgagaaatgttacaccaaaatcaagtctaactttgtcagcataattcttgctctttaattttcatcttaatgttttaagccacagactgttatgttctgttttcttaaatgatggttgtagaggaaaagagtaatgcatataaatttccaaatctactatcttaggtggtcgtcggttttctgagggtacttcagctgacagagagattcagagaacgttaatggaggtaatatttggtaaagggggtttataaagaaaccaatgtttattaaatgaagaactgaacattgcatatttgatagtcaaaatatatagaacattttaaatgaaatatgaaatttgaaaatattgtcaggaacaaacatgtttctctatcacaaactctaagaaaatgactactggaaaataaggctatctgccaaattccatttggtatacacctgtactattctgtgtttttttgagtagatcagtcattcatatatttaaattcttatgaatgtgatcttgcggtagttttatgaagacattttttgtaatggtcatattaagactgttggcaataaatgagctataattatgtatgaagctgctctaaaaattatttttttctctcactttattgctgagactgaggcaactaaaatagttttgataattgaagaggatagatgacagaatgaaagaatgcacataaagccttcctccagttttacctttccccactccaaattctgtgaaagtgatatcaagagtccaaatacattttccacttcaaatagaaactaggtagcatgggtaatgcagtgtcaaattctttctccttagaagtatttgaaaaatcttttttcataaattatacagatccgctcagaagataacatagcatttggaaattataaaatctcttagaaaccttaaattgagatatttttaaataacacaaatactcattttattcaagtaactaatatatcatcaactaacacattgtcagactagctatattttagagagtttgttaaatgcagtaaggtttttcatttattcaagaaaactttagaaattgaggacaatattttttatgtcttttagtatttctgtgtacagtagaattatttgaaaaaataggccaggcatggtggcttctgcctgtaatcccagcactttgggaggcccagctgggcagatcatgaggtctgagcattgagaccagcctgaccaacgtagcgaaacaccatctctagtaaagatacaaaaattagctgggcgtggtggcgtgtgcctgtaatcccagttactcaggaggctgaggcaggagaattgcttgaacccaggaggtgaggttgcagtgggctgagatcgccccattgcactccagcctgggtgacagagcgagagtctgtctccaaaaaaaaaaaaaaaaaaaaaagcagtcccagctactcaggaggttgaggtgggaggactggtcgagcccaggaggtgaaggttgcagtgagcgatgatcaggccacagtactccagcctgggtgacagagtgaaactctgtctcaaaaaaaaaaaaaaaaaaaaaaaaaaaaaattatcagtttattatcaaatttgtagaaaaatctttgtatccatttatcctaatataaatgttatgtctgacatatcataagcactttatatattggattttattattagcttttcctttaaaaaataattgatgaaattttggacattggaaattagatccacatagtttaatttcataattcttgacatgatggaagccttcagatttattaaaactacctggtagctatagaaagatacatagctattaaaaggtacataatctagcttagaactttgaggctagaaagtatatccctttatataagagagagaaaaagaattctatcaaatgaccattctgaagatagaacatatctatctgtagacaatacatttcatggcattagacatataaaaggtgtgtgctattttttttaatggttagaatttttgtaaaatctgattcttaatattcttagttactgaatcaaatggatggatttgatactctgcatagagttaaaatgatcatggctacaaacagaccagatacactggatcctgctttgctgcgtccaggaagattagatagaaaaatacgtgagttaagattctttacctactgtccatttccctttgtgcccatttctttttccatacttcacttcaccttccactgtattttaaaaaagataaaactggactataaaataattttttattttcagatattgatttgccaaatgaacaagcaagattagacatactgaaaatccatgcaggtcccattacaaagcatggtgaaataggtaaggaagtcatctattttatatgtatttacatttggtaaatgaagaaaaatacttttagaaattactgatagtttcctaaatctggttttaaattcagcaaatgtggtggttttaaattcagcaaatagttattgagcatctactataagctaggaaccattgtaagtgttttgtaagggctgacaatatagcaaggaacaaaacagacaaatttctgccattagagaacttatattcttgttaggaaaaaacagataaagttagtaaaacaaagtataatagatgatgataagtgctatggagaaaaataaagcaagaaagtggggggcgggcatggtggctcactcctgtaatcctaatggttttggaggccgaggcagaaggaccgcttgaggccaggagtttgaggttgcagggagctatgatcatgtgactgcactccagtttggcaagacgctgtttcaggggaaaaaaaaagaaaagggggataggaaattagggaagtgccaggaccaggcatgaggatatgtttttaaatgacagggaggattagcacagggaaggccttaccaagaaggtaatttattttttagagacagggtctcactcttgcccaggctggagtgcaatggtgtgatcccagctcactgcaacttctgcctcccaagttcaaatgatcctcacacctcagcctcctgattagctgggactacaggcacacaccaccaaccctggcttgtttttttgtagggatggggtttcaccatgttgcccaggctgatcttgaactactgggctcaagcaatctgcccacctcggccacccaaagttctgggataacaggcgtgtgccactgcacccggcctggttgtttgtttgtttgttttttaaattgattcctgttaaatgctgacaataggtcagataaagagttctcagagtagacctttggatttaactatatggaggtcattggtaatcttgtcaaaagtagcttcttgggagtggtggaggtgaaagcctatttcagatgggtttcagagagattgggaggagaggcattgagtttagacatttcttttaagagttctacagagggggcagaagaagtagaaggggaatgccgatgaggagttggcagagttttctataagatggaagagtttatgacccccctgcccttttttttttttttttaataatgctactgggaatgacctaggagaaagagaaattggcaatgttctttccttgaagagggattggccctatatatatgtgtacttttatgagactggaggaaaggcagagtacatagatgcttatgatgacaggttcttagatagtgcaggaacttgtggaagtgtttttttctgaatgcttctgttttctcagtgaagtagaatgcacgttcagaatgaagatagggaagtgttcttagagatttgaggacaaaggagaaggtataaagtcattatctatggaagtgagggattggactagggtgcaggccagtaaaacatggcttgtgaaccaaattctgcctgccctgtgtttttggaaacacacaaagttttgttgtaacccaagcatgctcatttatctgttgtctatggctgctttcctactggaatagctgagttgaatagttacaacagaaaccatatggcttgcaaagcatacagtatttactctctggccctttacataaaaagtttgctgacctccagactagggaaatctagtataatttccaggcagccttaaaaactctttagaagttaatggtccagaataatgacaaatagctgattgttgaatttcactatcttcattgcccctgttagagagttttgagctggaaagaccgaactgaacaaaggatgtcaatgtataggtttcttccacaaatactgagctcttgctagatgccagatactgtgctagccttgggaattcttgctctcaggaagcttacaatgaacttaaacctgattaaagacaattcatgaatatatgtgtgatttcaaatagagaacgacatgccctatattgcctgaccaaacggtgcatcatcaaagttattcaaactgtagtagcctgtgctgtcttacttctcttcctattctgtatcagatccattgttgctaccccaatcctatagctctttgattcatgtctgttatgtgggtggatggagaactcactttattactgctaccatagatctgatacttcaccacttgaatcttgcacagaaaccagagaagctagctaatgcatgctgtagcatttaaaaattccatgtgatacaattatgtatgattacatttcagttttgctatactttatatttggcttgtatgattaaagtaaacaaagtaaattccattgttataattggttttgagtgttataggtttattcaaatccaagatttgattacagttttgataagagtcacagcttaacaggtatctggagttcacatgtgcatagctatttcactgtataaaaatagattaagatattttgagattttggtgatatttcctgtttttaaagtttcaggggtgtgtctaattcttcttggtgctggtttatttaacagaagtcttagtttttggatattaatattgtggaaagttaacagagctgatgtctagctgatcaaactcaaagtaagctcttcagtttaaattttcgatgtgggcataaatcaagtaaaggtctaatttttaaaactaatttccagtattttttctaaacagattatgaagcaattgtgaagctttcggatggctttaatggagcagatctgagaaatgtttgtactgaagcaggtaagggtttaaagtacagttttactattgattttgatttttaaaatttgctgaaactgttttgagtttatctgaaagcggagcatagactttgcaaggatttgggttcatgctgttcttttaggaatcgattccaggaaataggagaagcagggcaagtgagatggaaagagggaaagctaatatgagggtgcaccattgaggtaggtgctgtaggaaagggaggttagatctcagagaagcatacagaatgccttccaggatcacccagctgaaagttgggagactagaacattgatttaccagtactcatcccccattggatgagatttgtccttggtagtgttgactcctttgcacttctacctgccttagggcagaatgtggaaggagaggcatgtaatagaacactggccccctaaagtaagtctgaggtgctacagaattgcctaccacacctgtggctggaattagaatgggccagcaccagaggtatctgctgcaaaatgaattgtgtatgttgtctaatactagtctgtgagcagtgttttgaaagattgatttatgaattatgtgatcatgccatttgtgtaaaatgtagtatttaaatataattctctgtggattgtgtgatactatttttttcacttctacatggtatgtaaaaattgtgtgatgctatttttatttccagtaccaagtagctttaataccctacctagaatcatttagtttttgtcttccatacagaatctttaaatagaaaaaataaacttctacagtatagttactgactttataggttatagattttcttaagtattagaatatgtgatttcctcttgcttttcatatcatgtttagccttagtaaattcaacacagtgtttaaagtggctgctcagggagggcttctcagtacaggtatcttcatgggtattgggtatgctgtgagtcagtatctgcatcagatatgcaggtcagatacttctgttcacgtctagaaatgctgtcaatgcaaattagggtaaatcatgctcacagagcgttatcaataaactaaactatttagaggtaaactgtcatatagcttgaacaagttagagtaatttatgacattctctttccaaaatgtaaaccagaccaaattattatcagaagattgctttggttagattgtaatccaaatgcaagctgtgcagtgaacctaaaggctgttgctatcaaaatatacgctttttttccttacatattcttacaaatttacctttagttattgcaaatgagctataacttctgtgtggattaaaattgtagttcttttttaactaggtgggacattcacatctggaaacatactgaaatttttatcttctttttagacttgaaggcttttttgttaacatttttcgtaagttaaaatacacttgattcaactacagttgcccttcctgttcaggtcctgacattatctcttttggattataatacatctctattttattttttcttttgagacggagtctcactctggcccaggctggagtgcagtggcatgatcactgctccctgtagcccagacctgatcatttctcctttatctcccagtagctgggactataggcgtgcgccaccacacccagctaatttttgtattttttgtagagacgggtttcaccatgttgtccaggctggtctcaaattcctgggcccaagtaatccacccacctgggcctcccaaaatgctgggattacaggcacaagctaccaggcctggccaggcatctcttgtgcagatttacttattcactaaagtgatttggaaaatagccatgtgtgcaaggtttacaaaaataacttacctagtttcactgtagctttctaaacaagttttgaaactttgttattttttaaaaatcagtcatttccattcacccggtttctaggacaacatagattgtttccttatgtagaaatctagaaaggaagtaatccttgaaatcttctatattaactccctcattttatgtaagtgaaaattcaatacaggcagatcctcagtggaaattttagaattcatttaattagtagatagcaataaacttacctgctttagtttatcatgagttaggattatctcaaaatctgggacccatatccataacacaactaatgtttaaaaaactgcatacaaggaaacttttacccctttgtcaaatactgtttgagaaggtacttgtcaaaaagttgaaggaaaaaattgagttgtgatactcaaatatgaatcaaataaaaataccaatttgtacataaattaggtaaattttaacacatgaataatgactccgagttttgctaaaacccgctgttggctttctatatgattccctattctcaacgtttttgattattaacaaagaatggctatcaaacttactcaagattttttttcccccataaatgtgtgccttccagcaaattgcttcctgtcaagttaagttacgcttaaaatgtgtatgtgttggtagttttgattgcttcggttttttatgcttgtttttattaagagctacaatcagatacagggaccatttaagcctgattttattttattttatttttttgagacagagcctcactctgtcacccagactggagtgcagtggtgcgatcttggctcactgcaacctctgcctcccgggttcaagcgattctcctgcctcagcctcccaagtagctggggttacagatgcccactactacgcccagctaatttttgtgtttttagtagaaacggggttttaccatgttggctaggctggtctcgaactcccgaccccaggtaatccgtccaccttggcctcccaaagtgttgggattacaggtgtgagccaccgtgcccagccttgaaccggatgttaaatattcatataatggtcatacctgtttttgttttagaacataatcacaacaccgctatggattttttttttttttttttttttgagatggggtctcgctctgttgccaggctggagtgcagtgccactatctcagctcactgcaacctccgcctcctgggttcaagccattctcctgccttagcctcccgagtagctgggactacaggcgcgcgccaccatgcccagctaatttttttttttttttgtatttttagtagagatggggtttcaccgtgttggccaggatggtcttaatctcttgacattgcaatctgcccatcttggcctcctaaagtgttgggattacaggcgtgagccaccgcacccggcctgtggattttaattgaaaaaagatagtggtttttagcaaattacaactactggctcagaagtaataaatctaagcttcacatttattccatagaattatattgtttttcttataatgaacatataattcatatgtgatatatagcagtcatgttgttttattctctacaggtatgttcgcaattcgtgctgatcatgattttgtagtacaggaagacttcatgaaagcagtcagaaaagtggctgattctaagaagctggagtctaaattggactacaaacctgtgtaatttactgtaagatttttgatggctgcatgacagatgttggcttattgtaaaaataaagttaaagaaaataatgtatgtattggtaatgatgtcattaaaagtatatgaataaaaatatgagtaacatcataaaaattagtaattcaacttttaagatacagaagaaatttgtatgtttgttaaagttgcatttattgcagcaagttacaaagggaaagtgttgaagcttttcatatttgctgcgtgagcattttgtaaaatattgaaagtggtttgagatagtggtataagaaagcatttcttatgacttattttgtatcatttgttttcctcatctaaaaagttgaataaaatctgtttgattcagttctcctacatatatattcttgtcttttctgagtatatttactgtggtcctttaggttctttagcaagtaaactatttgataacccagatggattgtggatttttgaatattattttaaaatagtacacatacttaatgttcataagatcatcttcttaaataaaacatggatgtgtgggtatgtctgtactcctcctttcagaaagtgtttacatattcttcatctactgtgattaagctcattgttggttaattgaaaatatacatgcacatccataactttttaaagagtatgattcaacgtaatatttgctaatatgtgactgggttttcttggtttatgtaagacgataggtccctgttgaggatgtgaaggtctggaccctcttccaggaaaaattctaacatacaattttgcgtatactataatttcaggaaatttattgtttcccaagctcatccaaggactctttaggtatgtatggatacctggctaagagtgtatgatgtaggggatgtaggagtgtcagaaatgttcaaaacatgatttctgttacctatacatgattcttatatcatctggcaataaaagctataacaaagtacacaaaggaatcatcattgggcatcaataattattaaagatgctggtgaaaagaaaagacaacttcagtttcataaacactaaagaaccaaaaatacatgacctagctaattatacaataattcttcaaattaaaaacttcctagcaggatattatgtgcctttttataattttagaagatgaacagttaaaatagaaaatggagtggtcaagttagccatctcatactcaaattattgtacagttctatttctatgtgttggcagtgcattttatgtgacaaaaagtagaatgtagggggaggtttaagtcaaatatctatgtgatcttttcacttataatttgcatttagttaaggagtgactatcttgccttttacctttgtgctggcggtggttttttaaagaatcaatttggtgtacaaatcctttctttctttttttatttttgattttttttgagatggagtttcgctcttgttgcccaggctatagtgccattgcactatctcagctcattgcaacctccgcctcccggatttaagcggttctcctgcctcagccttctaagtagctgcgattactggcatgcgccaccacacccagctaatttttgtatttttagtagagacggggtttctccatgttggtcaggctggtctcaaactcccgacctcaggtgatccacacgcctcagccgcccaaagtgctgggattacaggcgtgagcctccgcgcccggcccaaatcttttcaccatgggtttacaggcataacgccaccacacccagggaattttaaaattgttttttagagaggggggtcttactattttgctcaggctggcaaactccttttaaaagatattgaaagccatctggtttattatttttatttcaaaatataataatggaagaaattttacagtattatatacaatttactgagtcagctatcagttcctttttctgatttttttctagttgccattcttgatattttctaggtaatctaaactgagttgtattttcaagtactcttcaaatactttaaaaaattttaaattgagccgtttaattctttgcttaaaggtgatgggtattttattttctgtatggcaccacgtgattttaaattgaactcttcatttattagtcatttggttataaactcagcatagattgcgcagaattttgagaggggagaaactatagctttcctttcggatgccactggtgggtagcctgttttgcctgtttgttcttatgttaaagaagggctctacgtcctgtctggaaagggcggagctggctcggaccgccccactgcctttcccaggaccttcactcgtcctgtcccaccgcagccccgcctcctccacgccgggtgagct

SEQ ID NO: 13529 - DNA, 21689 bp, Human
tgaaactcatacttgagatgagtttttaacgaggtgcctctcagatccctccctcacaccctcaattggcatccaggctgccaaagccccctgcacacatatctgtgtaacagatcgtctccccaccctgacgccttccaccccatggtgctgttacttatggaattcagaaggcagctactgctttgttttctgtcttcctgataactctaggaaccttgaagagtacctgctacttacacatcatcttgttcttaaatcaaatttggaccataattgttatcatacaattttaactgctaaggtcacctagttctacagttcaaattaaacattagctcatattgcctctaggtttaaaactaatgtacccagaagaaatttactaagggccagcaatgttgaaatagcttaagtgcaaacagaggagtcctgtgtgctggcaatgacaaggcgatgttgtctaaagtccctatttgattcctcgtttgtccatcccttcccagtggccttttcctctctgaactttcaacagtcttgtgcctaagcacttcagttcactccttgttaaatgccgttgattggctatgcatatgtaacatcccttactttattccagaagaggtcaccttaatactgctttaattccctgaagggatgatgtttggtcatcagttagcaaaactcaagctttggagcaccagaatgtgtgccagaaaaaatttttccaaatgcttgataataaactcagaggggggtttggtcaccagaattgttaggtgaggctattgcttcctaacttttgcttcccacagtccaagctttgatgcacaaggttatggttgattactttttattgcattctagtgggaactggtttctccacccatcctcattttctgtggtctcaattccccattgttccttgggtctgaggatgcagctggatctgagagtgtgagacgctgtcatttagtacatgaactaaagatataatcctgtttactactttttttggtcaaagcaaaaaataatgcaagagttatgtgaacacgatgtttattacatgtatagaactgaatatgtagatgtttataatccggaagctttgggaaactggactttgataatttccctgtaatgaatccatttctcaaaagcatttttttctaaaaaaaacacacacacacacacacacacacattgttctctgtaacctccccagatagatactttttaaagatcttgcttgttaaaatgcctgccagccttttagagaagttgacaggttaggtggtttctgttagcagaaacacgtggactcaaagcttttcctctaaaatgaatctgttgtgtaacatcacagctggctcagaatacaggtgcgtgctcctgctctccctgagaagatagaatgggaagagaccaatccagatgagacgcaggggaggaggggacacccaacagcaaaggcactgttgcaatcttagcctaaaccatatctctgagaaagagtttcttgttgcctgcttgtatctctgggtgatcacagacccctgctctccaaggtgggttgtgaactctggagcactaccaagattggctaagagctgaaggagagtcccaaaggagcttcaattctgcagaactatacagccttctttaccttaccttgaccaggtgcttagagtttggaaagtcagggataagaattgaaattcctccaggtaagaagacccccctcttaggaaatggactcctccaattttctcacatgatttttcaggcactttcgcttttccatatataggagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccgggtaagtaggctgtcttggactgactggaaaacgatcattccaagcctatactgagggagtcacttacaaatggttttaatttgacacataataattgtgcatatttatggggtaccgtgtgttgttttgatccatgagtataacatttaatgatcaaattaggataatgggcatacccattgccacagacattgactacttctttgtggtgaaaacattcaaaattccctcttctagcccttcagtcaccctactgcgcaatggaatgccagagctcattcctcctatctgactgtaacttcgtacctgtaggagtcacttttaccagagctcttcagagcaatgtgtgtgagttaccagaagggatctctagagaaacagcatggagtagtttcataaaacagtccctcctgatgaagccgtgctgtggcccaccaccagcacgccagcacagtgggtccaagacagggagtagcagctggctggctaagagtatgacacatgcaaaatatatgatcaggtcttaactttttatatgtattttttttttaggaaagctttaatctattatccatggccaatttaagtcaacagggaatgttcctgaaacaagaccatgggtgactaaattttgcatgtgaagcatgtgcaacttaggcatgaaagcctgcaccctggtcactgctggggtagacctctaggtgctggggactcagtaacgttctctaagagcagaatagaagaccttctaaacaggaagaaaatttaggcattgattttggtccctgaaaagtaggtagactgtgatgtgcggaagtgagagaagcttccttgatgacggtgagaactaggaccaggacattcagagcctcaagtgtaggacagtggttctcaaacttcagggagcttcagaatcccccagagggcttgtcaagacaacagagggctgggccccaccctccagagtttctgattcagtaggtcttgggagaggctcgagaatttgcatttttgacaagttcccaggagatgctgatgctctggggtgagaaccactgctcttggagacccctgggggatagatgtacagacttctatagttaagtccctcttcaaaattcattcgagtgtttgctaacttattgccaagtctgcctttttccatcttccttgctcttgttcttcctcaaagatatttatctttcctaccttgtaacttggctttggacacctcagtgcactactccttccatatactttagccagtggtttttgactggtggcagttttgccccacaacccccaagagcattttgtactgtctggagacatttgcagttatcacaactataggaggtgggggtaaggtgctactgccatgtattgagtagaggtcaggcacactgctaagcatcctacagtgcacaggacagcctctcaagaattatctggcccaaaatgttaatagtgcagctgttgaaaaaccttgaattgaattgagttttttatgtgacttagctcagttcaatgtaaatagcctctttcattgtgcataactgtataaagtatctaggtttactgtattttcaatctcagatacattgctgatttctgacacattctgatcagctccatggctatgagcctcatgtataggttaggagaaagattcactccacccggaggaagtgggttttttggcatgcagcggctagtggtcccaagaatggtccattgtgcgcagcagcaatgtgctcagaggactgagaatgaacgtgccagccaatcaattgattgttttgtatacttaatgacagccaatcaatttgtctaatcgtcccttgtacttgccattgtaattgtccaggtaagtcagtttccatggaggctaggtgactttctgcttgtcattccattgctgaattcctctctgctagaaagataaaggttttcttctctggttttccaaaaaaacaactattggctatcttaagcctactaagtgatattgataaaaattttgaaagccaaaacaaaaacaaaaacaattcagaaacaacctccttgggcattgtcttgtgtgtggtgctatctggaagcccctgctggactccagctttgttccttctcctgttggatttccctaggcagagtgggagcctgtgagctgtgtctgcacaggcagagacattcacaatcaatgatcagtcagcaagcttctaggaactctgatgggtaagcctaaggtggccagcatgtatttattttaggatattttatcagcgagaggccttcagtggtagaagtgtgtagaggctaagggctcagacaaacctaaaggtactaccagggtctgccactggcaggaggctagattaaacaaacaaacaaacaaacaaaacacaacctcaaacatatgtttagcagtagtttctaaaggaaagattaaggaattaatgaatatctttaattacagaatttaacatctgcttttgagagccaaactgcttgattctggatctggattcttaacaaaaacatattactctattaagagcagactgtgggtatttttaacactgaatgagctataatatatgtagatagagatcacttttatttcttaatttgtagatattgacagtttgcataaccccaaagcaagagtagattttcctacaagcaccatttagtgctttacattttagaccctgcagagtctttaaggcaaatagtggaagaataaaatcaaattccagctcatgttgaacccttgtcagtcctacagtaattgaagaggtcaagcccagctctaaggacacctggctttcgggaggctgagtgaccatgtgggagatctgagagctgcttatggaagtattctgcaaaacaacaatgatgtataggggttatcttgtagaattcttatgggtggagtcatgtacttgggtgtggtgttttatatacggtgcattgcatcttgtggaacctgccatgcaatgcagctgtttgagccgtctgattttacctcttggcaaagaggtaaaattgacttcttaactatttttaagttcattttcaggacttttgtagatgttagaattaaagggaacatgatgaggaatgagagattttttatttagaagaatgcgtgtgtgtttgtttatgtgtgagttgcgttagactcctagaagagctgattttgaccgggcgcagtggctaacacctgtaatcccagcactttcagaggctgaggtgggcggatcacttgagaccaggagttcaagaccagcctggccaacatggtgaaacgccatctctactgaaaatacaaaacaaattagccaggcgtggtagcacaagcctgtaatcctagctacctgggaggctgaggtgggaggattgcttgaacccgggaggtggagattgcagtgaaccgagatcacaccactgcactccagcctgggtgatagactgacactccatctcaaaaaaaaaaaaaaggtatttcttttttagggcattctatgactttatataatacgtgtcatccaaaattaggcaggaatggaaataaataaaaatttcaaagtatttctaatttcttatacttaaaaaaagtgttttccctctggtagataagttgatatgtaaactgaaaagtcgatatctaattattttaagatttcaatttgttatcccgaatatttttgtgattctgacccatatttgctcttgtccagataagatctgtgaccagatcagtgatgcagtgctggatgcccatctcaagcaagaccccaatgccaaggtggcctgtggtaagaaacacccgatccctccctgctggagacctaagtgggctagactgagaaattaatcatgggtataagacaaacgagccatactcctcagttccaaaatccatgtcctctgctctgcagtagatttctcaattatgagacctcccctgtgtagtaacagggaggaaaaacatttctaaccatgaaacaaatagataattatttttagcaagaatctaacgttaaatgtcatagcaaccataaatagcagagggttggaccagcacatggcctttctgatgcttgatctcattgggaacaaggaggtctttcaaagttcttaggtgaatcttccagacgggatgaaagagcttgaaacacaggtagctgcctagatggttataagctgcatcctcattgtaggagcctttgttggctgcacagatacctggcttcttctcttgttttctttcctagtttgtggtatgatttaggttttaaaataattagtgtcccccatttaatagcaacaggaaggcaacatcttcaccaattgtttttcaataaatcaatggctttcctaagagacattaatgttaaactaaagtactgaagccctggctcccatctgcataatttattgtgtctgaagactcatgtaggctgaagatcttcacctttatttgtgggataagttgtttggcaggaaaacctttgcctggcttgaagcctgtggcacagtggcagagtcatggactctggagtctggaggggccccagggtgatcaggtccagcctgttcattttagagacaggatcacggtaccctctgcatcagggcctggccaaggccatggggtagggtgccccagtgtgaagaccagagccttgctctccttactgtcattgtcatgtcttgtccactgcacagacccatccttccctctctggttgcatcctcagccctgtattgaatactacagggactcatgcccctctgaaggtagattctacccttatatctttgtaaatatctggagagaaggttggcctgctttgattttttttggtccagatcccactccctaaagcctgcagtggaggtttagcaatgtgggggatggggggtcacatgtgtggactaccttctttatgacagctacatacaaccatcatctccctttaatccacatagcagtcttataaatagctttattaaatagatgagggaacagagacttagaggggttaaataagttgtccaggatcacagcttatgactgactctttccaagacagcattggaagatgctcagtgcttggtgctgggattttttctttttattggcgtttctattttccttctggaatccattcctcgtaaggcccctcctgtgtcttttctgtctgcactgtgagaggtctgggaatgtgagcttccctttgctggcacttggctgctaactctcctcgctccccgctccctttcagagacagtgtgcaagaccggcatggtgctgctgtgtggtgagatcacctcaatggccatggtggactaccagcgggtggtgagggacaccatcaagcacatcggctacgatgactcagccaagggtgagggcaggcctccgggtctgaaatccctgttgctctctgctgatagagaccccagtgctgagtcaaacccgtgcctttcagcccgatgggagtatcaatactaccaggaggaaaacactcctacacttgtctgtcaggttccaggggtcaaagactctggcataaggatggccaacaggcgactatgcccagtgggcccagcacatgcccatctgttgttgattgggcttgttttaggccttgccttcttggcgctgccaaaggctttggaagagaaagatgcactgaataaagggggctgccctcctttggggacatgctcgctgccaggcactggtgatagtctcttgtgttgtcttaatcatttatgtacttatgcagacgaggaaatggaggcctagaggggtaaacagtctgtgtgagatcacagggtaagcagccactaggctgaggactcctgtgcttccactaaacctacttgcaatcatagacatggagcaagatgactcagtccagaactggtgctgacagcaggcgaggctggtccaggttagcaccagtgctacatagtgtggggccaccacccagggaaggggcacaggccctagcagaactttgaagcagattccaacatctgagactgagcaggccaggcagcggcacagcctggagggcagcaaaggacccagagagcagacaccaggtgcggagggcctgtatgcgatcacattctgcaggagcttcaggggccctttgtccatgctggcttcctgggcagggctctggccccaattcttagagtctccacgttggtctctggcattagatgttcaggcaattctaatttttaaagaaaaattcattttgggtctctgttagctctttccctaattctctgaaatcactgtgagagatgtgatgacctcacgccatggcaaaaagacccacttccaggtcatcctgcctagctatacacctgtaatcaagatgcacagagagaagcatgactttaaaggtgttcatttctgcctgtgtcacataatcgttgtctagggtgatgtgtagcatcctgtgggtcagggtgctggacccccgtttgtaagtgagagagcccactcatggtatgatggtgcagactcgcagaggttcagtccagccatggcctggtgcagcccaaagcactcatgagcaattaatattggttgagtgcatgacagtgattttgagactcagtgggaagagaagcagtaagaaccagttaattctcctggtcgggacatgagggtattcacagaggaaacacattgtcccagagctgcagcttcctgaggcgttaccacacggagcctgttctaccaaaaaaaaagccaatttgtttatgtacatttagaccttattcaagtgcaaaactttttctgcattaggcaggagggaaattttccaggaggcaatgttccctagaaagggagaaatgagcgagagcccagccgtggctgagttgagctcagctggctgaggttccctgtgcccaagcttgtccatttacctgtgctcagtggacaggaacagccttagcagggtctcaggccagtggctcctcgttgctcctggctgcggtgttgctgggctcattgtcctttccaagtcctgtacctcccctcttggtcccctaagttctgtttttccaaattccttggagcccttgcttgatttttgagccctggggagattcattatttagacagacagtgattaggtaaactgaaatgttcagtgcagaacaggacagcttttggcagttctttaaagactgttcattgatttgtgcattcaaaaacattcattaggaaacaggagggtgtaaagggcaaaggtgacctgatactcccagggtatatgatgcaacatgaggtgccccggggtaagttcctggcattgtgtctaatgaactgcaggcaggtccagggacatgcactgagagtggacgtggggtttgggcatgtggggtgggagctggaggtagaacgttctaggcagggacctagtggagatggaaaagtatatcatgctgatggctaaacttgagttcatgttggctcaaggagtcccaggagcaagggctgtgtcagactgaaaagcttcagttttattccttggcagtagatccccacctgaagcttgtacagaaacagcagcttggatctgtgtgttttctctgtaagccctttcaggctgtgtgggtaggagaatagatgggaaagaagatggctgtgggggtttggagagtgagtgtgtcactatgcttgaccttgtggtgggggcgtccatgtattcagtcccttattctcacagtccctgtgactgagcccagcacagctgtgaggaggtgcgcacggtctcggtgcatagcagtttcctcatgggactcccagggctgagctactgctagtccagacttccccaaaccagtgcctcgcgtgctaggtgtagcaggcctgcaccctgtgcctcagctttgtagatgggaaagggcaggtggcttttccatttgccccagactctgtgtacctctcagggtcagaggaccctggcttggggagtctgtctggatagttcatgtacactgtatttgttcagtatgtttaatagttgtgtcaggcatacagctgggcttctgagtgacagtatcaaaagggctcttgattttctcctagtgcagtgatgctcaaactagattctgggaggcacctgtgggagagcctgaggggcagggtatgagtcagccaccgtcctcagccagaggagccttggcatcaccttgttttaatctgcaggtctctgtaggatgtgtgtgtgtgtgttaaccaaggtctaattgagcacagtaaaatgcaccacggagaattttggttggccaaagagttctacatgatagggtgggaaggtgcggggcctctcccatcctgggcctcagctgtgggcctagacagaccctggctagttagggaacccccacgctgacaccaaatggcatgtcaggaaccgagccatccattgggaagtttgtggccccctccttctgacctgttccccacttaggctcactttgcttccgcctaggctttgacttcaagacttgcaacgtgctggtggctttggagcagcaatccccagatattgcccagtgcgtccatctggacagaaatgaggaggatgtgggggcaggagatcaggtagctcggcactgcatgtgggagctgtgtgttgagctggctgggaaagttcatgagcagtgggttaatcacactgaggggtggattcttgtcctagcacgatagccaggagcgagttgggaaccccagcttcacggccgtgctgtggatggctgtggttgctgacactgggtttgggcttgtctccccctcctagagtgttgggggtcagggatgacgtccttcccctgcacatgccagtggaaagctccatggaggaggcacccaatcaacgtggacacaccagggagatttcaggcttggagagagctgcggtcctcttggtctagggtgggcgccgctcagcctgctctctcgccacagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgagcagctgaattaccccaggagagccctagacagaagctttaatacccccaaatcctcttgattcttgattgtgtcatttttaagatcgaaatattcaatctgggcattcaaagaatggtcagttttgaaaagaactatttatgtgaaaaatcttcagctagagatgcttcccacaacattttattataaaaaatttcaaaaatacagagaaatgaaaagaatagttccgttttttttgtttgctcattagtaaacattgactaatgagtccccaaatcctgccacaaacatacttaactggcttccatattttcaggcctctttgtcctgaacaggctgtctgtgctgtgtctgtgctgtgtctgtgttgtctgtctgtgctgtgtctgcgctgtctgtgctgtgtctgtgtctgtctgtctgtgctgtctgtctgtgctgtctgtctcatcatgaccctttttctcatctttgtttctcatgaaaaggctttacgtctgttgtttccagctccaaacccatgggccctgacctgtcttctccctgcagtgttgaaatcaacccaaggcctatatttgaaggctgaggtgattcaagtgttagtggagacgcaggcctcctggcacctcacccctgtatcccctccctgcttaaccccaatgagccctctcatgattcccaagttcccagcacttcatactgcacaacttctctccctgtgtccatgctcgtggaccccattgtcaccttcacatactcccacctgtgggtttctctgatcaccctccaagcagatgggccctgagagcctgccgtgtgcagcaccctgccacctccctcctgcccttcccccgtcctgttcagcgccatctctctccacctacccatgtccccagtttaccccatcaagcacccctctcgctccagctcagccttccccagggctgccatcatcccagccaggccaggatcagtggcctatccttccaaaggtactccctgcttggaaattccagctaatcccctttaggcctcatttttaattccctaacatctattcagtgttttctacaactttgggcttcctacaaggggaagggggaaatccacttattattctggcattcacaaccttttatggtcttccaactttacctgcctctgcctgccccacaccatctttgcttaatcgacatcatttcactcattgtccccttgtttcttagggctttgctttacctgagctccctctctggtcttcacctctccttcagtggccagcaaagttctacctcttttgggatgccatccctggccactagcagacagcgccagcgccttctcttgtcctgcacttggaatctggcacccatggtgttatagctcagcgtgctgtgtgtggctccatgtacaactccagttgtacagagatggagttccttcttgtgcaagtgtcagaccatgcacagggcagaggttgcatactggctgtactggggcagggaagtgtgcttatgcccaaagggaacccttccttgggacttcctgtgttatccacatgaccccccaaggtggggatgggaaccatcagcattccttgggtgttcttggaggttgtgagttaggagagctaaaacatgtagatcgtgatggcacccaaagaaaggggcccatgatgtcggcctgcctgtcctgtcctggactggaatggtgctgcgatatagaagcagggtgaagattcacagaaggggaaatcttagaacagggaggggaggtagccagtggctctgactgttttttctcttccttgtgcaagagagaggaacagagggaccacctactggacctgctgaaacaggttcattgtgcttagatatgaaatagaaggtttctaggtttaggggtcagcaaggaagggagggtgggatgggctcttttaggggttcccttcctttgaaggattgtctcgaaaatgccaatacagataccagagtcagcctcacttccctgccacaggcaggaccgcgggccagctccagtctcagggggtgcagacttgctgtggggctccaggaggcccctcgccagctggcctgcgaacagcctggcttgctctagacactccctccatgagagaggccctgggccaggcacagcttgtctaggtcccctgctccgcaccctgtttttgaagtagtgtcttcatccagctggactgctggctgtgagcaggatgggtctttccacctgaacaaatccctgctgctgatagtgaggcctgggtggcagtgtggatggctatttttgtacctagtcagagctgtgttttccatggtgtgtttttccccacatcttgctgacatgatgagataagcgccgtgttcagggccctttgctctgctgccctattctgcagttctgcaaggccactgcgtggagtctgccgggtgggggtggagtcacccaggggagcagtggagacggcctgagcaccctccccagctgtgcaccttctcccgaggctccatgcagactagacccagtcctagagtctgccacagacagtgcctcttttcctgggagtcccctaccccagattccagcccctttcccagggccgtgtgtgtgcacagcctggcatttgaggacttctctcagctcacgatgtctgtgtgcatcgggccatctcatgcagatcttacatggccaggactctttctcctgcttcttctggaccttccttgttgctccttagaccaggcagaacacagagtaggagtttgatacagatccagggtttgatggatacctgagtagccttggggaggtagagagtttgctgcaggcacagtcccagggagccactgtttgctgccccgtggttctgtccaggccctgggatgggagcagtcccatactcactggccagtgtccctcccagggccatctggcagagctgcacccctgcgggcaccacatgtccctaaaatcctctgagccctgctcttgtgggtccatgctgctttcggcagtattgggcctgtggccagcacagggtcttgagtggcatccaaccttcttcttggaagagccctgtctaccagcccatgcagctccaggtcagatcccagctcttccgactgtgtgatcttgaccaagacatttacattttggatccttggctttcttatctgcatcattggcaggaggagagatacctcctgggctatagagggtcaagaaagggctttggccagggggacatttgctggcacctggaagcctctgagacagaagaggagacatgtagtgggtcagaagttgagaggaaactcaagtctccaagcagtgctaattgtggccccatgtgggaatagctgggccttacacccagtcctcccacagcaccaggcaattttttgaacgtaagaatgtgtcagattaactcccccaacaccctttgaagacaggaggccccacttggctcctgggagccctgcccacctcctgggtgcctgtgtctggccacgatgtgccgttcgctcagcctcagcctcacagtatctcccccacccttctgatggacaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccaggtgcattcttgtctctgaacgaagccctggtttgtctttgttactggggttgcttatgtctcagagcaggaaaacctcaagagatagcttggagggggtcagctgactctggccatggactaaatgtaaagtcggtgaattttggcctctgtacatttagtgcactctctggggaggtctgctatgtgtctgacagtgtgcaagaaatgggggatatgtccctaggattcctccacttagcgccactgggccctcccactcctgccatctcaagtgaccatcgaccttacccacggctgctgcacctcaccctgctctggtgcacattccccactgcagcatttgcacgtggacagctgttcccgggtggctgtttccagatcttcaccacaggctgcctctggctgttgtgggcaccagagtgggacagggtgttttagacagggcaccactgccccctctcttgtactgcaagtgtgaggaggtggaggttgagggcactgctgtgaggctgctgcccactgcctgggccctcagccgtgtgtgctttgccagagttgagctccatcccgggttccagtagcaagtagagtgtagaaacacagagtagaaggaggtaacacttattgttttttcttgcaggacttctcaaagcctagacatactagtatgaactgtggatctctaaaagggggagtagagcaggcagacttccccaaatcatttaacatagaactcccacccttttaaagacatcactattgactggtgttgcccagaggacacttgggaagtgggcagcatggcatttgctaggtggcaccagccagggttgtatttatgacagtgcagttcctgcctgcagttggatctctccattgtgatggactcagtaacaaaggcattagggagtggctgtgaccccagagaacccctggcccaccttctgcacttgctaatgaagctttggcaggttacctgttttcaatatgttgtcagtgactgagctgggagtggagtccagagttctgggctaaggggtcttaggaaaatgtctgtgggcagccccaggacatccttcctgagttgcagttcagctgccatcacagtacttcagccccctccagcatctaggggctggctctgcttcttatcttgatttctctccctctgcagggggatgcgggtgtcactggccgtaagattattgtggacacctatggcggctggggggctcatggtggtggggccttctctgggaaggactacaccaaggtggaccgctcagctgcatatgctgcccgctgggtggccaagtctctggtgaaagcagggctctgccggagagtgcttgtccaggtaagccccctccacccaccaccgtcctgttgcagtggaggacccctgcccagttctgccctgagtgaggggatgttggcccggtgggaaagctgcacgctttgccaaaggttgtgattgtgtgattgtgttgggcactgtggccagggctctgaaaacctaggggagggaaaaccagaatcttcagggagagaggcgtgtagaagaactgccctcggtgaagatagcaggaaaattgcaggggagcatgtggggcaagaggcatgtggtccccgctggtcccttcagaagaagggcaaagcttctgaaaggggcagggcccacacagaggcttcaatccctgacgctgcaccttgctggaaggtttcctatgccattggtgtggccgagccgctgtccatttccatcttcacctacggaacctctcagaagacagagcgagagctgctggatgtggtgcataagaacttcgacctccggccgggcgtcattgtcaggtaaagtgccatgtgctgctattacacaggaccttgctccttccttgcccagatgctcacctcacctgaaagggaggcagaaaggaggatgtttctgcctctcagaagtgggagggtctgtgagctcttggtacagcacagtgcatccccagtgcagaaagcctggttgtcaggttaaaggaggctgccccaggttcctgctggcccagtcaacaccaactccagtggggccatctctgagcaactgggaggcaggcggggatcttaggaaaataattattaatataaggccaaatagctcaaatggctgggaatcaagtcagcaagtctattccgtttctagagcttagtggtgtcaacattggcctgggccaggtaagtggagtgggaggagaaaagcaccggaaggctggagttagatcctggtccctgaacctctaagcatccgtggggctataaaacgagaccagggtatggcacagataggatgggtgcgcgcaactgcggtggggaggcgtagtgccatgcgaggagggctgtgttacagttcgttgctccctcctgtccttgaaatggagaaagaaaccctgctcctgttccatcttccaatgcccttcctttctgctggacatgcagggatttggacttgaagaagcccatctaccagaagacagcatgctatggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgttggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaccctatgcttagttattctctgcaaaaccccagagacatgacacctgctctgtatagcattccctggttgcccacccccaccaccgggggaagttagtatcctcccctcggggtcaccccatcctgtccacgtggagcagatgtctcatggactaggtttttcttgttactagcagctatgttaagccacaccactgccatgttcattcctcaccacatctcaccaaggtggatattcttaggaagcccatttttacatgcggggccctgaggccccaaaaagggttaggaccaaaggcagtggccacctctggctcctccctgagttctgtgtgctctccttacgcattgctgcccttaggctgcctatgccttatcctgtgcccttcctgcatggtgtctgcatgagactggcgtgagggcatgctcaggccatgtctggagtatggataagtgactgaatttgaacaaagtgaaggagtggaggggattggtctgtggagagaggagccgaacttttaagtggatgcacatttcccttcactcgtgttcagttgtgaagagaataagcaaatggttctttttcattgaaggtcatccctgccatggcccccggtgatgtggttcttggggtttgatcagagcaggaggaagatgggtcctgcatggtttccggcaagcaggctgtgtggacaggactcagctctggggaatgtcctggtgcagcctgaggcaaagcctgtgtggcccccgtgtctcacgggcagacaaagctgatctggggtgccaggaagacccagaatgtggcggggaggggaggggaggatgaggccaaagggcctcacagtcctgtttgagacagaacctataccctgagaagacactaggtgggcaatacaatgaaacatgacacattatagagaaaagcacgtttctcaagaatgcatacaaatagacacacttaagaaacacactggaatacttgcctggggtagggggaggactctaggtataacatgcaaaataattagtgaaagcaagatagagaaccaccttctgagccacaaagccaagtgtcacagtgttagggaaatgtggacggagcaaaggaggttggcagggagcggccagtggagtttgaggaaactcaggagcacagagtccctggaagtcaggtgaagactgtttctagagcaggggagccaccaactatgcaaaatggttttgatgggttacatgatgggaggcccaggactgtccagtgaattcagccacatggaggttgatgatgtgggaaatggcagagtcacatttaaacgtaaatatgaccccaaccctcacctcaatcatcctcccctgggccatctcatgacattcagagtgcgtgctgggctgcactgccctgcatgtctgtgcagtgcctgccccctaccctcatcctggactctgctccccactccccacattccggactccttggctctttggcttcccccagcaggccaagctcgttcctgctcagggtctttgcacctgtcgttctgtcatgggtgtggggtgcgctgcaggtttcagatgaaatttctgtatttccaaaaaaccccttccttgatagcctctctttctactccattccatttctagtttctttttcagtgtttaacatgatgttccttggagcctttcacttgaatccttccctacccattcactctcccttccttcttcacatgcgggtcctccaaatccctgcagtctcagctgacaagccaccctccatgatgctcccaatctcccaggaagatgctcccaagcaccttccataaatcacacccaatgctgtctccatctggtaccgggctctcaaaggttgtagttctttaaataactaaatattttcattaattattaataataatgttatggcaataattctattgctcacactctgaagatgatgtatcaacccaaataagaaagcttttttccccagcttcatt

SEQ ID NO: 13530 - DNA, 145287 bp, Human
ttcattcctcttatatttcttttttagttgtaaattttcctccaacatttgaagccagaagattttcttctataatcttaatttaaaatcactctacttggtctacttgtatactctgtctttatattttgctggatgttggccattttaaataatgtttccacacttatacaatgtatacagaagaatttttatttccaaaaaggtatctttaaaaaatgttttctccctgtagtcccagctactcgggaggctgaggcaggaggatcgcttgaacctgggaggcagaggttgcagtgagccaagattgcaccactgcactccagcctgggtgacagagcgagactccatctcaaaaaaaaaaaaatgttttctcctcttttaagtttttaaaaatctctgaacgctgatctgtgtttttacttattctcgttaatgcatggaaagcttaaggaatcatctatgtttaaggtctgacatggttttgagaccttatgaattatttcacaagaaggttttgtaggttttttccttaatgagacattacatattcctaaggctctgatgaaaagaaaatttgcccattcaaatttaattttaaactcatgttatacaatttcagtgattttaaaaatctatgcctataataatgttataatattaccatagtgtgtgctccattagggcgcatgtgtctgtcttgtttatcactgtagctccgtgatagcctagccaccagtggctgtattttagtaaataactgtgtaagtgaatgtgagaatgaatgatagaatttcaaaatggctttaaaaaacaatataaagatgttccatataaaccatgctgcctcagtcacaacactgaaatatagacttttacattttcttttttttttttttctttttttttgagatggagtctcactctgtcacccaggctggagtgcagtggcgcgatcttggctcactgtaatctccgcctcccggattcaagcaattctcctgcctcagcctcccgagtagctgggattacaggcatgtgccaccacgcctggttaatttttttgtatttttagtagagacagggtttcaccatattggccaggctggtctcgaactcctgaccttgtgatccacccacctcgacctcccaaagtgctgggattacaggcgtgagccaccacacccagccaagacttttacattttcaatcaaatttgtagtctctcctagcctattctgctatgagtagtaaattacttcactaagggtgctaactaaactctgtatattcaagataaccatggtctgtttaaatagtttatgaatgataaatgcagaagatattatatagatgttattttataaagatgctatatatagtgataattccatatgttatgaacttatacagatactgagataccaaatatgctaaagacactaagatttttttttttttttgagacagtctcactctgtcacccaggctggagtgcaatgacctgatctcagctcactgcaacctccgcttcccaagttcaagtgattttcctgcctcagcctcccgagtagctgggattacaggcatgcgccaccacgcccggctaatttttgtatttttagtagagatgcggtttcaccattgtccaggcaggtctcgaactcctgacctcatgatccacccgcctcagactcccaaagttctgggattacaggcatgagccactgagcctggccactaagatatcttttacgcagtgttagctgacgagaaatgtgactctctggtactgaaatgaagactttcctcattgctttaggaattgtgtatggggcttgattcactgcgattttgtctagctttataatgataaatatgtgtataatttattcagtatgaaagtattttacctatcttccctatgtcgaaggtttacttcctagtgttctctcttatacaaatgattgaaggtgtctttttttattgcttgtcctcagaatggctttactcctttatacatggctgcccaagagaatcacattgatgttgtaaaatatttgctggaaaatggagctaatcagagcactgctacagaggtaagactgtcagccctaaagccttgaattctttgatcttaatgtccatattctttatatcaggctgcaaatagtctccattactttgtctaaaatatgctaggaatgttcatgttactattataatcgcaacagtggctgtgaacaaatgactcaggcttgtgcacagagttccatcagtttatgccttcattttggattcgtgtctatttattcttacataaaatcatgcttccattaattttccatcctctgaccttttaggaggtttgtaccattctaaaattcaattacagtaaattctactcatctcttttcaccaatactttatctttgttaggatccaatataattccttaaaggaacaattttttttaccatcagaaataattcataagtatctgtgttagcacagtttcatgaggaatgtcattaaaaaaaaaccctgtaccttattgaagcacaaattatgacacatggttgtgtgactgattatggcaacaactgaatagaatgttcaaaatcagtctagttttaaagagttccaggacatctagacataagaagtgggagtgggcagggaccctgagaacatcagttttctttcctaagcatttcttattccattttctttgtattttccctctcatttttgcttaggcagattaaggagcaagttcaatgactgtctggggcagtgatttcaagtgatgctccagaagcccttgtgcttggggccactggaaggttgggagtgggcgacatggaagaggagaggaagagagctcccctgagacatgcctcttctcacctgtttcaaccagagtatatgggcttggcttttctgttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccttttcttatttcatattttgtggccccactgataaaatttcaaaactcctggcctgaagtgaaagatgactggtggattcttgttacccagaaactatcttaagataatttttaatgtctaatatggcttcctttctggacaattaagtcttgaggacatgaactcccttctatgctgcattagaaggagaggttattaaaatgtaataaatcattttccagtccctttgggagaaaactttttatggagccaattgcaacaagtttctgacagcttattctcgttagttaaaaaaaaaaatccaagaaatcactattaatgagaccatgtttcctacctatgactggaaaacacaactacccagtatgaaatgtttttgagttctctattcaatacacacagattttatactcttgtcacttggatatagtgtgatttttatgatttgggacctttttttccctcagacactagttctgtccatgattaccatgggaatatcttcaggcagagctcaggtaacaatatgagactgcatctttgcatcagggcctctgagaaatatatcaaaataaggacatctatatttgttttatttgattttgatttccttgaaagcagaatcatttaccagatgaaacctttatgctagagtgcttctatttaccaaatagacttaaggtttctagtgtaggatttaggagaactcagctcgctggcattcccagctgtctcatggctcctggctcttttggtcaaggccactgtagcatttcccatttggttccaaaaatacccttttatgtacattgcagcagtagaggccatgttacactctgatccccagaaagttaaaatcctctctgatttcacaaggaaatgtgtcttttgcaaataaatcatgtgaggttttaaattctagcttagacacattatatacctattatttgtttcattttagacaatcatttaaataattaaaattacttttttccgattgaatatataagcttaattgattaaactctcaatgcctgcactaatggttatcaaaaaacacacatggacaaatctttacatattcctttttcgtgcatcattctgtaaaaaaaaaataatgtttttacagggctgtgtggttgattgccatttgatatcctgtgttatactgctaaataccttctacagtcttatgtgcccatgtgtcaatatgcctaaagaagggacttgccctgagctgtttggtagctaatttgcaaaaattaatgactaatcaagacattatgatcactttaaagttcaataattgtgagattattcaatgtggcaatgaaattcatgattgagaagaaatatttgaagtttttaaatttcccataattatggcacttagcattggtaaataaatgatgaaaaatgaagctaccaaactttaatatggatttccttttaattgaggcacttgaacaaatcattccaaatgtttagccttgtcccatgcagtacagattagaatgaaatctacgtggtgaagatccgaggttaaatactaagaagggagttctcagtctctccagtaccatttttatacagtatttctctactctcttccttcttcctaaatattaccaaaattaaaggccaaaaactttttaatgacattctgttctgtgagcaaatgcctcatctctaagaaaaagattaatttcacactcttttaatataaactatcacagtgctgcaggaggtaatacatttaaatatgtatgtgctaatgagtctgtgcttttctcattcacagagcatttaatttgtgccaaacaaagttctaaattcaggctactatttttcatcttaagatactacatgctttactcttccattctgttaagtaatgtgttgtgtttaaaattcagttattattaaaaaaacgattattattgctggtactgcacattgatacaatacacttgaggaaaattattttttcctcagaagtctgcagtgactttaaaaaaattattttcggaaaaaaatggagtagttaaattgtggtaaattaccatcgtctctagaatgcagtcctgggttcaagcaattctcctgcctcagcctcccaagtagctgggattacaggtgcacgccaccacattcatctaattttttctttgttatttttagaggagatgggttttcaccatgttggccaggctcatgtcgaactcctgaacctcaggtgatctacctgcctcagcctcccaaagtgctgggattacagatgtgagccaccgtgcctggcctagaatgcagtctttcttttttttgagatggagtcttgtgctgtcacccaggctggagtgcagtggcacgatcttggctcactgcaagctctgcctcccgggttcacgccattctcctgcctcagcctcccgagtagctgggactacaggcgcctgccaccacgcccggctaatttttgtgtttttagtagagactgggtttcactgttagccaggatggtcttgatctcctgacctcatgatctgcccgcctcggcctcccaaagtgctgggattacaggtgtgagccaccgtgcctggccccagtctttcaatttaccattctattgcccatatttttttctctatggaaatggaaacttctaactttgagacttgttttccaacttttgtggattaaggatgttttttttttctttcacgtaagtagagcctaaaatatattattttttaatgtacttgtcacctttccaggaactgaattcttgtttctagaaagaaaaagatagctttccaagttttctagcatgattatctaagttttctctaccttttcacttcccatgctgttttttaagctgtctttttaagtttagaattgaaaaacaggtttttctacattacctagcacatgtaattttatatctcaatggtcaaaataatataaaattcaactattaagagcataattaataagttatcctaatttgccagagttttagatcatattgttccctaaacttccaaaattgaactggtaatagacaactccatccccaggggctgttttccctaaccattcagatatatttaataacctgcatagtcaatcatatattttatttccctgtctcagtcaccatatctttgattcccagtcagacttggtctccattctttctacccttcccacttttctgctttacctacagaggcattatttaggattggttctcacttttatttttcgattgcaaccatacatttgagcacatcctgtatgtaatatgtttgttaaggaatgcggatgtttttcaaaatgtatagaatagaaattaggaaagccgtctgattaaactattccataatatgatggataactggttataatctgcttctaatcttcccagtaatattttattcttttggttgtcaatcttgatcattaaagattagaggcatcattgcttagaactaaatctctagcatctgaagatgttaacagacaatttttaccttccattttaccaggatggctttactcctctagctgtggcactccagcaaggacacaaccaggcggtggccatcctcttggagaatgacaccaaagggaaagtgaggctgccagctctgcatattgccgctaggaaagacgacaccaaatctgccgcacttctgcttcagaatgaccacaatgctgacgtacaatccaaggtacttaaagctgaacacatttgtggaaaggaactctttggctgccagactcctcctgggggatgataaagaagtaggccatggtgataatgcaaaattatttctggtcataaaaagagataaatgactttcagaggtatttcagaaagaaggggaccatctaaaaaaattaaatgcaagataattttctttaaaagatgaggttgagctttttagaaatctgctttcttattctgtttatagtcacaaataatagaatttaaaagataaaattgtattgtgtggtgcttggggatgtcttcttccagtagaatgcattttgccatgttggaacagtatacccaattgcagcgagcagattgactgtttccataattttgcattgtgtaatatcttccctctttcttccaaacaacactgcttcagatgatggtgaataggacaactgaggtacagtattgtggttataccaaaatttaccttgtctttatttttagtttttgcccaattggaataaatgctcactaattcatactaatgattagaagtttgattaatgggaaattaatttgaaaaccttccccataatgaaggcaaactgataattcaaagatatttagtgtaacatatatttgaagcattatttttatcagtaaaactatttaaataagttattagagaatgaaatgaaactctttcttaacatatattttaatgagtgagatttactattaacttattgtcaagaagagatatgattttatttccttaatgagaattcttaggttagagttttaaggaagtgaaaatttgggaggtttctctgccactgagttttgtctttttatctaattgctgttgccctttttttttctgtatgctctttttctttaccacatttatataataaatgatgttattgagcatatcaagagcagaccaattgctttttcttgtaagtcttaaaatacttgtcatggaattgtatattttccacattccaaagtaagtcacatcaatcaataagaacattaagttcagaagcctctcagtatggtgtgtttgtatatgtatgtatttagtagtctctccttggccattgctacagagagagacactaacacgaacattgttgatgtatattatacaaactaacctatactcaaaaacaagtgactttttatgtaggtccattattgttttgctgaggggattctttagactatcatctcgcttgatgactaggttgtggacttttgagcattctcacagggtatacttgaattatttgtgttatttcttttgttccctatcgttgcatggaacctaggtcagagacaacggaaagcccaactgcttggtgaacttgttcacaactggaaccgtacaaattgatatcttaataactaatttcaatacctttaatttcttagatgctttttggtgattatttaagatacatttttgaaagcagtattggctctaaacattgtgaaagcagaagtttgggtggatttttactgagttataaatatttgcttgaagacaatagagtaaaaagaagagaaaccccttcgtctaatcctgtagaaatgtgaactctgcctcctacttccatgttaatcagggaagcgttcctctgaagggctgataccagttttgtgctgatccaagattgacagcttggttatcattatgaatgatcagtgaggctgtatcagacaataagtttatttttgcaaatgatattactatatttaaatactttgaaaatgatccacccaccctcaatatgtttttctgaaactaaattgtaacatcagtaatagacacacactcagggtatgtctgtgtgacaggaaatatcaagataaacatgaaataaatttagtcaattatttcctaaaatatgaaaatttgacattttataaaataacagccaggttgagggctgattttcccctccattttgacatgaatattggcattatgtaaatgcaaaataaaaatatcttgatcatagataggggatttggattaatagtaactgttcttattttgtgtcttgcttctctctaagtaagaaattatttgtatctaatgttgctacagtaagagcacaaattttcattacctaaggtatctgagtgcttatttagggtgtttttaaaacaaagccaccaaagcctatagatcaactcaatagaaaaaaagttgtaattttgaaaatatttcttaaaaacaatacagtaaacatcgtagttcatttcaagtaaaagagagcaataccaagtaacccaaaaactgcaggatgtgatagccaaataacagtttctatttttcccataatcttttgttaagtagtgaaaattctggagagtaagaaaaattattagatctttgtgtactttaataagaaaagagttaacatgcttctattgcaaagatggcaacaattttcaactagattttcatcagaaaaagaaagaaaaggaaatatatttttttcatttgataatttcagacttattttttaaacattttgagagtaaacagttctgtaatgcccatatagttgatttaacctggttggttaaattacactttattgtattgataaaatttgtttaacattcaaaattggagtgagctgaacttttttcttccttttatattcctattgatgccacgtatattgtttaatttttgttttttaattatttcatcatgacaacaacataatcgtgctacacagttgtaaaagggtataggaatatcatgacagtgtaaatgatgtggaacaaattctatatctttgtaagaatttttcaacatattttcatgcttccaaaagtataatgtcaacaaatactgcttttttaaaacaaaaataaaacaaaaacactggtttctttgaatcttctctgaaaagacattaaaaaattcattgatatgttaatcctatggctgaaacctgatgttgtttaaacatattctggttttcttcaatatgcaaaaccaacttaagaaacattgttttgtataaacaacaaatctcataaatagataaatatttaagataattaaaaatatgccatgaatattatgccaataaatgtagaatatttatttactttttatatgtttagttatgtaccaccttataacattaagatttaagatcttactaaagcatttattattgcttatatattaggtagacttttaccatgtgaccttcttcactaatacaatggctgcaacatagaaaagtgaagcgctatactgactgtcatatctttgctttcatagagtggttttacccctttgcacatagctgcacattacggaaatgtcaacgtggcaactcttcttctaaaccggggagctgctgtggacttcacagccagggtatggattgaaatagtttctcattctagatagcagtaaatgaatattttaataaagtaaaaaggaacaccaatggctttcttaaagattttacttctttttccttacctgggtctgtgctggagatactagatttttcatttcctttctttaaatcacaagaagtcatcttggcttaagcagaaaataagaatgttgtaaactcatgcaaaaattatttccaatagttaaggatgacattcattctgaccagtatgaacagttatatttaacgatcatgccatgaatcctgataagtcacgtcaaaaaattattaaactgttaaaatgttaactataaaatatataagtagcatgtcttatgatgactgtagggcacacaatttgatagggaattgtttttaatgaattgagaatttgttcacatgaagtcttactaaaatacataaaaggtgtcacattgttacatgtttcatggtatgctgttattagaaagaattcacttacatgataatggtatatatcagtatacttaatatacagttaatgcagaatatgaatatacaaaaattacaacagacaaaaaatcaggtacatatccttgccataatgatgatatgtgatagccaataaaataaataaatataatttgtatgtataatgtttttgtactaagaagtcatctgcactgaaactatgttgtgttattttcaagctgtttttcttactgaattattctgaaggagacgtttgtttgttgttgttgctgtttagagacagggtctggctctgttgcccagggtggagtgcaggggcatgatcatggctcaccgaagccctgaactcatgggctcaagcaatcctcctggctcagcctcctgagtagctaggactacaggaacacactaccatgcctggctaattttttaaaattttttgtagcgatgaggtcttactatattgcccaggctggtcttgaattcctggcttcaagcaatcctcccacctcaacttcccaaagtgctggaattacagacatgagccaccatgcccaacttgaaggagatgtttttaagaatcatttttatattggatattaatacccaaatatttgtattctgtttttaagaatcataaaacttaagatgccagactctttaagtgcatggatgttatagaaagaaagactttacactagggccctatcttaggtagatttaaaatttttgtttctattacagtaaagtggtccctttgtctcttgactataacttgtacattcaatacatattttgtagttattgactaacttagttatgcagtttcattccatttttcattctctaactatattgttttgtggtttgtgtgatttttgttccttaaaaatcaaagacatagaaagagtagaaactgtggatcaaattaccacgtaggtcacaacttcctttgtggcctttaacacaaaggcatcgccatcatgccctgtcatacccaacagctcttgtttggtctttctgtggtgtagaatggaatcactcctctgcatgtggcttccaaaagaggaaatacaaacatggtgaagctcttactggatcgaggcggtcagatcgatgccaaaactagggtgagtgtctctgttctttcaattttctaccattattatttctttcaagcctcatagaaggcacctcaagacaccaggtcattaacataagcaatgtgttttcaaggaaattgctttattggaattgatttaaatctcatacaacatttaaagggttcataccgtacagtgaaattaatatttgctcataagtgcccagagaagcaaaatgttggtccctcaatgagatagtttttcaagttttggcttagtgattttctgggaccaaagatcaaagattaggcttacacaactctcttttgggtagttataagtatcaagaacccaaactaattaccatacattaagattgagaatgtggcttttacacaaaatattttagtacatgtttacaatcttttgcttctaagtattcaattcctaattcatttttcttaagcagctatgctatactgacctgagcaggggatttgctattatggagaaaagcatacagttagtatactatacctttatgtcattttggtagaagtgatagctttcatttgtttcaaacttaagtaaaatgtcatttcaagtttgcagtacaccccaaatagataacacaatagacagtagagttcagttgttaaaagtgcagaataaaggcaaactgcctgatttcaaatcctatttttactattaataagttgtattatattggcagtttacttaccttctctgaacttaggctaataataacacacctacttcataaagttgtgtgagaattaactcttaggtatattatttaccatttttgaaaaagcagagtaaattacctagctcttcataatatttgataatattactgacgttatataatatgtagttatttgctgaaacatgtaaggattatttcagtattaattatctggagtagatttggttaatcatagacttcagcaaaacttcaaatgtgcctataatacaaaaatgttaatatgtggtataaaagtctatgttaatatgtggtgtaaaaagcctatgaaagatgataaatagaatatgtctcttatggtattttacttcactttgtttaattctgagacttcatgttttcatagtcccagcagtaaagatcaaatctagtttccttgcaaatctgggggctagcaaacacttttgtttaataaactttatcatctgtaagcttccagaatctataccagtcccagactataaattatggtttttaatgacctcaggaaaccttgctttcttaatctcacttctctaaaacttttggtccagagtggctacatcacaacacgtgggagttctggagaggtttgcgttctgtcaaatctttgctgtggtgtccagtgtctttgcatcagagttttatatggtttctactttttgcttagtaggcatgcctttttccttaccatactgtgagtatacagaatttggaacagtatgcgttatgttgcatggtttgcttacttattctttctatttaaaggaatgagttttgcacattactacattactaacatcattactaacattaccaatgtattacattacaaacatactttactaacataatttcttcctatatactgcctttatgagattaccactggaaagaaagcattttggaaatgcaaaaaaatttttatcttggccaatgtcttaaggatgcacattgcttttattaatgctttttggagtattaactcattattaagatagttgactttgttcttattaatcaacagtatttacttaataaaagtactctaatttgtgtggcttacatatatttgggtatacaattaaaaagtctaactccaaatagacagtgtatcttcataaaaagagtactaagaaatgaagagaaatggattcttatactagttctgtcatagtgcagcctttagatacagcaaataaattaaatttcattcaaggatttaaaaagaataaaataggttttctaactgtatacattgtataaacattccattcatttattccttaaacaaataactattgagttcctacttggtgctgtgaaccctgaagatacgacagttaacaagacagagtaggtttctagactcatagagatgcaagtcagtagttcaaggaattaagttaacagtcttcttgtaaaagtttaataataggttcttaaaaaacaaaaaaacaaaaaacaaacaaaacccttgatttgtagcattacctttgctggtttccatggtgtaaatacttctacagtggtcagtttagagctagcaacttggtatcactaaatgtagaattgggaagaggtgtgcaaaaagtggctctccttatttcatatgagctggttccagcacaccccaggattagctacaatattgaatggttgcactgaacatttttatttttattatactttaagttctggggtgcatatgcagaacatacaggtttgttacacaggtattcacgtgccatggtggtttgctgcacccatcaacctgtcatctacaataggtatttctcctaatgctatccctctcctacacccgtcccccaacaggccccagtgtgcgatgttcccctccctgtgtccatgtgttctcattgttcaactcccacctatgatcgagaccatgtggggtttgattttctgttcttgtgttagtttgctgagaatgatggtttccagcttcatccatgtccctgcaaaggacatgaactcatccttttttatggctgcatagtattccatggtgtatacgtgccacattttctttatccagtctatcattgatgggcatttggcttggttctaagtttttgctatgtgaatagggttgcattgatcttttttagcactaaactttccccccataagttgaaatacttcttcatctgtaagtagaaggattttaaaagcattgttgggttcttttcattctggctacagctaacagacctatatccctcttactaaagacaaaatcaagtaggaggtaaatactgaaatcaaggactgtgggctggaattgggaggccaattctggaactataatatttgattactaaaataaatgaatatgttttgctttttcttttgcttttgaaatgtattcaaaaatagaaaaatgtttatattaattagttctcatgctgctatgaagaactgcccgagattgggtaatttataaaggaaagaagtttaattgactcacagttctgcagggctggggaggcatcaggaaacttacaatcatggcagaagcagaaacaaacacatccttcttcaaatggtggcaggagagagaaataagtgcccagtgaagggggcagccccttataaaaccatcagatctcatgagaactaactcactgtcacaaaaatagcatgagggtaaccaccccgttattcaattacctcccactgggtccctcccatgacacatagggattacgggaaatagaattcaagatgagatttaggtggtgacgcctaaatcaaaacattgataaactatatcaatgtttaatttggttttgactatatttttagagaatataataaagcttctacatatgaaaatttttttttttttgagacggagttttcactcttgtcacccaggctggagtgcaatagtgcgatctcggctcaccgcaacccccacctcactggttcaagcaattctcctacctcagcctcccaagtagctggaattacaggcatgtgcctggttaattttgtatttttaatagagacagggtttctccatgttggtcaggctggtctcaaactcctgacctcaggtgatctgcccgccttggcctcccaaagtgctgggattacaggcgtgagccaccacacccggccggaatgtttttaaagtattatgttttcattttgttgttgttgttgttgttgacatctcaatttcccccagcatttaaattaaccacaaatattctgaatttagtatattctgtcaaggatcttgccttgatcttctcattattttttctcattcataaggtttttattatctagagaatagcaagatctagagaggctttcagataattaagaaacaaatattacccacagttatttcttggctctcatcaccattttggcaatcattgaggcattttccatcttgttggcattctcatcattgactactatctaatgtgaaactctaagacatttgcaccagagccttttactggtatctgaaagacctcatttcaatgtgaaaacgtaaattttatagctagtgaaaatgaaattataaatttaggctttattaagggcattattctttttttgtttttaagcttatttattatttaaatgtggtgataccgcatattaggattatgtttaaaatattaaaaaacatatttcaaagcaaacaataaaaagtgtacaaaaacattaaaggatgatgaacaaaaaacacacagggaaaaggaatcacccttcttacttgttattaggtataataattaaagcagtaacaataatggttttcaattgtcatatgcatatgttgttctaggcaccctgctaagtactctacaaatatcatcttattttatcttcctaacaacttatgaagtgtgtattattttcttgttgagaatatatggaggtcttcatttgagaaatgagactaccaaagggagaaattagtttcagcagaattatgtaacttgacctaggacacagaactttgtaatcagcagagcctacccatgtattcacacaaacttcagaatacattgttgaaagaatgacctaagcagagagggggaagatatgaaaagataaagaaactacataagtggcatccctccaatgttgattgatctacctttatgaaaattatccacatcatggtgtatagtacatccgtgtgatgaactgattctagagaaaaaaaaaaaaacaacaacagagaaaacacaaggggtctctggaagggggaaaaacccataacctgcaactacaaacttaagaatttaagtaaaaagattttagaatacaaaagcttgaaaagaatttttttggggcattaactttataatgtgctttgcagaaaatattcaaaatctaatcaaattgagcctgttgggtaacttgaatttgatgtcatcattcacacatcttataagcacagacaccttgcatcattaaatgtaggatttagaactaatttaatccttattgttccttgatgttcttgtgggtatattaaatgttctccataaagctcctgttgttactctgagagtattttggatgtttcaacatgattacacaaagactatttcatgcaatttgcagaaagcaatactctgccttttctaaaaaacatgtaaggtgccattccctccttcatctttcaaacaaggcttgcaagttaaatagggtgagaaacatcatctccactctatgtatcacgaagctcagccttagagagattcatccatggtgaccgatttgagattcactgcagggttccatggttccgaagtccacacactgaactgttacatatgatgtctctgttcaccatgtgggatttctcaaaccctaggtctccacaaagccctcaccaagaatacgtttgagaaaccatgctatatctaattgttaggtaagttatgtagcaactaatgctctgtagttccaccacagggtgcttttatcaggatacaaaagtgtaatcattgtcatcactttgctggaacaactctttaaggctcctatctggcaaattttaaaataatgtagcatttcaactacactagctaaatactttttttctgagaaggcaatcttttcatgctaattcttaggtacccaaaactgcaaaatctgttttggttattcaatatcttcgtactagctaaatggatttcacaaagcaaagaatcattatcagtcaaggtcctagccaaaaacagaggcccaaatttgatcatttgattagagattattgaagggtctatttataatattgtgtagtctgtaggaaagagacaagggacaagggacagtgtagaatcccaggggctagtaacagcgggactcaataccagtgctcaacctaaaaagtgagaagtacaggagacccccagaacttcaaaggagagaattgtgtggaaaggctgctttggcaggaaggtaaactttcgtaaagacacacagccggatttgggaggtctctcgaagtccttttcatgtcttgctgcattggccaaacccagctggaagccagaggacaaggcagctcactgatgccccctacagtggccagtctgttgggacacagagcagggaggagaagggtagagcatgggtctggaggggcaaacagaagacatctagcatagaaatctccgtgttgagtcagagtgttgcgattcagaggaattatttttatttggagtaaagcataacctggagagatggtcctggaagtagagacacaaacgagaggccatttgagttctggataaatcagaaactgctgaaatcttcttaattgctcaccatccattctctgtgatttatccaccttctccacctctgtccttgggacaatctttttttctttttccttccacctcaaatcaccagtaaatttaagcactcagtatttcattttctctctcacttcttgctcactgttaattacatttcgcctcacatttcccacccactctgctttttgcccatgccaccctaaagagaaataaaatataaaagacagagggcacttggggattgctctggaatcagaggctatcccagaagtgtaaagatcagaaagttttataagtaatatagcatacagttctgccatattttatttgatggagttagggttctatttattaataataaagttcatctttgggaagcaattatgtgatttctaaaatgttgaaatatatgtgtgaaaatctttaaaatagtctaaaaaatgatgcttcacttttgcaagcattaggaagcattttagaatttatgaaagtgatgacaattcaaaagagaacatatgtgaaaaaattacgctaagaaaaatttttaggtaaaagtatattagaacaaacaatatgaagacagtataacctaatataatccctgttttcggttccagggagtagagctttaaatttcaacaaatgccacatactgtgctttcccatcttcttgaatacgcagacacatgaccagaagccaatttcattccattgaccctctgtccacacaggggatctctcttgctttctccctgtctctgttttgtttgtctttccctttctctttcttgttctctgtgaagatgtacttctgacttgttttctctttcactcatctttctggttatttaacaaattgcagttctattacttatttattgagtaatcaggattgagtttaggaactccctctttatggttgcaatagatgaaatatagatttttttgaagtgaacttgggcctaattctttaattcttttggcaggatgggttgacaccacttcactgtgctgcacgaagtgggcatgaccaagtggtggaacttctgttggaacggggtgcccccttgctggcaaggactaaggtgagtcattatgagtaagatggggtcctaagaaatctttaagttacttgatgtattatctctattcttttttaaattgaaacatcaggcaagcattttctagttctttaataattgtgtgctaggaataggaatatgtatcaaaccacttaaaattattaaaataaacagatatatgaattaagatgtattaaatgtgtgccttcaagtttttgtctatatttttacctgttattcttactgcagatggaaatctgaatacatctgtattttaaatataaatgagaatatctcttagatgctgagtctagatttttatgattctctcagatgactatgaaacatatataaaattatcttttaaagcagaacaattagcaacacaaaatgaatctttttgctcatccaatctttatctcttaggcaatactaataaaaagtaattactcaacagtggcattggttgattatgttgaagattagtagaggtgatttggaaagtacaagttgcaataggccacctacaaagaactattaagcaagcatattttctttatgacatactacatctagccctttttcctcccgttttatcaatatgctcaaatatgggagaagcacttttccatatacatgagcaccacactgtgagttggtttgctgaagatttttcattatcaaatgtattttaaatgcttttattattgtatagttctctattatccaaccctacattgggttatcagaaaatattttgagacacgaattggagatactcatacagagctgattaatgtgatatgcagcaaccttggatccttaaatacaacacaaagttagacaaagggcagttgttgtattttctccctattccattccacctcataccaccgcccccccccccgacagagttggtatcaactaatgctattactagggtaagctgaagaaactaaggcaattgacacaaacaaatatttttcaatttatatataattgaaatcatttgaaacaaaactagcccatatgtttaagatatgtgtagaatgaactcaatttgtaaaggtgtgcccacatgccataaaagagtggcttcaaatcagtaatatatgaagaagagaaataattatccgcgttacttttattctcatacctatactgtgaatgttgtatagatctgtctttaaaatgcaacaatttgggctgggtaatgcagagataattatgtaaagttttgataaagaaacgttgaaatttaaatggaaataacaaaatttcagaccaatcatgttacagccaatacaaaaaccaatatgaagttgaaaataggcagatatgctttacaaaccgtaaaataatcttatctgcagagtttgcttgtaattgtcatgtcactaatgaagatggcaggttacctggatggaatttttttaatgtccttcctgtaaaatcaagtatcattcaaatgtaaggatcctgcataaagtgtctctgagtgtacaattatgttcatgtattcatgcatccaactattatataatattgagtagatacaatttgccaggcaagtgttctagtcactaaggcaccatcaagatgaataatacaaaatctttttttttttttttttttttttttgagatgcagtctcgctctgtcgcccaggctggagtgcagtggcacgatctcggctcactgcaagctctgcctcctgggttcacaccattctcttgcctcagcctcccgagtagctggaactacaggcgcccaccaccacgcccagctaattttttgtatttttaggagagacggggtttcaccgtgttagccaggatggtcttgatctcctgaccttgtgatctgcccatctcggcctcccaaagtgctgggattacaagcatgagccaccacgcctggccataatacacaatctatagctgcaagaagctcagaaattagtgggcatgatagaaaaaaaaagataattataaaaaatagagatatgtatagggtaataaacacagagaagatgaattaatcaggttagagtgaggggataccgctctcctgggagtggaataggtacctaatgctagactattctccctccccttctgtattagtccgtttcacgctactgataaagacatacttgagatgagactgggcaatttacaaagaagtttaatggattcacagttccacctgaggaggaactcacagtcacgaggctgaggaggcttcacaatcatggcagaaggtgaaaggcacgtctcacatggtggcagacaagagaagaaaatgaaaacccagtgaaagggctttccccttataaaaccatcagatcttgtgagacttattcactaccacgagaatagtttgggggaatccgccctcctgattcagttatctcccactgggtccctctcgcaacacaagggaattatgggagctgcaattcaagatgagatttgggtggggacacagccaaaccatattaccttccataaaaactcctaggtttaaatcacccattctttcttctgaagcaactatctaagtgtcaccccctcattctttgtcaattctagctctcagcaaactgtgactcctcaccacaaccccttcttattcttgctgactttaatgatcttgattagagcagtagataattcttctagttggcctctcagttaggtaactctaaaccctctatctatttctgtgtctaacttcacacttgccagcccctcctatgtttcagctcactctcttcagaaccccaattccgaaattcttttattctgctgggtccttcagtcatagtttcactcttcctcattcacatcatgcccttacctctgcccagcacaaatttcatagtcatttatgctactcccttacgtattcatactacctgcatttcactcaattaaattcaactcacattcatgcaatcaaatgtggctacaggaaacacccagccacactaactgtgctcattttagattcatgatcactaacctcaagtcagctggtaatgctgcctgacaatctcgctctatcttctaagtctattcactctcgatccctgctatctgaccattctatattttcttcaaacttatgtagacttctttccttgtcttcatttcccataacactgagagaattcaagcaattggaagataatttccagagactcccacctccatatctatccatatctatccagtgacatgacttggagcccatgtagtctacattctctcccgttactatcatctggtgtgattgcttggtcctgtcttctcaaaacactttctttatttactttctgggacattacattcttctgactttccttctgttttcctagctgccacttctcagtctcctttactagttcctcctcatctctcaggtctctgaatgttagaacctccagagctcagtctttgtatcttttctctatcggcactcacttactatgaaatctcatgcagttctatctttaagtagtacctgtatgctggtgccacgagtgtacatctccagaattccgtatgtagatgtcagctccccattgccacttggatgtctcctgggcatctcaaatttagtaagctcaaaattaagcactggatataacacccacccctcaacctaatcttcctgttatccttcttatctcaacaaatggccatctaattttttttagtttctcaggccaaatacccatgtcatgttggactcttctttttctcactttccacattctgtcaccaaacactgtcacctcttccttcaaaatgtgtcactaattcagcagcttgccaacaatctcattactaccactctggtccagatcaccatcaaccctacctggaggactgcaagaggcccctaattgacttcccttcttttgcattctgtccatatggtctattctcagcacagcagcaagagtaatcctgttgccctaaaccttccaacagcaccccatgtctctctgagtaaaagtcaaacctgcaaggtctctcacctctttgaattcctccccttatccatcctcctcaatcacttgccttaaaccacattcttctccttacgattattgatatcgatcatgcccgttataatcccaacacaatatatttgcacttgccttttctaagcctcaggtgtttttcccccaagtcaacaagactagctctcttacttccttcacgtcaaaactcatcttctcagtgaggccatttctggacatcctatcaaaattgcactcacgtacacaaactccctaggccattcggtgtttttgttttctcctttccattgatggccatccaatatactatatactttaattcttattgtttttaaattgtatgtctgtcttccacactagaatgtaacctcgatagagacgggggtttcctgtctgttgtgttccctgctgtatccacagtacttgaacagggcttgagtaggtgctaagtaaatatgcgtaaaatcaacaaaagattagatgatgaatattttattttccacgtaaataaccttcaaataggtaaaacagcatcaatgaatgttaatttttcaaagaaacatgcaacactccagtccaaacgtcatcaagccttgaatttcttctacactttgcaattatcttcccctcaatgcataaatacttctcatcagcctgttgctgttttctaaacttatttaatgaacttctaaacatgaaagtaataattatgaatgaagattatttcaaaatatatgaataatttataagtcacatatactctaccacaattaagaattaatgtatttgtttttgttgtccctcactgttgaaatcaccttccttgttgagaatattgggcggggggccttttctggtaaaatatccagatacaatttctgctttgttgaatgtaatgactgtcaaactggatacttggcgaacaatcctttttctagtggccatatttgcattggtattaataaaagacaatagtcccatctctttaataggcaaattgttttttaaaatttagttttttcctaagtttacatattgtttcctgaaagtttatttatttagctttaaaaaaaatgagagtcttaccgagtctgatgaacagtgcattaccctgctttcttgtgttcctgctgttgaccttactctagaattaaggctaaagctgttttggtccatattaatgaagacaaatttagattatcctcaactgtaaaagttgtgaggtcattggcacatggcctacatttgcctcacactcttctagcccttacctacctgttttctccaagtccaattcaagtagtctcctaatactataggtaaaaggaattgtaaaatttcagaggaacatggatctaaaagatggtcaaagtttccatacctccctgacctgcccacttgcttctcattcacccacttccctctgtatttataagaaatgcaggcagagagattaagtgaatgcagactgctatgcatggagttggatacaaataactgaagcattaggtattatttatttttctgtatttaatattgccctaataactgtaaaatcaggctaaattgccacacataccatgcatgacagacatactaatttgcatttttgtctatggtagcataattatgaaattaaattatctcttagtgttcatctctgcgaaatatagtctgctgtatattctgatgtcaaatggaaattattttttcccctgccactaactgtgttagagatcaagaatcaactttgctgtactttggaacctgaaaataatgaaaaaaaaaaaggacattattttgttttcttttaatgtgcagaatgggctgtctccactacacatggctgcccagggagaccacgtggaatgtgtgaagcacctgttacagcacaaggcacctgttgatgatgtcaccctagactacctgacagccctccacgttgctgcgcactgtggccactaccgtgtaaccaaactccttttagacaagagagccaatccgaacgccagagccctggtaaacttggcccagtccacattaactgaatacagattgagacaaacaaacccacattcattgaccaacatgcatacaccagcaatgcaaggttacagatatgtagttaatcctgctaaatttgtcatccttcacaatcagcctgtgtacttcatacattcatagtttgttagcaaatgctggtgagcaaagatgtatttaagagaacaccaatgtaacatttctgaaactagtgagttgcaaacagatagatatgaaacctttggagtgataagcagttttaaatggaaaatagaagttgaaaaataggaaattacaaaataaattctagatacctctagataaagttagaacacgagtatgaaaagttgaatttattaatctctttttggaaaaaaaattaatggtgaatatatttgactatgtaagggggtataaaatgtaagtctatgcagagttcaattgaaaattttcattgttgacttgattactcaaccataggctaatagaaaagttatgcctagtgtgttacggcttcagggagcattttatatacaccatttcaggaactgctcaagagaaaactgcaagaggctgtccctagagcagctttatgtctccccagttctgatattgaataagtcttccttgcttcacttattttctaacaataatcattggaagtattagacatgtactaatttatgcctcttgtgtcctaattcccaaactaaaagtaaatcctttttttctatgtgtttacatggtttgtgtctgttaaaattggtcttcaaacaatcagtatttaagctgagagaccatcattagaatcatcaaatattaaatatgatttttacaagaatttttccattggaatcaatttattgataattacgtgggaagtgaatatattttccagattatatgtaattatgtgaaaacattcattttgtctagggagtcaaaaacattaatttttaattggatagtggtcaataagcttataaaatatcacagcctgttaattgcaaatattttaagtgctgcatgtgcatgtggctatttatatctggcatgttgtatagctcataaacaggggaaatgacctaaccaattaattatgtttatcactctattgtgaaaaataagaagtcatcagcttaagtaagaccatatgctttcctgagaactgctagtgtgtaaaaacgttgactgatgattggtccatgttgggacatgcgaaattgttagctggcagaatagacataacaaaggaacattgttgaaataaaaaaaatatataatacacgatgagtaagcaccgggccatttaacatattttacttaatttgccccaattcctgggcattagcctagttcgccaagttagaaagtacctgacagacttcttctccacatttctttaccccagagctacctccttgcatttatcccagaaattctccatacatttcttgaaaatattcgagaacttaacagtcatttctttatacaataaaatttatctcattggcatatatgttataaaaatgatataaaaatatagcttctgtatgtaaaaatgatcaacataatgatttctgctgactagaaatatgccctttataaagaaagtcgtagcaaagttgaaatatttcttacaaaggcagtatattcttagattttttaagtagatgaataattcttatgctctgagaaatggcccttcagaagaatatatgcttatcttcagttcatcttcaagtaatttaataaccaggacaatcaatataccttaaaacatcttagaacttctaaaatgtaattgcttctctgtttttctttctttaaagagaaggaccatgtatttttcttcacttttgttttccctgtaaccacacaaacagaattacgtacaggcccaccacacataagtgaagttcagtgcctacaggaacacatcaccatttttctttccaaattccaacacctgcagggattgaagaaatggtaacattatgtgacgatgtaacattattgcctgcaatgtgccagcatggagttgtgtgagaattgtttctgcatgttttcaactaacttgattgtcttttgcacagaatggttttactccactgcacattgcctgcaagaaaaaccgcatcaaagtcatggaactgctggtgaaatatggggcttcaatccaagctataacagaggtagaaaaatgttttagctagtcacaaagcattccttctcttactccttcctccctttcctttttctcatcttctgtcctcttcactcaagttttatttatctgaagaagccccaaagccccaccggtgcagaggagtaaaactgctgttgctttgtttcgcagtctggcctcacaccaatacatgtggctgccttcatgggccacttgaacattgtcctccttctgctgcagaacggagcctctccagatgtcactaacattgtgagtatggcttgggtcagaataaccccagggaggaagagcgagaggaacagagattgtgggtgtgtgtatgtgtgtttgcgtgtatgtcatcgaagtaagcaaccaagctttgagaagggcccttgtaataacacattattgaaataatcaccagaacttcactgaaaagaacctggatagggtaagaggtgttataaagtaaaatggaagctatgaagtgagacagcttaagactctgggtgtaggtggattgaacatgcatcttaaatgcatttattaaaacaaaatacattttaaaagctcctctgcaagtgaatggataattggttcgaatagaatctttagggctcaacctagttgcttgagggaattgtattccaggcaattttcacaaaaacatcaaatcattaccataattaaccttaacaaaagattaaccagagatagatcaatatcagagacttttacttcatgtcaaactcttccttcttcaattacatggatttcccattttgtaacattacgttgatttttacttttgatttgatctgatttgctagagtggaggcttctcttagctgaaagttataccacatatcctggaatgaatgttggtctccagaccactttcattcaatcaacaagtactggatgtctcagaatttttctatgtaatctaaattaggattttcacttctaatttctttgtatatctctcattttcttggattttccccctttaaactttggtcattgtatcaggataaatcattgaatgcaaatgttctcctgagcaagagaacttctttgcacaaggtgcaggcatgtatttgaagttcaagaaggtctagtagagtattgagattcacatgtgcaccagaaataactctctcaaaataaataagcttattattaaaatgagctatgttgtcaaaagcaattgattggcacttgttgctaatttttggcatctcattccatttaagctgtgaaagagaatgtccagtttcactttttatttgtattctctctcatatttctttttttctgtatttcacacaccatttccacagtgaagtttctgatggctaggaaaatccattgtgagaattaattcaattgagtttaaaaattatttaatactctctcttcatgttattcagtaattggagcataaaatcattgaagaatttaaagtctatatttataagttttcttaattatagcttattggtcctaaggtcataatattatatgctaatctttatttactccattagacatgagagtaatttcacaatgtgccaacataagtttaatttctagtcacttcttagaactttaaaagtaatcatcatccccccccttttttttttgagatgactacctttttttttcttttttttttttttaattgagacctgaacagatttacgtacaggccagtaacattaaaacaaaaaacaaacaacaacaacagcaaccaacaaaagaaacaagcaaacaaacaaaaaaccgctgtgttcttgcccgccttttccttttttatctccacctattcttatttgcattccaatgcttataggatcagaggagcaatagtgacactgttacaatatgttatcacattataatgataacatgtacaagaatattctgtgggttgcttgattgcaatcccctgaattaatctcttttagtggagacttttacaaactcttcaaagaataatccatataaaatggttgtggaatttgtggccactcttactttgcttcttcactgaccaattccaaatcttcaggtggttatggagttataatatactcccttctattaaaaaagttatatggggtacatgtatattttcaaataaaaataaaatattaattgaaacaaacaattttgacatatttttcaggttgttgaagactttcaaatttgacaatcattatattaaacttcagcttccaactgttggtcatttaaagttcttcattttatctgttcatttgtccattatattatctttccatccagctccctcaaaacaaattcttgaggggcacatgccaatataatttccgtgttttctagttatgttttgtaaggtaggtccttcaggaagcagatacctattgatagggttgccaggtaaaatataggactctcagttaaatttaaatttcagatgaaaaataaatttttatatatgacccatgcaatagttaagacatagtaaaataattatttgttgtttgtctggaattaaaatttaactggctgtcctgtacttttaattgctaaatctggcaatcctacatttagaggaatttaactttctctagcagtgggatgcctgtgaagttgtgttttctcagaacatgaggatatagctactggatccaaaattctttgcaagttgatgaagaaaccgtgtgaacgctgactgcctgcttgctgtgtcagagttggtcacttcctgaccctaaaacaccccacccttggagcctttgtgtgttgcctgaaatcatgttgcatttttgaatgcaatgctgtttgttgtgcttcgatgcttttcaacttgatgcgcccaaagtggaagtcaatgtagccctgtcagcagagtcagttttaacaactgagaagagtggcatgaaatttagtacctgctttggacatgagcatacccattctcttgctagttttgtttttgcctgaaaattcactccaagtgtgaggtgtaccagtaactcaatcacgtatagacattttttttttaactgaaaatctccttttccagaaggtttattaatacgctttgaaacttagaatgccgaactgccaattacaacacatccataatccaaagtattcatcaataaccataggaatagaaaactaagcattttaacaactatcaagaaagaatgcaaggtcttacaaagttttatcttccttcccataagaaatcagtggactaatggtaaagttcacacattatattatgcttaaaaatttccccgaatccttaaatttcattagcttgagataagaaagacaaggctattaaataaaatagggtgcctgacaatcaagacatggaaattatttattacaacaatatatcctgattttcattttcttatttattcttatatataaacaatggtaatattaacataaaagactaataagggcaacttacagtagaagtccattatgccagaggtgttagataataattaaacaagaccattattataaagtggagagaccatgtgtgtgtttatacataacctttgtttgaatttaagccttagtgctttaaattagattctatatctaactcatcaatttcaagtgtgtaaaacccataaaaaaaacttaagtataaaataaaggttttagaaatattggccagtattggaaacatttcagattttgaaagccccttattgataaagcttggcttaaaaaataaacatgaaggccaagcgtggtggtggatgcctgtaatcccagctacttgggaggctgaggcaggagaatcacttgaaccaaagaggtggaggttgcaatgagcctagattgcaccactgcactccagcctggggtacagagtgaaactttgtctctacataaataaataaataataaacatgaaaatttgtcattacataggaattcctgggacctctttgacttttaacttcttatacagaaatttattcttatcatcatttctaccaaaattagtaaaattgctagccttttatcagacctagaaataacgtaaagatttgaggagtattgtttttgtttttctgagacacgaccttgccctgtcacctaagctggaatacagtgggcaagattatggctcactgcagcctcaacctcctaggcacaggctatcctcctgcctcagcctcccaagtagctggaactacaggcatgcaccactatgcctggctaatttatttatttatttatttagagaagagatcttgctatgtctcccaccctggtcttgaatgcttgacttcaagcaatactcctgccttggcctcccaaagtgctgggattacaggcttgagccactgcaactggtcttgttttgttttgtttgaataccatcggccctctgtatcagtagcttctgtatcagtgggttctaaatccatggatttaatcaatcttggattgaaaatatttgaaaaaataaaaataaaaaactacaataaaaataacaaaaaattttaaaaagtacagtataacaactatatagcatttacattgtgttaggtattataagtaatatagagctgaattatacaggattatgtgcataggttacttgcaaatactacaccattttatataaaggacttgagcatccatgtattttggtattggtgggggaaacaggaggcctgggaccaatccctcaccaatacagagggacaactgtagttagaagattttagccttgccgggcacggtggctcacacctgtaatcccagcactttgggaggccgaggcgggtggatcactaggtcaggagttcaagaccagcttgaccaacatgatgaaaccccatctctactaaaattacaaaaattagctgggcatggtggcgggcacctataatcccagctacttgggaggctgaggcaggagaatctattgaacccgggaggctgaggctgcagtgagccgagatcatgccactgcactccagcctgggaaacagagcaagactctgtctgaaaaaaaaaaaaaaaaaaaaagaagatcttagcctcatctatttagagacaggttttaaatgatatggaaaacaagttagaaatcatgattgtctgtccagggaggaaaaatcttgtgatacatctaaagtctgaagataaatattagcattccaatgatacatcgttttataaaacaacatactccagatacatttactttacaaaagtctaaatctgttatcagaaaataagcccattagaggataaatgagtcatcaacaaagaagagaaaattagagtagatatccaatttagtgctttcacaatcaaatcatttgacatgaatttctcataacttcaaaagaaatgggtctccaaaatactgagaaaaaattaactgtgaactatgtgccaaattaaagttcaccttaaagtttctagatttaagggtttgttgtacaaggaatcagaagaaattattctctgcagtttgtcaattaccacaaccaaatttaaaatcaaatttagtttatttggaatggtttactttacttggttgaaatcatccttatcttctagaacagttgtggtaaatcaatctgtaataatttttattccaatatcttattctaactgtaaaattacttgagtgaatgaaaccctgccttctttagaactatatatggttttaaaatatgctgatttttaaaaacctctctcttagagacagtagagtaataaccggctacttgatgagaaaattctcttaatcaaacccttgttcttcatgctacacctaaagccaccctttcctgacaaatgtgtcatattttggggtagaacaaagatacctgaggcatgatgcatggcctacctcaacagatgacactgctgacagtcactttattcatctttcagtggctctctcaaataactgtctataattaaatatgctcattaatcttaaatagaggacctcctgggcaaatcaaatttcttgtctgatccatttttgtctagtctcataacacaaaaaaatcagatacaaaataatattttatttcagaaggaaattttgaatcttgaaatgatttatttatggtataagtggtattaattttttgcaacgtgttgatcttcagcatctagtttctcactgaaatagattcaagttgtgatcacatagttaagtgagacaatgacagatttttaggtttttagggtaaaagaaaacttcatcaccaaaatcaatttaaagggatgcttaagctgctgattgtgaagtgaaacaactcaagagtatcctggatgttcggataaatttactagtttttcatggacttgaaaaaataaaataaacattcgttttatccttataaagatggagaagaaaaatacaaaaatcagctgggtgtggtggcaggcacctgtagtcccagctactggggaggctgaggcaagagaatcgcttgaaccctggaggtggaggttgtggtgagccgagatgttgccattgcactccagcctgagcaacaagagtgaaactttgtctcaaaaaaaaaaaaaaagatacaaatctatattttccagactaaataattatgccttttcataggtttcttaaatccttggatatattgctgaatttcacaaaaagggacaactttattctttaccatccagagcggtgggttaatttatgatttgacgatctttgttccctggcagcgtggtgagacggcactacacatggcagcccgagccgggcaggtggaagtggtccgatgcctcctgagaaatggtgcccttgttgatgccagagccagggtaggtactggtgccctgaggttctcttctatcgcagcgcatgagtttcatccttaagagagggtgttgcccttcagttccttgatttggaaataccagggactgtaagtgaaaggatcaattcaatagcagttttccagaaaaaaaaaagaaacattatttaagcaattacacacgacgaaaaatgcacccaaatttcagaaacattaacatttgaaaaaatgtaaaacttatcatctaagaaatacatcgactgatattttaatactgttttaacctcggaaagcactttctcatatctctttattttcatgaattttaaaatttaacctaaagtatttagatgctatacatattaaaatttatttcttaccacttaaaccaatcacatttccacagtcatccctcactagttacataaaatcaagttattctccaagttttagtgtttttccttcatctgtttgccttccctcctttttatgatatttacttttcttcttactctgattttacaaatttagacattctgtatttccacagttccaaaatagaatttgggcactgaagattgcttgatcagacttgtcctgtttctaatagcttgtaattccttcacaagtttctttttccttctttttctgtttttaaatcttactttccaatttattttctcaccttcctttacattgaatacaccagaatgcactgaatacactatcaatatactgtaccttctatttccttttccatgtggtttggttaacttttgcactgacatcattgagattctcatgttaaataatttccctccttcttcaatatttgatatacctaagttagagctcatttcagtttgagttgtaccattataatacagtgttatcttggaatgaaagcatctggctatggtcatataaattgtaagtgatttcaggcaggtcacttcactttcaagtctttctttaaattattattatactttaagttctgggatatatgtgcagaatgtgcaggtttgttacataggtatatatgtgccatggtggtttgctgtacccatcaacccgtcatctacattatgtatttctcctaatgctatttctcccctagccccctacccccgacagtctccagtgtgtgatgttcccctccctgtgtccatgtgttctcattgttcaactcccacttatgagtgagaacatgcagtgtttggttttctgtttctgtgttagtttgctgagaatgatggcttccagcttcatccatgtcctgcaaaggacatgaactcattcttttttaaggctgcatagtattccatggtgtatatgtgccacattttctttatccattctatcattggtgggcatttgggttgcttccaagtctttgctattgtgaatagtgctgcaataaacatatgtgtgcatgtgtctttatagtagaatggcttataatcctttgggtatatacccagtaatgggattgctgggtcaaatggtatttctggttctagatccatgagtaattgacacattgtcttccacaatggttgaactaatttacactcccactaacagtgtaaaagtgttcctatctctgccaggcatggtggctcacctctgtaatcccagcactttggaaggctgaggtgagcagatcacctgaggttgggagtttgagaccagcctgaccaacatggagaaaccctgtctctactgaaaatacaaaattagactgctatggtggcacatgcctataatcccagctgctcaggtggctgaggcaggagaatctcttgaacccgggaggcggaggttgcggtgagctgagatcgtgccattgcactccagcctgggcaacaagagtgaaactctgtctcaaaaaaaaaaagcattcatatcctctccagcatctgttgtttcatgacttttaaatgatcaccattctaactggcatgagatcatatctcattgtggttttgatttgcatttctctagtgaccagtgatgatgagctttttctcatattttgttagccacataaatatcttcttttgaaaagtgtctgttcatatccttcgccgacttttcaatggggttgtatgttttttctcgtaaatttgtttaagttccttgtcgattctggatattagccctttgtcagatggatagattgtaaaatttttctcccattctttgggttgcttgttcactctgatgatagtttcttttgctgtacagaagctctttagtttaattagatcccatttgtcaattttggtttttgttgccatggcttttggtgttttagtcatgaagtctttgcccatgcctatgtcctgaatggtattgcctagttttcttctaggatttttatggctttaggtcttacatttaagtctttaatccatcttgagttaatttttgtataagacgtaagagaggggtccagttttagttttctgcatatggctagccagttttcccaacaccatttattaaatagggaatccttttcccattgcttgtttctgtcagatttgtcaaagatcagatggttgtagatgtgtggcattttttctgaggcctctgttctgttccattggtctatatatctgttttggtaccagtaccatgctgttttggttactgtagacttgtagtatagttcgaagtcaggtagtgtgatgcctccagctttattctttttgcttaggattgtcttggccatatgggctcttttttggttccatatgaagtttaaagtagttttttctaattctgtgaagaaaatcaacggtagcttgatggggatagcattgaatctataaatttctttgggcagtatggctattttcacaatattaattcttcttatccatgagcatggaatgtttttctatttatttgtttcttctcttatttccttgagcagtggtctgtagttatccttgaagaggtccttcacatcccttgtaagttgtattcctaggtattttattctctttgtagcaattgtgaatgggaatttactcataatttgcctctctgtttgtctattattggtgtacaggaatgcttgtaatttttgcacctggatgttgtatcctgagactttgctgaagttgcttatcagctttaggagattttgggctgagatgatggggttttcaaaatatacaatcaagtcatttgcaaacagagacaatttgacttcctctcttcctatttgaataccctttatttcctccccttgcctgattgccctggctagaacttccaatactatgttgaataggagtggtgagagagggcattcttgtcttgtgcagcttttcaaagggaatactttcagcttttgcccattcagtatgatattggctgtgggtttgtcataaatggctcttactattttgagatatgttccatcaatacctagtttattgagagtttttagcatgaaggggtgttgaattttatcagttttttctacatctattgagattatcgtgtagtttttgtcattggttctgtttatgtgatgggttacatttattgatttgcatatgttgaaccagtcctgcatcccagggatgaagctgacttgatcgtggtggataagctttttgatgtgctgctggattcagtttgccagtattttactgaggattttcgcattgatgttcatcagggatattgtcctgaaattttctttttttgttgtgtctctgccaggttttggtatcaggatgattctggcctcataaaatgagttatggaggagtctctctttttctgttgtttggaacagtttcagaaggaatggtaccagctcctctttgtacctttggtagaattcagctgtgaatccgtctggtcctgggctttttttggttggtaggctaattactgcctcaattttagaacttgttattggtctattcagggattcgacttctgcctggtttagtcttgggagggtgtatgtgtccaggaatttatccatttcttctagattttctagtttattggtgtagaggcatttatcgtattctctgatggtagtttgaatttctgtggggtcagtggtgatactcaagcctctgtaatggcggacgcccctccccctaccacgctggagcctcccagattaacttcagactgctgtgctggcagcgagaatttcaagccagtggatcttagcttgcttggctcccctggggtgggatccactgagctagaccacttggcttcctggcttcagccccctttccaggggagtgaaccgttctgtctcactggcgttccaggcgccacggtggtatgaaaaaaaactcctgtagctagctcaatgtctgcccaaatggcatcccagttttgtgcttgaaacccagggccctggtgatgtaggcacccgagggaacctcctggtctgcaggttgcaaagaccatgggaaatgcgtagtatctgggccagagtgcaccattcctcatggcacggtccctcacggcttcccttgcctaggggagggagttccctgaccccttgtgctttccaggtgaagtgaagccccaccctgctttggcttgccctccatgggctgcacccactgtctaaccaatcccagtgagatgagccagatacctcagttggaaatgcataaatcacctgccatctgtgttgatctcgctgggatctgcagatgggagctgttcctattcagccatcttgccagcctccggccacttccaagtctttatcagtaaaatatgagggttggactcagaaactcaaaactcctttctagactttcttaacattctttgattcaatgaatttaatagacattttcttgtaacaggttccacagatcttcatgcagaatccagtgatacacgggtagccttaacattactcttgttgtcttggttttcatctgcctttctgtgcattgtccacatagtgtaatttatgttctttggtaatcatcattgatctattatattcttatctatttaaagctttattcaaccatgagcttcccctgccataacatttttctggtttccttttaaggttacctggcattcagctatttgaaaaatattttctatggtcaaccagtgcactctgactatcgtatactttactggaaattgtgttgatgttcctgtaaattttttgtaattcgtatttaataatgaaagagtttcccatttctgtcttaaagtaaaaccccttaatgtttattattcaaattaaaatttctacttttaatggaaatttattcattttcatgtgtctctgccaaatttttctgtattgatataacccattattacaaccttttatctttttggataccctctgaagcctcttccttaaaagcaccactggcaacagagtctttcctttaaaatattaattaattagttaattttacacaaagatttcatcaattctacttttttacttctcttttgcaactacatttagtatcattaatacatatatagctacctcttaattccttattccttctaatttaaatatcaaatttcagatgttatcttttgtttattttttttcttttcagctctacctcccattctaagctacaactgaaatcccttccctatagcattttctattgtgaacaaacaaaaatactgtagccttgtgaagcagtgctccctaaaggtcaatatgcatacaaattacctgggcaccctgctagaatgcatattgtaagtcagttctgcatatttaacaaactctcaggtgatgtcagggctgctgattttgggattatgtttcaagcagcaagaagttagggttttcctattcataagtcctattttaaagcgtactttcaccatgtgtgttttattgtcatttaatccttttaatgtgttcctgggcctctgatttagttaacatttgaacagtgctttagaattcatcaagcatttaaacacaaagtgtcttatttgatacccagaggattcctgtgttgtagggtggcttagcgtcctgaaattcaagattgtgctgattaacctgtggtgacagagttaagataagaaaaagatttctcctctgattccgcatctttctcctaactctttctgctaacgtcattatctcccacttcaaatgtaaagagagcccctcttcctcccatccgaacaaaccactggtttctaattagtcacattctttccctgagcttatgactatgatcaggataaaagatcaagcttgggctcatgcgcattcatgcggcccatttatgaggtgggataagaagaccagcagcccttctagaaccacatggaatatgggatgtccgtttcccccaaatgagggatggctgtcccagaagaagggtgcagggggtattgggcagaaaaatgagcacatatctgctattttacctcttgatttctcaccgcacgcatgcgtgcacatgcacgcacagacacacacacacacacacacacacacttttggaaacttcctctctaaacctaataacattgctcgagaattcaccctctcccgaagaagagatagtaaaaaattgtgccaagctactacattgagctccaaggttgagattgctgcgtagttcacaatcttctcaatcaggtttagaaataatatctcatgggtctaagtcatatgttttgcctattcacaatatataacaaaagaaaaaccatatactcataataacatctgtaatttttaaagttcacgcagaacactctattcaccagtccagagcataagacacattttgctggacagactggagagcaggggaccacagtggcctcagttcctctgtcagccaatgtgtttgcacccaggtcctgctcgcaggaaggtccttccttgtccagtgtcctcagtggacattactgagaaggccaccagagcctgaccatctgggagctctcttgctttaggagctggttctgttggcacaattacagggcttggcatttgctttagggatcgagcaatcccaggggtcctaggcttaaactcacttgaaacttagctcatttagaactttagttagatactaggagatgtggctcctgggaaccctgttagctagtaactagtaatagaaattttatcaaatctttgaactttatcccagccagtgttatttttctctttgtaaaaggagctggggctcagcaagtctccagagtaaaatggtagactgcagtggcaaagcagagctcacctacttccggtccaggctgtgtcagccagtgatgctttatgatgagggaattgttgcctctcatttttggaagaggtctatgtgatcaggcttccctcgtttctttaccttttcccatgaatcttttcttctgcacttccccaattcttttccctggtttaaattaacattacccttaagcagtaaattcaacttttgcaattcagcagggaaataattggccaaacctcaaaaagtcttatatccctggttacaggttgaaagattttctttgcaaaatttgcatgttatttccttttccactttcaggtaaagctttagcaaaaatggaaaaaagtaggcaagacatcctattttttaacttttttttttaaagaagaacattaatgctatacagtctaagaaccaaggatcaatagttaataactaaccaattatgtagctacctctagtcaatgattgccacttctcagctatggattaaagagtcatcattgctccaactatccctcttactcatggaaaatctattttagagtgtgtcacttgcaatacccacccacctttatcaaattttgcaggacagagatctgagaagggaaccccagaaacaacaaatgttcatcatagctattctcaagttccttggtttttaaattgttgtttgttttgctaaccatttatttttataaataaaaatatgttcattttatttataaataaaaaatgtttattctcccaattcctctatttttttcctctgtatttcagagaaattttatcttctaatgtgttgtcagtctcctttcctactgagagtcactttgttccgacaggtctgttagtggccatcttattgtagtatctgtttccaaagaatgtataggcagagaaatgtctttagaatccaatgccctgaattcaagttctgttttaatagctgagtaaccttggacaatctttgagaacttgtttaatttttcttaatattgacctggaaaatggtctaataatacattttatgctttccttttaactctgttagaaagatgggtcacatatgcattgtacatgaagaaaggttttcaattgcaaatgttcacaaaatttcaattctagtctaaaataatcatattactgttatttatttacttcttactaccttggaattcatgcagtgctattttatctcttcctatagctccttttcttttttcttataactttaagatactgcatgtttttggatagatctttcttcctctatatacttttctccattcattcttagccctgaaagtcagcccagttttcccttcctcacttttattatgacatgcccttgggcagatagtaaagatatacctctttttatcactaaagttacactcaattttctttttacaagagaatggtttggcctggttctctaaacactgaaaacattatttccaactacacttcagagtcaggtgattttcctgagcctcctggaacatgtccttcctgtcccttagacccagctatatcctctgtttttaatggaaagtacttggcaaatagttcaccctatttgctttttgccagagccccatttcattttttaagttctggatgcaagttccagaactatctacagcattttctgaaacatcttttaaaaccagattacaatatcttctttgtgcactgtttctccttgaagaaaatgaccagcatttgtatccttggcttgctgaatggagtaaaatcaaagattttccagcatccctggttctttttctttgaaagagttcccagaataaatcctgtttctaagtgaaaactcttggatgagaatataggtcctaggacttttggactagattttattcttattccaaaccatcagttagtttatatttaaacataagtgaggcctaaagccttaatgagttgagaaatatttcagaaagcagtgatcaagttcatggaagtatatgctttttaaaaatcaaagggagactttgtgaccaacagggtcactgctgtagcaaaatataaaatatgccatggttaaagcagtaatgattttcttttgggtggggttcctagagattccaagaagacatcatgaaatatgtgagtgaaacatatcaccagtgaagttctgtctgcccggcactaactttttacttggcttgagttgtaggaggaacagacacctttacatattgcctcccgcctgggtaagacagaaattgtccagctgcttctacaacatatggctcatccagatgcggccactacaaatgggtacacaccactgcacatctctgcccgggagggccaggtggatgtggcatcagtcctattggaagcaggagcagcccactccttagctaccaaggtaaggagaatgacatcatgagaacatggaccaagaggattcctaagtcatggcctttctgctctaccacatacagaatcaagagggtagatctcctcaggccttgacttacttccttctctacatatttaagactcattgtctaaatgatttaatagaattgtgagattccgtatatcttcaataaagagtgctgaatttcattctaattaatgccaatgtttctaggacaggtatctagtactctaagatgattttcactttttcttctcttttattataaaatccataatatattcttaagaaaaagataaatgaaatccctaaatatattgaactggtaatactaatgaggaagagggtactgcattagattggcagtactatatttgctgtgagttatagtaccagatcgaagctcaatttacttgtacattttcgcaaccctactattagccaccacttatttgacattctcattcccatattagtttccaactttaccaactacacttttgcctgggtatttacagtgtttaaagagagctgaagctggaaaatcacacttctttagttgttattgacatcgagcaaagaattttacttatgttccaagtttcatgacagggcagagtaatttttcccatgctttatacatgctgtttgacattcataatttggagatgacttagaataaaacatgaatatactcagctaattagagcaaaattaattgagccagtgcaagtgaatttgtcatggggcaaaataattcccacaaatgtaacagtgattcagattaatgaaaggacaatttcaattctctcataatcagtaggtataagtacttcatccagggagagggaaagttgcaaatttaaactgagatagtgatgtggcatctgtcctcttgtaagtaggagcagcccactagctgttatggcttatctggttgcctgttatgacttacctggttgcctatggctgtaaaaggtattttgatataagaaattgacaattattgaagttctgaactctgaaaagttggaaggattttaaaagttcttaaaaaaaaaaaaaactaagcaacaaatgtagtaataacctgagagatttggtgattgtcttatcagaggagggtgtaaatcatcaaaattaagatacataaaatacagaaatagataataaaacgtagtcttttgtctgtcaaagatatttaggatttaaaaaatataactatatccatggtaaattagggcgataaaatagaataaaatgttaaacagtgttttttttttttttttttttttgagacggagtctcgctctgtcgcccaggctggagtacagtggtgcgatcttggctcactgcaacctctgcctcccgggttcaagcgattcttctgcctcagcctcccgagtagctgggactacaggtgccctccaccacacccagctaaatttttgtatttttagtagagacggggtttcactgtgttagccaggatggactcgatctcctgacctcgtgacccacccacctcggcctcctaaagtgctgggattacaggagtgagccactgcacccggccaaacagcattttaagagttcagctgactagggctgaacagtggttgattcatcattattaaagacatttaagagggtaaatgaaatcttggtgagattaacataaaggaagaaggcagatgtgtgactcaagagatgccttctaactttggttttgttattctacagtagattttatgtatttttgtctaataatcatttccaaacttataagagttggatcactattctagcaagactttaaagataaggagtttatgttttcttcctcatgatgcagttagcctcaaagaactctgtttcatcctgagtatcaccctaatcattgtgtgcattgagtggagggaggagagctctaaccacaaatgctggtttatatggacaatgcaagaaggaataaatacttcctacgtttgtcccacacttggaaaaaaccagaagattcgctctcttccaaggatttattaataccaaatgttcaaaaaagaagcaaaaagaaaaacgtcatctcatttaaaaataatttgtctggagacaccgaaagggcaatattgcttcttgggggatattctgtgtttatgatgggggcttaaatggttccaggataagccatggcttagagcacctaacccaggcatatttgctatgtgttttacaggccctgatcggtgttagaattcccccactcccactgtagtgccagaagagcatgtggttaaactgtctggccaagaggatggatttgacatcatggtgtaggaactgtgccatcctcgagatcttagtccagagacttatctgtatttataacacactgctaattacagagtaaggccattggttaggcacggaagacactgaatgtacacatatcaacatgtgtaggagagcagccctctaaaaaaagctctaaagcttcagtgtgtttaaaagtctggtgttaatcagcccaacatcatgccagaagtagaacgtattttacaaaagcaattggtcttttagacagtgtgagtcttttgggaaaggggacaagtcaggatgggagttgctttttaatagtacatgttttttgttctatagaccatttatcttgccatttctgcagaaaatatgtcaactaattcacgaatacttgtttttactatggctgccaaaatatcctaaaatttaaatgaatttggaattcaggtgttataaaaaggattgaaagaaagagaaggagggttggagagaaggcagctgttgtttcaattctattaattttagaggcaagaaaaaggctttttttccccattcacaaattggagccagtttactgacactagtggcttttaaaaatcccaaacctataaagtcagatttcagtctccaagcccttaaaataaaatttcttttattcagtctatcaagccaaacttttgtatgttaaattgtattctttttctttgtccttgttcatggctaacagatttaatgctaccagtattttttccaaatgaagaatcagtatactttgctcaatatgttaacaaataaaaagattttttgaggagttacaacaataaatacgattttacttttgtttctcacattttcagaagggttttactcccctgcatgtagcagccaagtatggaagcctggatgtggcaaaacttctcttgcaacgccgtgctgccgcagattctgcagggaaggtaaagattttctatacgttataattatgtaacagtgaaggtgatagattaggagatctgtaaagacatttttctcacttctctgaaaggaatgtgagagcaactgatgaaactatcccaaatagacatggtggcgatgtcttccatgaccgtccaggtacatacacactgattcagaaagcattttgagctgtgcctcaaagtcttgtcacaacagccccagaaagtctctatattaagaagaatccctgcaatgttaatgtagtatttcttacatagcagtttagacctttttacattgtgaccctcaagatcccctttgctggtggtatgctcattttcaattttagttatgtttttaatatgaaaattattagggatttgtttattttcgttcttttttctattgactatattaattcattaacatgaatttaatcaatatcagtttccaggcatcctggtagcttcagggcagctaaccctaatttattaatgctgaaacttaaacacaccctttacagaacggccttaccccgctccatgttgctgctcattatgacaaccagaaggtggcgctgctgttactggagaagggtgcttcccctcatgccactgccaaggtgaggaccacagaaaaggatttacaggcatagggtgtaactatcgcctgaaaacacatgagaattgtcttttaaacacatggtatagtataactgcgactagtcctagcgatagtagcttttggtattgacacccttttttttcccttgtatttctgccagttgcgtcttgaaaatcttttttaagattttttaagagtcagcaaatattaaggggatgtgcctataaaccagtagagatgaatcttattgctaacattctgtgtgttagagaatgaagtctgaattttgagaactgagaaataaagtcattaacatgttttctcttctctcctataaaccaaatgctatgatgaaaatgtccttttatactctcattctttccgacttcaaacttctatttgtttctttgtctttttttttaatgttttacctgtgttaactgtagcatggatccctctaagtccctagattcagaggtggtgggaggatgcctttttggtgtatatctagcaccaaattccgaaacagctccaactaagacttgtacttacggacagggcatttcccaccattctagttggccccttattacactgaaaatatatatgaatgtcgtataatgcataaagtcctcattgcgtctttcgttcattaattaagcacacctattttgagaacacatcagggtttatttaaaaaatattgattgtaatgggaaaatatttatgctatattagacaatataataaaaaaactgccaccatttatttgccaaacactatgccgagcactttacaggcaatatctcataataaccccatgagactggtattctaatgatctccgttttgcagatgagaaggtgagatttaagtaggttaattttccaaagtcatatgaataataagtgttagagcttgtacctgtgtttgacctcaggcagactgactttagagccggtgctcttaaccactaggtcctttgtgccccaaagcaatagagggagatttattccacttctgttatacaaatatatacatatatactcatatgcctatttaaattttatacatattataaataaaaaataggatatatacataaaatatgttctgtataatatatattttatatataaatatattatatatatcataaatatataactttgtacacatacatacatatacatctacatatatttatatctttttgatgccaataaacagtttataataaagtacttgaactgtcaaaagagggtgccaaatgttcataattatccacactgttcttactcctcttttttctacaacctcatcaattcagcacatattttatgtctttctttacactagattataagctactagaggagtgttcatatcatattcatttgcatatctatgaggtgtttaataacatatgtgagttcccaataaatttggatgaaagaatgaagattgagcaactatggaataaaaatatacctgctcacttaacataccagcattttttttttcattagctttccaggctgaccattctcaacatagatacaaaagacttcattagtactcatgagtactttcgttgaactcttacaatgtgcaaagaaaggattataggtactcaatgggaggtaaaattgtaaaacgtgtgttctctttccacaagggactctcaatctacttgtaagagaagacctagattataaaataatgtgtatagttttcctaaggagataaacatagccttgatttctagcctctaccttgtatggtccttaatcttaggcatgcacgtaccgagttcagaagatgacataaagcatttgtctactccagagtccacagtaggatgggtattctgggaatgcctctctagtgtctttcacttatctgccccagcctgtcaatgaacatgagcccttcatctttggggccactcctagagggctccagatggtaagatccccactgtagtctccactttagactctctttctgctcattataatgtctcctctccttaatacacacggtcctttggccacgagaactttgcttctttccaccagagtccagaaccttctcttagtctttattgggagtgctgcaattatttgagtccaaaaatgtttcctctttgtggagtaagagggcttttcagatcttgtaggttgagtatctaccaggcaaacctcctccattgccagaattgacaccttctttgatgatcgcttatgttgttttgctaaaatatccctgtacctaaccttagtagagcccatgctgtaggcagtggggtaactaagactaaagaaacacattgtagcaaaaagaagttgactaaacttatttggtccacaaaaatctgtgtgtcctttttttcaatagagtctatggacacaaatacagtattttgaagcatctgggacctctgatcagaccctgaaaaggcttccaagctgaatttccttcagttgcttcaggagaaacattgtttgtcaaaaatgaaagatacttattcttgcttggagaaatggggacagagtagataatgtagggttgtgtgaggatcaagatttgatgatagctcataaagacatttaaattctcaaaacacttttttattttttggtacactttgcagttagctttaaggaaatagcatgacctaaaaatacctctcaagtttgattacaggctcaaacctgtaatcccagcactttagggggccaaggtgggcagatcgcttgagctcatgagtttgagaccagcctgggcaacatggtgaaaccccatctctaccaaaaatacaaaaaaattagccagtcatggtggtgtgtgcctggagtcctcggtacttaggatgctgaggtgggaggatcacttgagcccaggaggtggaggttgcagtgactgagatggcaccactgcgctccagtcttggtgatggagccataccttgtctcaacaaataaataaataaaacatctcatggtaatctcacaagaagcacttggtcattatgctctctttcccttcagcatgtcactgaagggaaaagccactgtttttaatttctatcacacattttgaatggaaaattctaccggatttgataaagaaaaggaaataaaacaatatatgttgcagacttacagttgttccacatttttttcttttaactaaacatggggtatagagttttgttcttgtaagcagagtatgagttttcctgtccctctccacaaactcccgcccgaaataagtagcctcatatttgtactttcaaagcagcaggttataaagaaggggagatctaggatttgaatggaccacaagattcatataagctaattttgttgttgaatatattttaaattagaatgcaacccattaaagacagggatcatgtcatgttcaccattgtattcccacacctagcacactgctcggcatattctaggcactcagtaatatttgttgaaccagtttaaagtacaatccaaacagaagcatattagttggagtattatagtaagataatagaaataattccatttgattctttatgttataaccatatgtgaagtgtagccttggttccagatagcacacacaattcaagagcaatattgacaaactagaatcagctcagaacaggtcatccttatagggagagatctagaaatggcacttccatcaggaatggttgaaggaatggagaaaattagcctggaaaacagaaaactaaaggtggatatgaaaatcatccccagtatttaaaggatggtcatgtagaagaggaacctggcttatcctatgttgcttttcaggagagaagcaatattataaggagagaatttttagttctggagctttgatgtctatatctgtcttacagtagaatggggtgccttgtgacttttattgtagagattcggttattgttgaatggaaacgtgatgagtaagagtttggattaactgtaaactcacttttaactcttctattgattagagatttttatttcctttagagatacgtattagagcaattgttaatcttactctatatgcatgtgttttatttttgttctttttagaatggctatactccgttacatattgctgccaagaagaatcaaatgcagatagcttccacactcctgaactatggagcagagacaaacattgtgacaaagcaaggagtaactccactccatctggcctcgcaggaggggcacacagatatggttaccttgcttctggataagggagccaatatccacatgtcaactaaggtattctgtcctttcttgcatcaatcaagagtgttttggatgcatgtaaacaggaaccaatcgcagacagtttggaacaaaaaggagcaatgtattaaaaagaaacagggatatcttacagaccccaaggacaggaagggagtcaagccttatgagagattagaaaaccataaggaagcaagggagagagactctctgtatggcaacactttggcttcttgacttttctatgcaagtcagtttcattcatctctacatccccgctttccttgcttttctctgtgtgtctaaagaggctaccctgtagctcccaatgttaacatcactataattgctccagtgtctgctgctcctcattctaaatttcatatgtatagagagagaaagaatgcttccatctggggtttagcttaaacaactgcctctaaactggcaggccgatgttcaccacccaaggcattctttagtcctgctgggcatctgaggcacctatggataggagagaggaaactcaataaaatacagatttttttccatcaacgtaggcctagcttgagaggtttggtggtggtggtgagaaaatcatttttttttaataaagcacatcagtcattttagcctttctccagggactggcctctatagacctccgcattaattataatacaatggcagtcaaagatataatggaaaaatattcaaatataaaaatatatatttttacaagtatatgtcttttgatacatctatccatccatctacataaagacctatagatccatctatctaactttctatcttacacttatatatatgctgctatagccagctgctgagaaacacagaattggaaactgtatttattaagttggtctgtcatttgatgtcttgatgctttttgtaatacattatatgagcttagtgaaaattacgtttcttagctccttccataaatatacaaatactctatgttttctacatttcattgttagttggtacttttaaagtatcagtgataagttggtcttaatgacatttgtaaataggttatgtagcatgcatccttcaggaagagctatgaaacaggcagattgccttgaatacttctgcagtcctagtctattttcttgtcactcagaagtgttcctgtacatcccctgcccttacgtacttctctggcctttataaaaagtccccacaaatccttttttaaagcacgatgagagcaaattatagggttagtcttccaaaggatagttgcatttttataagaacgaacacgataaagccttatagtgaaattccgtgtatcagatggacaatcattacagtctagggcatgggcgtccttgtgactgttgacgtcatgtcattcaggtggtcatttaccctgttggagaaaatgtgatcatgaagcatagaatattttatttagtattagtgtatgaagggggcatgtgtttactctattaataacaaataaatcttcatttgaaaatcagccaaagaaatccataaacaattcagcagtattttgagtaggattaaaattccagatagttcatgaaactgatcttacagtgcttctgatggtgttatttttaatttataaaaatgacaagtacatatctgaaatcagttcactatgtcctcctttacggtattcttctaaatacattactttctttgacagcgttttatcagttagcaaacatttaaggagtattttttagttgcacactcagcaatgaagaaaaacattcaattttgaatcacaaagtaattttgttatctttataacaatgatttcagtattacatgtgagtggtgtcctaaacacatagtatgtttatcactagagtaaaactttagtaagtttacacagatatatctgaataataatacaatatacaaaatttacataaaacatataaccttgccttttggttagaattataagataatgcaactataaaaatatctcagataagcagcaaaactgataaaataatttcccattgcttttgaagaaaacatatattcttttctttttaaggccaactcaataatttcatagtctccaaatgattatttcacattaggaactataatatagaagtgatattataatcattgtccaaacaccatctatcataaaataaaaccaaaaaagatccgtcgttgggtccaccagtgtgtcttaggaaataaattactttttttgaaaagaacttcaacactttctattttcttgatttattagaaaagttttttttttttttccagaaacctttcaaacagtgtttttcctctattctcacacctaccacacaacaatcatcaacacagaagacttctgtgaccaaatgcggagaggttttccccacataccaagcagcacacaccagctggtgtcctccaattcagttctaacactgtctatctggagagagtgttagatcccttcagttgagggctcagtccccaagactgccctctgcacagacaccaatcacaagtctgggcctctgaacttctgacctactggcttcaagttggggttcccaggacactccctttgagttccattaattcactggagtggctcacagagctcacagaaacacttacattcacagtgcttacagtttcttataaaggctattacaaaggatgaagatgaggagacacatagggcaaggtatgagggaaggcacacagcttccatgcccttcctgggtgcaccaccctccacaaggaagctccaagtgttcagctatccagaagctccccgagccctgtcctctggaatttatggaagcttcatgatgtcagcattcattcccccaggatataggatgggactgtctctctcaggagggtcttatgatccacaaatgctgggagggaagattagagcctagccttagggaaagtgaaaggaggccgggggaaggtgggagatattttgtttcctgaggcctggccctgaggcctaaaacgcacaacgttataacaaaagactgtaataacggctatgggagttatgagacagcaactgtggacaaaaacctatattcactgcagtttacatcctttgatttggatatgcaagtttaccacaataaactgcagagattttcatactggttgttagtttgtaatcttgcattgcagaaaatccattctgcaaatagagcagaaaaaagcacacatatttaaaagtcatcaaaaatgtctttgagatttgatgatcacttcatgtgatgatcacttcaataacatttttaaacagactatctctgtaaagagaaatattctgtttgttattttagtaaggagaaaattaagaaagaatcttgttttatcctaatattcacattttttatacattaggattaaataatatttgtttagaagtgaagaaaattttaatagaaaaggatacaccttctatctcaccctgtgttttacgaaactcaaagttgagctcacccagagctctcaggattaaaaagctccaggcccacaaggaaaaagcctcctctcacgttgtagaatggttttctctctctaggtttcacttacatttttgaaataaggtcagtgtcctttttgatttccagaagtagcaccatggctggagatcatgaattttgaagaacatggcttagctttctcagcctaagtgctaatgcaggagagtgggcctgaaaagttgtggtcaacagggctggtcaattttaatcagatgtgaactggggaagaggtgctgactcagagcccaggtagccacctcagtctatagctgcaggatgtccaggaagagcataaatatactaggcatttgaacaatagtgaggggagagaaatatacagtataaatatactgtaggctagaatgtaagctccataaagacagaaacttttgttcactgctgtattcaagtgcctagaatatgaacacttcatgacatatgaaacatactcaagaaaacacccgtaaacatgtaaggctaccagagtgtgacattggctgaataagccactttcccccatcttttctccatgcctttctttttttattattaattcataactgtaccttaattggatattcaaataattacttgatgtatatataccaaacatgttgcataaagctgagcagttgatggtgctgtataaataatgaggttactttaaggtaatgtttagaggaacctcctgaaaagtataccctctttgggtgctggagaaagtttttctgaactcatttcctgtaactgtccattttttacactgatgtgatattttgttgataaaatatagatgattattatgcttataaaataggtgtaatagttggttgatcagctatttaaataaataagttgatacagcgggacatccagatggatttgaaatacatgccatttgaaagcttattggctgtgctattttaaagtctcacatcataatataagaacccattatagaaaatagaaaatgtaatttgcctgatgtgttgattgacttagaggacatgtcttagaggaaacaccattaatttagagagtttgccttgaatatcagaagatatagtttctgggaagaggctatgagttttccaggatattttcaatattttcaatattttttcataatattatagatgatgcaatgtattttcttcttcaactgtatccctttggttccattctttctgtagagtggactcacatccttacaccttgcagcccaggaagataaagtgaatgttgctgatattctcaccaagcatggagctgatcaggatgctcatacaaaggtaaagcaaatcactctcagtattgtgacaggttctggctgggatgattcccagtagcccccattcgggtcaccccatgtccagggtcttccctcctcaagagtccattctgaaatataaactaatcataaccctctcctatgcacaaatctatggtggctccccattttttgctagaatcaagtccagtggatagcatgaggtcaggaccctttgcaggaagactccaattttgcagccttaagtctatcctctctcttactgctttagctagttcacatgacttgctgcgttcctcttctatttgctcatctccatgcccttggtctggaaatggattttccctctctatgccataaaattcttacccattctttaagcctgctgtagctacatgtttcctgcatctcctatcagagtcattctgtctttgctgttttcagatattatttatgcctctctcttagttctttgcagattttgtcacccacatctgatctctcttgctgatatgaagttccctgtggtcaggggcacatatataatctgctaaataatatctttagtcaaatggaatcctataataactgatactctacccagtccttctcctctggggtattaaccactagagtagtaaagtttctactttatctatttttaactttttattattatttacagcttggttacacacctttaattgtggcctgtcactatggaaatgtgaaaatggtcaactttcttctgaagcagggagcaaatgttaacgcaaaaaccaaggtaaagtacttgtggtcattttcaattcctataagcaaaaaggttcagccatctggatgcttcactagtttaccaaagctacaagtgtatttttttcttcctttttagttctaaagtgattttgacgaggtgatgtagttttgtaattatttgagaattttcattctaataactttgacatccatgaaggttagcttcgaactacttctattataaagttaaagtagctgacatcgatttaacaacttactgcaggatacaatagatgccggctagaacatcttgatgttctggcagatttcctttacattgtttcagtggcttggcccccctcccctgaccccttctcctctcatgaagaaatacagacagtcagcctagactgcgtgcctttcatttttaatgaactctgtcacattcagaacatcacatggacatgctcagtgaggcaataatgtataaggcctgggctggaagttctcaaggataatgcagagctgacttgatcccagcagtttccccagtggcatttgaaaggtcctattcagcaaagcaaggttggaacataacactttacttcgtgcactcaatgtggttcaaggtgaatagaagttcatattgtaactgtggctattatgcatactataacttgcagctccaagttctttgatccaaagaaatatttgtttgcacatttatttaagttcatatatcagaaatttctttttcttttttttttttttttttaagacagggtcttactctgttgcccaggctggaaagcaatggcacgatcagagctcactgcagtctagaacctgggctcaagtcattctcttgcctcaggactggctaggactataggtgcatgacaccatgcccggctaatttttaaaagtttttgtagagatgaggtttcactgtgttgcctaggctggtctcgaactcctgggctcaagcgaaattctcccaccttggccaaccaaagtgctgggattacaagtgtgagccaccaagcctggcccagaaatttctgactgcagctatttgaatgggctcaagtaaattagtgtgagcacattcaggacttttcaaagccatcattcaagattctataaattaaaaatatacagaagttttataagtcagtctttatattctcttagaagcagaaacaaaatcatttctatacataagcatgtttatagctaatttaaaataaacttatttttaaactataaataatactattaacatttaagatttaaacttataatcttactctagcaagaatagcttgctgcctagtttctgaccagttcttaagttctcatgaaattgaactttgagacttatttaaagcctctaatatgaattctcaggcattagctcctaaagccttttctgatgagccagctcccatataagcactccaggaaagacattttggttggaatccaagtattctcttgaaatgaacaaatgcaacagtacagtgagatgttggcagggcttgaaaatgcttatcatatttttaaatgtttcattgttgaaatggttataatatttagtaggcaaacactatattgtctagagaatatcaatggtctccctggagtttgacctgcactgaatgaagatttgattgaaagaaaaatctcattttatcatttcagttttttttgtttttttttttttaagtgaactaagttgcttgcagtgttacatttggaaccatatatctttagggaaatagatacaaacctcaaaggacagtcttttaataaactcttcagattttttttcacatgaaaatgacatctttgggaaaggaattaggttttcttcctcatatcttatgtgtagctgtagttactaaaaatggattcattgctttaaaaatgtaaacatatacattaactttactctgtaaactctcatgatgtggtataaaagatttggcaaaattaacttgttttataagactatttgttgcttaaaattagaatgaaaccctgttatagcaacttgggacgaaccagacctggttaatcatatatttaatttgtgaagagggtttagaacagcacatgaaaaaaattgtatttattaaagacactgtgaagattatagagctcttcaattagaaaaacaaacaaacaaacaaacaaaatgaaaacaacaccaccaaagtgattgctaaaattttgaaagctagaaaataaaacatattcatgaacaacttatcttatccttcatcaaacttgaaatcttggccatttccatttttcaaatgaggaaactggggcttagagaggattaagggtttgcaaatgattggtagcactgggtctagagctcctagccagatgggcctatgacagtggattaagaatcaaccaaatgtttacgtaaacacttctgaattgctccagacttccctggcaaatatcctcactggggatttcaggtaaaggttagattaaatcagggctggggaacatttttgtggccacaatgtccactgatctattgagggcaagaacgttgctttggcattattaatttacatatatttatagataatttaggtttgtttatatattatagtgatatattattttattaatttacatgctaagttatttagcacatagtgtgtgattagtaaatgcttgttgaatgaattaacttggctgatactgaaaagatgaactaaattcaatggatttaatggatgtaaacacaacaaaaaggaagaatttttacaaaaagaagtatcgcttagtgtattctcctcaaatgtccatggattatctgatttgaccgcagagtccctgtaatagccaaaggcttcttggagtccctgtaattgatttatattttcaggtttcctggggtcatcccattgtagggatttataaggagatgtaagacttccaacatgacagagttgaggatgtgccacacttagagacacttaggtaaccctgatacatgtgggcatgttcctatgggcagacagagtgcagtgaatttataaagaaatcatgtagcacccacatctatagtagacagaacaagcaaatatgtatgttgctcacagggcagcagtgacattggatgaaaggggtatgtacacttaaaagcttagagtatgaaagggccactcagaacttagagcccaggacaactgggtctgaaacatatagataaaattttatgagaagtgaagcaggtggattttaataaataatagccattgtctggtagccattggctgtcatagtcttctgcacaggatctgaacctcgcccgattgtggagaaattacttaactttcttattttcagtttcatcacgtctgaaatggggagaaaagctgttcttggaaaggaatataagatttagatttactttcaatgatttagaatccctaaagctaagccaaaggttaattattaggagagtcatgatgaacaagcagtggtttatatgaccctctgcaaccttcagttaaaaacaattttaactcttgtttcccagggaagaaatcacagataatgctgttttcttattttaaatctctcttctcagctcagatgtgagcagaagtcgactgcacccacccccttcaccttcttaagggagccctcctttttaatgctaactggttaaaatgtaataatagttatcatttggagtctgttaatcttgtttcatcagctggtctcttctctttgcttagcagaccataaggtgtgagggagtgtttgctgctgagaaatgggttgctgatcatcttgggctccaaataaagcatctgtgatggttttgttgtaaataagactattcaaaatgaaggctaacctaattttcctctccctctgccaatcgggtgctgggcccgccaccactgtcctccacagaacggctacacgcctttgcaccaggccgctcagcagggtcacacgcacatcatcaacgtcctgctccagcatggggccaagcccaacgccaccactgcggtaaggcagacgccactgcccctcaccacgctttcttctttttcctctcttgccctggtggcttcttgtctgagctgagtgaggtcagattcctcctctttaaataagccccctggactctggaaagccccagatttttgggcaggctttccagaagtcagtgtgacttccccagaagtgcttgccctgggagggaaagcagtcagcctgactctttggctctctctggagacgggggccctccgcttgggctgctggaacgtgctctgcttacagctggctctcagatgtgagcacaaattgaccccccctcgccttcttaagggagcacagtaagggagctgctagcttaaacaaagctcattgagttgtggagccattgaaatgtaaactaagcggtgcaattaaacgaactgggatcccgagtggcctgggttggatgcagcccgaattgcttgcctgtgttattttgctgcacagtgagcttctgcacagctgtagctaaatatgttaccgtgttcccgatggtaacatcttacctgcagcagatggcctgacttctgatgagggataagtgtacctggtacttgctaacaggttttggagacgtcatgaggcactttcttaagtgcaatacagtatttgtagaagatatttgacaaccttagggttaaagcgtcaagtgcttcttattaaaaagagcaagcagatgcaagcttgttgtgttaccatggtgacctggcctatagtctgaagaagttacaaagacagatttagacgtaatggtaaaaactagtgattttcctaagctgtgccttgttttggaaggaaatgctggctgatgcagagcagcgggtgagctcattggctcacatcgcagtcctctctcttatttctcactctctctctttcactctctcttcagaatggcaacactgccttggcgattgctaagcgtctgggctacatctccgtggtcgacaccctgaaggttgtgactgaggaggtcaccaccaccaccacagtgagtatgagtgactgactagcttcagccctgttattcttcgttttcaaactaaatacatgtacagtactttttcactcacaagatgtttggagcttttagttttgaacttctttttgttgaaagtattgtagcacatacataggcgtatgcagaagtaaatggattcacacaaggaatacagggcttcggcttcctttactcagcatctatccctataaaaatgtgtgaatatagttttataatatttaattcctttttctgtgactggcttcttattttctggcttctgtgccctttcctttagttgtgtgtgacacctaccgctggcaaagcggtaacacactccactgcaaacttaccttagccaggaggtcaggccagcctctggaaagaccctgctcctcccaacactgtgctcatgactggatcaaatggactcccagtgagagcaattcatccttactttgcatcttatttctgattattattttttaattcaaaaagagaattccttgtgctttctaggtaaattgtttctgtgttgtgaaaaagtatattttaaaatttcttattttctctgttttgaatacaactgctgactcttcatgacaaatcagtgattatcactggcctttgctagagaaactctagaagagtaaagaccatgacaatattgagtcctaatgctcctgtaccattcagtgggagcaaagtttaaaggagcctcctgagagggggctcctacctgaaagtggaagtgctattatatttgcatttattcactcactaactttctactttaagcatggattaaagaatggctctttaatttagcttcgtaaagtagaaaagtagaacagtacgacatgagaagctcttcaaagacaataaaaccacaaatgaacaaataaagaattctgaaggaggttctagtaaatgctccaaactaaaaatgcatatagagtttgaaatgcttggtgtttttgacagatgtgaggaaaaagaaaggaattttgttcttcaggctgacagtaagttcctgttgacatatattgaagtgatggaatacagttggtttaacgtgcagttttaagcagagtggcctatgatttattaatgagctgcaagacacaaactgaatttagatgggaaagaatagcactgcttgttttctgaagcagaatcttaaaaccttcagccagttcaccacaatatttttaaagatttaaggtatagctttgataaattatataggagaaaaacaggtcttgtcactgcctagcaccatacttgtaggtcactatatttaatggctttttcttattttatgatttcttataccaggaaaatcttcatattaagggcctacacatatatgccacttcatttgatatctttaaaacaaggtgtacatcacaatacgtgaagcctttagtggcaagattggccaagcacacctgttctgccattagaagtcatgttttctctcaactttttaccttttccctgctctgggaataatgtatgtttattttaccaagttatcactagatggcaagcttgtatctcttgctatcttgtacctactttgcttccattcatttcattaactgatttattccttcattatttattggatataaaatatgtgctaagttctgtgctaagtgctgaagaattatcagtggtgaaaacattactcctccccaccagcaacttcagtgtcatgagagtagagaatgagactcaggcttggtaagaaaatacattcatattttactcaacaaaactatggaacttatatgtctggtttcaaagagatctcaggtttgtagatattactcaggtgaatgacttcaaacaaagatctatatttaaaaagaagagcaaataagcattctctggtttgtctctaaatactgtaattgctgtctcagtgtccttgtcagaaatcagatacaagatcatctctctaccacatctatctctggaaaagatgggatgaaaattccttttagaaccccctctgtgagctttttttcttttctggtaactattattctctacattctgtagctgagcattgctccatcaaaagtcgctatacttagaattcaagtttctaggtgaaaagccaataaaaatagaaaacataacagcatttctcctttcagttaggacactaagaaatcattgtccacatgaactaaacaagtatctctgttatctaaatggatagttttaatggttacatgtttcgatgctggtctctcttcactgtctgctgctctttgaactggtttctcttataattgtgagcttaattgttttgtgaaatggaattttggggtaaggattggaagaatagacttattctcatctattctgggagtcttcttacaataaacttcctctctttggaaagagattttcaatcattcttttcccacataatattttttccacataatgtattgttaatgatattaaaaacagtaatatttaagtttaaaaatatgtaaggcattgagggaagatctaagcttcagatttaggttgtcgggttttaaagcccatgttcttaacctttctgatataactgactttggttttgctgaaaatagcttaataggaattttgtgaagaaactgttttcacctaattttcaacaaaaagaaaaaccacttaaatagtgctctttattgatttttgtgggagagtgatattcaatatcattttctaaaatctacagtcacaaaaataatttgaaactactgatgatagcacaatagacaacttaatagttaagtaaaattaataaaagttaatgttattaccgctcaaatgcaacagttgcattacacctgcacaactgacatactaatttaacatgaattggatttgtatgatgtgccatatgagcaaccatgtagtccttttgatcaaagaaagtttcctttcctattctttcttttgagttctttaccccaaagtatgaataaagtcgttgtgtagagaccagaataaggcagtagtttgtaaaggaaaaaccacttctgtagaaacttctgagacattttggaatcgtagtttgtttccttaacctttgcttttctaactttactttgtgagatacagcagggaatatgagacattttagcattctcctgggattacaatcactacatgtttgccagaatggatatcagaatggtagagacacatttctggtgacagaagccaacaagcccaatccactaatgcagcttggaagaactgtgacatatgactcatccttccgctaattgatcaaccatcatcaattatttctattatttgtataatcttaaagtgattgtgttttatgttgcatataattggtatgcagaccataaattactgaataaattagtaaaataaaaatattatcttatattattacttgaacattagggaatagttcagtaaactcagaaaatgtgaatattctaagtcctaaatcttacctgatgccataagtcagttaacatgaaaatcaggggaggaggggatagaggagttgtctaatgggtacaaaaatacagtcagatagaaggagtaagatctagtgttaggcagcacagcaggctaactatagttaactaaaatgtatatttcaacataactagagaagtggatttggaatgtccccaaatccactggggaggcattttggcctcccaaaatgataggattacagacctgagcccccgctgtgtattttcttaaaaagacatacttagtgcagaatctttttaaacttttgacatgttttttcaacctgttataattgtctcaattacatctaattgggtattactttcagtgactcacctttgttaggactttaaaaagaaatgataaatgtttgaggtgatggatatcccaattaccctgatttgatcattatacttatgtttatatcaaaatatcacttgtaccccgtaagtatgtacaactgtgtatccacaacaatttaaaaattttaaaaataggagccataaaaatggcaatacaataaatacttgtaaagtcatttgacaccttttgaggtagagccaagatcttttctttaaatataggtccatcgattagaaattaaattgccattcttgcacaaacaatatcaatacctattatattatgtatatatatgctataatatgtatatttatatgatatttgtatgttctgtgtactttccttttctttctttttttttgagacaggatctcacgctgttgcccaggctgaagtgtagtggtactatcacggttcactgcagctcaggtgatcctcccatcttagcttccagagtaacagggactactcgggagtagtaggtgggcaggtgccaccactcctggctaatttttgtattgttttgtagagacggggttttgccacgttgtccaggctcgtctcaaacgatccacctgccttggcctcccaaaatgctaggattacagtcctgagcccctgctgtgtattttcttaaaaagacatacttagtgcagaatctttttagacttttgacatgttttttcaacctgttataattgtctcaattacatctaattgggtattactttcagtgactcacctttgttaggacttcaaaaaacatctaccctagtttttctagaaaaaaaacagtatttacataatatttaatttagttattaaagttatattaatatgtatgattggtataagtatgtttagaaacaaaaacaagtttagcttgaactccactgatggaagctatggatgagggccttaaaaggtggcatcataaccaagatcactaagtatgctgtggtggcttagggattatgtgatataaatgcaattggtgaccaggaggattggctgagtgagggttggctaagtgaagatcagttaaacacacagtttcttttgcatagaacaaatcagatattgactactatttgtaaagcagaatgttaagaactcctactttattttctacatttttcatatcgtgattaacaatataaattcattattaaatctctcttccatctattatataccatttcttttgccatattatccgatttaattatatcccattaaacttgtacttagtgtcctactcattttaacttttaaagtagtttctaatcttgaccatagtatcttggattctgtagcagaaagagatgtccatgatcatttcactatagccttgttctctatgtacgattcagaggtagttgcataaaaccatgtttatgtttaaataatcaagttttcaaaggacattttgtttaaaaggaaaatatgtattcatttcttgttacattatacatatgtaggactacttattttccatccattcaacaaatatttaatgatggccttctaaaggtcaaataccttctcatgtataaatgatattatatttaccacattgcatatagaggccatttttaatatctatacagaaaaatatccatgaccaatatgatcacagtgtattactttttctgttgccacatatatttgctgataattctgatagcattcagtgaccaaactgaagtaaattattgtttccactcttacaagtacaaagaaaatatagtcccattatcagcacctgaaaatagaaactgagactatcaggcaatgaaacttaatcatttaaaaagtatctccagtaattattttcaaacagagaatcatctccttattgaaatgtttactacgaaggacaaatactctaaaacatttctgcaaaaattaactttctaatacagtctaatatagtagacatcctttcacatttttaaatattcccaaaaagttgaataaaggtcagccgcggtagctcacatctgtaataccagcactttgggaggccgaggtaggtggatcacctgacgtcaagtgttcgagaccagccaggccaacatggtgaagccccatctctactacaaatacacaaatgagccaggcgtgctggtgcacacctgtaatcccagctatttgggaggctgaggcaggagaatggcttgaacctggaaggcggaggttgcagtgagctgagatcgtgccattgcactccagcctgggcaacaagagtgaaacgacatctcaaaaaaaaaaaaaaaaaagttgaataagatttcatagtagggtagtctctatgttatattttaaatgcaaatcattttcctgcaatttatatactttccctaatacaggaaaatgaatctcaaattgagctgtgcaataaacccacctaaggaacctttaaaaaataccctggtccccattatagctgggcccgatccctatggattttgatttaattggtctatgatgggacccaagcaacaatattttttaaatgtttctaataattgtaatatgtagctatagttgaataccactaatacagaatatgggctataatttattggtgttaaatttctaaattaaaatttataatattaaaataataatcaaattgtatattataatagtctttttgagtttgttcattcaacaaatatttatcaaccactactattctccagatttttggatggatacttttgtttttcctgcagcatttagtttgctttcagtgaataagactctgaataaaactatttaaatatcactagaaatatgcaggcaagctgaatttacaacccttgcctccaactgtgccttcatgtgagtagcaggagactttctttactttctctgtttcttcctgtcttttaactaaaattccacccaaagacaatccatttcatcattatggattttaaatttattttttgcataatttagtattaacaagtttttgatatatatttgaaaagctcctgctatgtttcaggtgctgtggaaacaatcttcctcttaaatgactcacactctcatgtgggcagataagcagagagggcacacacagtgcgtagtgtatgacacagcacacacgatgctctaggagtacatagcagcagataaacacagttaaacaaagacattcactggggaggatcagggaatgtttctccaagaaagtcacatctaacctgagccaagagaagaggggaaagaagatttctggtaaatgagagaatatgtggaaaaactcagaggcatgagagaacatgacctgtcaaaataaaggcagctcaacacgatcgtagcatggaatgagagatgaggccttgctacctctcgctctttactgaatcacagggctcttctgagccagtttaatcagttttctgaagaaaacaaagagccaccaaaaagctcatgcagtatcacattatgatcacacagatcttatatatgtatatagtcagagttgctcagtggaatttgattaaccagttgaatttctttgtaaatatatttgaagttatctactgcttttggaaagaaaataattgatgataggttcattatagcctttcaaacaattatctaacatctaggtcaaagcctaaaaaactagacaacctattttttgtactttggtggttttagttgaagatgttactcttatgtcaagggattcatttttttttaaagtttccatgacagtgtcaattgatgcccttaatgtattttcactacagaaactgaaggtttgaatttgacactcaatagtctttaggtgatgttcaaaataatgagatttgaatttttatgtttttggggtacacatatcttttatttatttattttagttggcaaataaaaattgtacatatttatggtatacaacatgatgttttgatacacacacacacacacacacacacacacacacacattgtgaaatggctaaatcaagcttattaacatatctattacctccacatacatatccttttttttgtgatgagcgcacttaaaatctactctcagcaattttcaagtatatactacattgttattaactgtagtctccatgttttacaataaatctcttgaatttatttctcctgtccaactaaaattttgtatcttttaaccaacatctcccaaatgctcctcccccttccttctccaacacctggtcaccaccaggtgtctattctgtgcttctgtgagttttttagattccacatataagtgagattatgcagtatttgtctctatgtctggcttatttctattattctgaaaaatcactggtatgtcttgtgtctaaaatagtgccaagcatgcagtagacattcagaattttccttgagtgcaagaatgattataaaaagtccagaggctcttcacttttaagatgcatttaatactgagttacaataatcataataaattatggtagctaatatttatggagtgccaacatatgccaagcactatttttagagctcttgcatatattacatcatttaatcttcctaaccattttatgaagtacttttctatcctttacttatggttgaggaaattgaggcacatgtaggttaggggacttgctagggccttataggtaataagtgatgaaattagaattttaacccaggcagctagactcagatccttgtctcttaaccttacactgtacatgaggaatgaaaggcagtggattgacaaccttggagagctattgcataaggcaaataagcaacaaaccagaactgtagcccagtgaaatattaaagagatgatttgatcctctgatcccaaaagagatgtgtcatattttctgcccaaatagtttatatctttcacattatttacagcttcttttctaatggctttgcttttaatacattgcatatgttcattgtttctttttaaagcttttctggaaacgtcacttagttcattttagggaagctttgaaaacatcaatctgctttctcaatacaactaattattattaataataccattgctaaagaatttatttttcaaatgagaactcaaaataatgaactgtctcttgtacaacttctctggcataaatgatcatttatcttcaaaaagaacaaatgagttttcatgaaagcaaatttccaaaatatacacgcgggaaagatcccgtagtcatggctcgatggcttgctgctgctgttgagtgtggcctcctatgtgatgcttttcatcttttgtttacttttggtttcaacttgaacattaatgatttttgtttttccagactattacagaaaaacacaaactaaatgtacctgagacgatgactgaggttcttgatgtttctgatgaagagggtaagacttctattcaatcttctatgacacctgtcatgttcttacacaagggcaaattaccctttttttcagagaccaagctggttatgtggatgacagaatcttaacatttaaagtcactttttcacctttgtttcaatacatttacttttgccatggcagcgggggccgggggcagttctgattagtatatttgtttctggtattatttctttttcctagcattaaaattaatggctattaaataatatgactggaaaaggggaaaaactggaaactggccatgtgttaaaatagctatatgataacacaattgttattaaaatatgtttgaattatgttaaaaaatctttttttattcaaatgactttaagtaaagactttaaagtatactccatcaatgagtgttcttcaattgagaaatctctgtattctggttggttcatatgtacagaatatattttaagcccagaggagaagagccttatagaaggtttaaaaatagtacagcaggaagtagtataaattccacagaagaatgtattatttaagtcagaaaatatcccccctataattttagagttgatgaaaaatgacctcaggcaatggcttcctaagtcctgggaagcctgctttccaaaaaggagcagtggggactgcctggagtgggtgtgtgacattgggctagagctggagatgggccagctggagggtgtccggctccctatctctacttcaactagagtagctgacttttcttcattttgtattttgaacttccatgtaataatccacttggataaaaaaatgtgctactaaaaaatcatgaaagcagcatataaaatttgcaagcatttctttatgagaagatagaaaaaagaaagaaaaaaaatcacgcaaccaagtttcaatagttcagctattggtccaatgaacatgattgaaaaattaccaccatatatgtacatgaaaatgtatgtttgaaaaattattgctattaagaatggcactaggtttaatactcattgcttttatacagagaaatattaaagatgtttctttaggttctttaagataaaatcataagataaaactttacattgagatgtccttatttagaaccaacttgttgaatcacctattggtagtatgtattgagttttctcagcttttataaaaatttatgacaagaatgaacaaatgttggatcaatgtagtattttgagtaaattcaaaggtattcccaaggccagcagttccaaatatttagtataattttgtgttctatcttaatacttgccaactagttctcagcattcctatatgcatatcatattttgttttgtgggatcatctttattatctttacttgtatgttgaacagctcttaaacagtttggtgaccactttattgatggggaggcacttagtgattcaggtacccttagaggatatttttggagtgaaagcttttctttgcttttgatttttcttaactggatagaacaacttgtttaaatctgtgtgcctaatactaatctgtttcttttgaaatagcatgtgtaatatgagtggaattgtatatgtgtgcatttgagtgtgtggattttattaacttagaagcctaaagtcatgaattgtttgtactgttaatgattttgcaactattattgagaactgctaacataattatataatctaatgaacattatataaatatttttccacaactattatcttttcttagaatataaatttagagaaaagtaattcttttgttagttgacattgagctagtgtgaacatgacaataactaagttagaccacttgaaattaatgcagtttatatcactcccttggttgatgatatattttaggtgtgattaaaaatatattaatagttatgtgatttttaatatagctaagaatagaaataaagtaacatttaaaaattatttagggtgaattttgcatataaggaaaaatgagtaatgtaagatattttatctagtaagaggtttccaaagtacacgtggtaccactttaagcaactctattacatgaaaatttaaatttataaatcagataaattgaatagtgattatttaatttaaaaatagccctttatttacaaaataattgctggagaattccattagttaatacatttaaagtatttaatattgagttataaacgaaatttataaaaaatagcctcggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaatagcctctcagatctgcctattgcattaaatgagataagttataacattctgtactttcattattaaaaatgttatatattaaatattactggtgataagaactcttggtttgtgaagaatattggtgaatgaccaagattatcttttgtggcaagagaagtctatttttagaaatagccaaaacttaatgatatttctttccccgaggaaaattcaagttgaataattttcatgtaaaggatctatttgagtattgataagtaactttttcatggaaaaaattagtgtgaaggaaattagctggttgacattgccaatgccaacactttaatgttttgtgaggttaatatgtttttatgaaacctgctatcatccacgtggacacaatgcagccacatgtatttgaaaattattagctaatccctgttttctctacagtctattgttttattagtagtaatagtgtattgacacccaaaaagagtattcaaactcttgtcattaagaatggcactatgtttaatactaatagcttttaaggagaaatattaaggatgtttctttaggttcttcaagataaaatcataaggtaagactttacattgagatgtccttacattgagatatcctatcaggctaatttgctgtatacacattaaagtaatccataatatccactcatgaatccaattaacaaataatgaatatgatgttattgtgtttcggaaagctctataactgatgccacagtggtcaaaggtgagcatgaggcacacctttaggaagcctatatggagaaataatgtatatattaaaagaagtataatgtaaggcactatgttgtcagtttttcatatccacttggggagatcaggagctagatatacctaacacagtctcatgaacgtgctaagagatgagagattaataacagggcacatagattttagggattagataaggaacagtatgggaaagtcttgagataggaaagtacaagagagagacacagagtggcagaatcctccagtcatttggtctgctgatgcataaaaacataccaggctcagttgtggactgtttgaattcttaactgaaagggaaacacgataccttaaagatttcaattaatgatgaaaacatttaaaactgtttttacaaagatttaaccagcagtggtacatagaaaaagtttattgagaagaacctggaaggaagcagaaatctaagaaaagagaaagcatttactaaatctctataatgctaggtacatgtctcatttaatccttataccatccctgtgacacaggctgtggatatcattccacatatatatatatattttcagttaaggaaaggcttatttttggagaatgaggcctagagacattaagtagtttgttcaatagcacgcagctagtaagtggtgggtgtggaatcaaaacctagtatgaaaactattgtaatagcacagccatgatataaataacatccttatggaggaatatggcagcgaaatgcaaggaaaagacagaaatgggaattcagtctaacagaattatagcatccagatttaaccaaagatgtgaaggtaatcgtctaagtctttgtaggatcgtgagttgatccctgtcttcgctgacttggcttcccagccataaatgatgaggtggggctcagagattttggcatctgtataaccaaaatgcccataggaatgtgactcatgtatgccttattctcatggattcttgagtgggtggcttgtccatatatctctgctagtactctggaatgatgtatactagtaatcaagagaactccagactggctgaatgttgggatgaaatatagaggcgcctcctcctttgaaacactcacttctgttgtgaacacttaacacttagtggggctcttcatctcaggttttagccctttttccatgtctcagcaggaataatgcttgcttgagagggagtgggttccgtaacgtttcagagaatctccttgtcagcatcatgaggggttgtcaggaaggggagccattccacctttttttttttttttttttttgtgatggagtctcactctgtcgcccaggctggagtgcagtggtgtgatcttagctcactgcaacctccatctcccgggttctcctgcctttagctcccagagtagctgtgactacaggtgtatgccaccatgctaatttttgtatttttagtagagactggttttcaccattttggccaggctgctctcgaactcctgacctcagggaattcaccttacttggcctgccaaagtgctgggattacaggcgtgagtcaccacgcccggccgccgttccactttaagttattcccatgctattgtcacccgtgtcctacaggggttaaatataccactcactatcactgaggaatcttgtgttttccgggtatcaaaacatcaattgtacataaaaagcctgcagtacactgatgctttccagttagtagaaaacagttttcacgaaattgcttggaaacattggacaataaaacaacaagaaaaagccaagtcataaacctgggaatcatcattctattaagtgagtaaataggtaacaatcggaaggaagttattccaagtataggaaataataaagaaattcattttaggtttgttctataatgtaaaaactaaaggttgcttttagtttggttttgttttcacattgaataagtaagttgaaaaaaagaaagtgtataatgattctcttaaagctgtctgagttgtacaaaattctttccaagtctaatggcactctattcaaacaaataagagctaaagcttttaatctgaatattattttaaatcatcttttctccccccttggcttgggcaaggaagtagtcgtgctatttgctcatgtagggaattttcaaagagaagcacattgacaaggggagaggtaaagaagatgagttctgctgtggacatgctaaatctgagatgcttatagaaaatttaggtggagaagtccagaaggcaattggaatatagatgcaaaattcatgagagaggtctgggaccaatacagatctgtgtattgttagtggacctctaagtccatgtgataatatgtgaaataagaagaaaaggcagatggaaaatatcaacatttaagagaagtagagacagggaagaaagactcaaaaatatagggggaagaccaggagagatttgtgtcagagaaattaaggagaatagttttacaaagaagaaatcacttctcagccactgattaattgctgaaattagcaagcatctgcttgataagtttgattgttaacaaacaggagtcagagtgtgaaataaagaaggtctaagagtttgggaaagaagctaccatatttcagagatggcagaaatatggatgttttatccatggaaggggaaagacctccatagaatctgtaacagaggagagaaggttgaagatgaagggcctagcagacaatgtatctaggaagttgggaggggatgaggctttggaggcagggatgggccagctttacactagcagaaatcttctcacccaccaagggaagcaagaatatgagtgttatttcaggggctcattaaatacatttaaagctttgatttgtatgcagaattttccagttatagaccaacctgggtaatttttttcaaagtgatttttcacattctgttaatttctacttgctttcactttccatctttcactgctggtatgtattactgaatagcatgatttatatacatctaactgtcttcgagagaaattttatatagcactgacaagattagtccccagagaggtggctttccagctaatgccaacactgggataggatttagacactgctttcagcatttagggactttgcttctttgggtcatttctctctgagacataatcaagacattgactatatacctagggccaccccaggtgtatatgaaaatgctaaaaattcactttaagtagcactgaacctagcagcagccttaggcagatagcatcataacaaaaccatcaaaatgcacaaaataagggagaatgtaaaggacattcacttaggaactcagcgtaatcagaggtggtttttttgtttgtttgtttgcttgtttgttttttgtttttttgagacagggtcttactctgttgcccaggctgtagtgcagtggtgcgatcatggctcactgtagcctcgacttcctgggctcaagcgattctcccacttcagcctcccaagtagctgggaatacaggtgcatgacaccatgacctgctaatttgaaaaaaatttttagtagagatgaggtctaggtgttactcaggctggtttcaaacttctgagctcaagcaatcctcctgcctcggcctcccaaagtgctgggattacaggtgtgaaccactgtacctggccaatcagaagttttaaatttttgtcttgtcaccagagtcataaaattttgatatatttgattaaaaatatattcttcaaatgtctttctattttctaataagattctattcacacgagagaggaaggctgggttcctgtggttgatttgcatgttctacctgatcaaatgctgtgtcttgctccttcagatgtagagtcattccagccagactcttcttttatctttacctttctcaccttttctttcttcacccttataaaccttcctcaccctaccaaggtgtaacaagagggaaagataaatgggagaaataagaaaatttgaaatgtaggacccattttattaaggagttttgtggatttttaaggaccaagaagttaaagcttattttgagttgtatttattccctgtgaccatcttggctgctgagagacagcggtgagaactggcaaattaggagaagcaagatgaaatgcaaaagcaaacagactctgaggagggacaggatgctcgaacctaagtagtattcagaatttggtgctagaattttggggagtaggggtggggtagaagactgggggaaagaaagagtatataagcagacttttttttttttagatgagtctcactctgtcacccaggctggagtgcagtggtgcaatctcggctcactgcaaccttcatctcctgggttcaagcaattctcctgcctcagcctcccaagtagctgggactacaggcatgtgccaccacgcccagctaatttttgtatttttagtagagacagggtttcactatattggtcaggctggtcttgaactcctgacctcaggtgatccacctgcctcagcctcccaaagggttgggattacaggcatgagccactgcagccagccaacttttagtttttaaataatctttttggctttttgcaagggatccataatatgcagcttgcactgtgcttgtattatgtgacagattctgtattaaaccatccccttcaccttttcatgaataagaatagatgtagtctcctgaaatgttaataaaactcatatttttttctgaaagtaatgtaggcttaatcctaaagcagactatgcctgtgttttgataaatctataattagaattcatcttagaagttttttctcctagaagtaaacaacaagggatatccaaacttaatattaaaagaattaaaattcaagtgattacttcttcttggtaagtactaagaaaatgaatcaaatgttgtttctctaagttttagcactgtatagttgtttgctggtgttctgtgttctagtgtgcagtgcagtttcatcaaggtcaaggtaatgatgttgatgcatttcacaatcatgaccatatgttgtagttgatattacattcaagaaataatcctgcttcttcctctgattgtttcaaggtgatgacacaatgactggtgatgggggagaataccttaggcctgaggacctaaaagaactgggtgatgactcactacccagcagtcagttcctggatggtatgaattacctgcgatacagcttggagggaggacgatctgacaggtatctcataaaacttataattgatgtcagccagaagtatgtgcaacatattttttatgatgatgataaaaatgtagatgcaattattgagcatttaataggtaccttattaatctcagcagttagcatgttatgtttttccattgtctaacaactttaagatatgcccattttaaagaacagaaaactgaggcctagaaagatcaaataacttggtaaaatcaaacaactagtaagaagcaaaaccaaccatcataaataagagttctcatcatttaaatgtggcgtttttcatcactggccactttttcctcaaattaaaaggacaattttgccttatagacattcttactgagcggcatcacagacactttggatactcttctgcccccacttttttgttagtaacataatttctgtgaataaagtatgttgtgaggctgaattaaaaagaaatacattcagaacaaaactgcctggaactgactttttcatgaaaaagaatccgaacagaatcccacgagagcctggatacaagaaacaatcggagcaaaatctgagggagcccagtgttaataggcaaatctgggaggtttatataatattctgagatatatgatcagtgctactttttgttattattaactagtacaactggcacttgttatttttttatgcaagttaggtaatgacattctgtggttcctcattgaaattatgactgataagttgggccatgaatatggatgtcatagctgggtgcagtggctgggtgctgagacctgtagtctcagctacttgggaggctgagttggaggatcccttgagccccagaattcaagtccaggctgggcaacatagcaagacactgtctcttgagacagaaaaaaaaaaaaagaaaagaaaagaaagtttgtccacgtagtgtaatgtgttctgctaatcaataatctcaggtttatagttttaaagttggcactattgtaagctattttatgaatatccagcatagagtctaagaaataaataccttaaagtctaagtgaataattagcaaaaacaaacttttcttgggctttttccttgagcaccaatgcccccttccactatctttttttttttctttagcaagataggcttgttaacttcatagtctaatgggatgggagagggcataagctagtggtacacatagagtgccactgaagccctgaggctctagcttcctggagcagatgaaaccaaactgagaccaaataatgagtaacaatggtgaggaaaagtggggagggcatttgaagccttaacaaggtcttgagcaaaggctcgcagggtgtatgagaaaaaagggaatgcagtgttgctggagtgtaagtgtggaggacgggaattatatttgcatagcagggggatccttctgccagtgagaaagaggatgaattttaaaggagagtttcaaagggctaaacctggagattgcagccactctgagaagcaattgttcgtgtattaactgcaggtgtcatgagaggactagcactctaaccttggtgatagtcatggagagaatttcagaaataaaaaatttgagagttttttgagacatgtgtaggaggcaaaactagtcagatttcatgatgaatttcatgatttaggtgaggaaggggaaggagattaaattgagtccttggcttcaataacttagataaagggtgctcccagaaggaggagcccctctggagttccataagctgtcttgatacattggtagatttggaccttatactctgagattcttaaaagatttcaaatttgaataaagtgtaatgttcatggcattgcacaaattgatgataatctatgaacagtcttattactgtcaaccataaagcttctattttttgcatggtctcccttattaagaataagtacttgatttgatctgtttttcttctttcaaagtacttaggttgaggaagaatttagaataatactttctataaaacaggatggatggcttgaatgctcctgcttaaatccaatacttttcagcacataaggtcaggggacatgaaacaaacaagacatactgtgttctccaggtctccacttgcatttctagatcactagatgtattcaccatttccaaaatagagtgacagacagcatctcattttcatggtcttcttttatttttaattttgcttaggcaattcaatataagttaccttttctcagtgaccattttttcctttgcattatttctttatctgaattgctttcactagcaccatgcccaggtaggtattaacagagcatggaaacaagcccttcctagatttatccacatttccctgctcactgctaaacctgcgtgtgtgtgttgccggggcggggggtgagggggagcggtgggggagtgggagggggtgcttatattctagaattatggatttattctaaaataaatatttttatgtattgaactgaataactagctgagctagaagaggtgaatatattattaaaatgtaaatctgtgacatgacccaggtattgctttgtttcaacaatcactgctgcacctgtggttgataacacattagcatggctttccccaaacaaccccaattagcctatgtgtagttggagaagatagaaaaaatattctgatgcctaaaatatgcatagatatggaagaatacaaatacatacaatttaatgtacattaaatacaaatacaaccaagttatgattagttggattttgcatctgttttattttattgtagcttacaaattaaaaatgctttccaaattcaatgtaaaatactaaataataatgaaccacagaagcttcttcatatcttaaagcaaatttattgaaaattgtggatttctactcgttaagtttgccactccattaattgaatgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggttatattattttagtgagaataattctttagttattattattttagagggaatattcttttagagcgaataacttctctggtgttggaatagtccatctttatttcatttaagtagattatacgacatcatttttaaaaaagcagttagaaatgatacacattgattaaacaaccaattagtatttcagaaggcagtaagtaagtagaggaggctagaatacaacccatagaaaggtagagacactcctatatatggttttgattattcattgttgctccctctctctgtccaacttttctcactctctgtgtacatatcctaatatctttctctctctaatcaattttttgtgattatatatcactttgtctccttctttctcttcttatccctctgtatttctttcctgttggggttttaggaaagacaaaaaacaccaacacctctctattcctctcagtacaaaaccaattgagagatagactcaggtatcaactaaatggatatcaaaatttcacttgtatgactgatataccgattgcaaagtgcgactttactttcatagcccaatgggctctttaataccacattcctgaaatagacagacttgtctacttagccatagtcactccttgagagtggcaattgagacctgattgattctttcaaagtttagacctttgcaatctggcagccacgtcacaaggttttatttgaggtaccattatttaccattcagtttgttctcattcaagctaaattttcattttccctttgagaccggtgtttctgctattccagaagacggttgagcccatagaacagctgtattagaaacagaagaggttggctcctctactattttcccttccttagccaaattcaaaacaaaataaaggtgaatagaatttaagagttgctgatctagcccgggcatagtggctcacgcctgtaatcccagcactttgggaggccaaggtgggcggatcacgaggtcaggagatcgagaccatcctggctaacacggtgaaaccctgtctctactaaaaatacaaaaaaattagccaggcgtggtggcaggcgcctgtagtcccagctactcgggaggctgaggcaggagaatggtgaacctgggaggcggagcttgcactgagccacgatcgcgccactgcactccagcctgggtgacagagcgagactccgtctcaaaaaaaaaaaaaaaaaaaaaaaaagaattgctgatctcgtgccacctggtacaaaacacatccaagtggatcttagctatctttgtgatttacagcaggaaaacaaattatccattccaccagctgagacaagcttttgctgagattaacccttttcccaataatctaatcccctatcaaaagctaaatgtaaaaccatctgtaatataagtagcctccaattgctggagctaaaactcttgttgatgaaattactaaggctctgtcaagagcctcaatcttctccaagagcctacataacataaaatagttaattctcaggttatatttagattttgttttattgtaaacacagatttatgtatgtgttaacgcaaggatcagacaatcaactctttttattcatgtcatttaccctttaagactttttttggaatatacctacatgtaaaataagaaggagaaggtcctggattactatgaattacctacaaagtgatgatttcctcaaagacaattgatgcgggctatgttgacacctcatagatatgatagtacatggcttacaaaattaaatatacttgcaaaatgaagatagtttctactaataaatatgctaatttaacatttagtccataattctacagtgcttcactggccaaacacctactagctaaaagtaaatgaaagtttgcttctataaatattgtgaaagcttgcgtatctcctttttttcccttatgggctttgggctaatattttgaacacagatctttaatacttgagctacagtgtataaaatatagcttatttaagataccaatctgtcatttgattttacaaattgatttaaaaggaatgagattgcatctatgcaaatgtcaagttttacctattacatatgagtgtgtaatttagaactttgaagttcagatttttcaaaaatgtaatgcatggtttatcaaggcctaaatcccattttgaagccaaacctcatttttggtcagtggccattggcaatttgtctttgtgctggcaggtgtgtctgtgttctgggctggagcttagatacagtttcttgtgctcatgcatctcatcaccacggcaaccaacactctggtgcttcagtcaccacacacaggacatgcaaaggggacagtgctctcgtttgaaataatagcattgttggagtcactagagacaaacaagaggaactccacttccgcaggaagcatgcatctggccacagttcatttcactctgtaccttccaggggaatgcaccaacattcagtcattcacagtttagagaggaggagaaagaggcatagagagagaatggaaaataataagcgaaaatgaaactgggctttcattttgttcttctctctgagggccatctactttcctccttatatttttcttagttgcagagagattaacatttaacacagatttaagcaatctatcctggaattatttcctgagtgaatttctggtactggcagtaataaactacagttgctggtttcaaacatttctgggaagaaaatgaatcagattaggagtatcaaattttaacttctggattcccttgtgctcttgccattgagcggtaggaacctgtcaaaggatgtgttagttcagctgttggacaaaaaggtaggacaacagagacttgtgtccccctggaagttgtgctgttagctaatagcacgcttttttcactctcctgctcggctcatcattttgtcatcccaaccctgctactgctgttggtatatgccatggcctcctgccaacctaccagccttcgatccttcagttccgacaggtctcacactctgagccatgcctcctacctgagggacagtgccgtgatggatgactcagttgtgattcccagtcaccaggtatgtgacattttgccttcatgtctttgctttctggagagctttgtaacattattggatgctagaaatgtcctgagaaagtttttaatccccccaaaatcattcccaattcagttgagaagctaggataagagatttgagggttttcctaaaacatgaaaaatgttcactagattttttcaatgagcagtgtttttctgaaaaagcatactgcttatttcttcagctatactgaattcttctgtggagattatatatgaacattatatttttaaaataaaatctccattaaaggaaaaagtgaagtaggatgcatttaaggtataagatgaatggtacaggttaagttatatctttcaatatttaaaattgttagctatgagaaaggcttaaaatttattctggaatattttaattttagttatgattttatcacttttggtggattgggtatagggaaatagatggatacctactgtcttcaaagacaattacacgaatgtaatcttatataatctatttaaataatgcagtttaaaagagaatgcattttaaaagattcattgtaaatacattggttttatattttaagtgtaagtttttctaggttataccactttccagtgatgacactttttatattttgttatattttactttaattgaagcaaagtgtgtttattcaatccagtgttctttgtgtttaggtgtcaactctagccaaggaggcagaaaggaattcttatcgcctaagctggggcactgagaacttagacaacgtggctctttcttctagtcctattcattcagggtgagtaaatcaatattatgtatcctgatcaagaggtaaaaagagatgggagtgaaaacaacagctttgtccagtagctttagctggtggctagctttacagtggaggtgccctttgtttaaacttgtaaataacattgctttatccaacatggactctatatctacaacaacaaaccagcaaaaaagattgaattcagcattaaaaaaactgactattgttttaaaacaactagtagaattgcgtcaaacagcttgctacctaactggaatatactagtggccttcctactattcacgtactgtctttaagacatcctaaaaagaggggctgaatcatgtgatttctagaaagtttctatttattaggattagctgattggttcaatgaaataaatgcctttctcagatgctaatgcatttcaaataatgttacagaagcttgaatcacacaaatatatagaggagtttatatattgtttgaagtagggatataaacaaaaagggaatttgaacgcaatcagtcaggttctcagttatctttttaaagtcattcagagagtatacacaccactgttgaagcaatgctgcctgtttttattaactcattaaaaaataggagtttgagtcatactttcaaacatacttaaagttgttcttaaggtgttcagttatgtggaatataaattctttaaggagttttaaattgtaacactcttccaatttcttccttacatattagtagtttgcaataatatagtaatatcataattatatataaaatttctattttttatttaattatttttaaagccctatttatatgctatatatcaaaatgcaatattttgattttaattattatccccaaatccttatccataaatcccagaactatttggaaaagtagatcctttcttatttttattattctaaaatattctttattcaggaaagagttccaacatattttagttaaaaattttagacttcttcaactaatcttatactaagtaaaggttcatacaataacataagttatatagttattgaaaacaatcctaatacttttttccttgttaaataagtagaggctagttcctaatgcgacagttattcatgagaataaaaaacaaattacacttcattcaaatttacttgcttttttaaaaaaagaaagctatagattactaaaaagatacaacattgcattctgctaatgaacttcttcacagtggtaagaaggaaaaagacctggatgtagagtattgtaggatcatagataagaatctagaaatcataatgaggtgtttaaagttcatatgcagcctacaaagtgatgagatggttttaggtaaaatgtaattgactaataataactgaatttacacaagaatctgtgcatgccaatacttcagtttgcaaaataaatcatttatattttgaaaaaggaacttttaaaagaagttctttcattactgaagggcagtaaagtagtctaagtacctcaattacaccccaattatgtacaactagatacacctataagtaattatggtgcactacttatgatgaaccaacagcatccagtagttaaagatgaattatgtgttaagataaagatctttaaattcatagtctttaataaaacagttttcctatgaatctcaagcatttaatactgactctggataattctcaacttttgctgtgcattagaatcacctaggagctttaaaaaatactagtgctggccaggcgcagtggctcacgcctataatcccagcactctgggaggacgaggtggacggatcatgaggtcaggggtttgagacaagcctgaacaacatggtgaaacctcatctctactaaaaatacaaaaattagccgggcgtggtggtggtgcacacctgtaatcccagctactcaggagggtgaggcagaagaatcatttgaacccgggaggtggtggttacagcgagcctagactgcaccactgctctccagcctgggtgacagagtgagactccatctccaaaaaaaacaaaaacaaaaacaaaaaaaactagtgcccaggcctcaacccagaccaattatttggaggcctggcattgatactgtctacaagcgccaatagtacagttgttttatatataaactgttaggaaaaactttgcttaataaggctttggttattagagagacctggttaattaaggtatacctagttctctcaaatgttctttatttcttccattcacttatgtattcattcttcacacatttgtgtaattctataaagtacctgacattgtgccaggtactaagaaaaaagctaagtaacatctagcctctgcctttagaaacacactctatgttgttatttaaagttagaagacacttaatctgtaaagagagagaaacatcgtggttaatagtgtgcttgggagtcagacctgtcagaattaaatcctgacactgacactcgtatgtgacatcaggcacagttatataaaaatctctgagtttcagtttccatatctataagatgagtgttatattattgatcccataggggagctttaatagctaaatactttttaaataattagcactttgcctggaaataataagtgctcaatagattatagctattagtatttgtacaatccccatatacacatgttctagatctttcacaaattgcaaatccattaaggaaaatgtattatgactcctctaaatggcagcgtcaatgtggttcaattcacaatagtaacgtttgacttactgttatttttattcaggcaaattattctctattagcgtctccagtgtttcaacaaacacaatgcatttgatgactctaacagaatgagttattactattgaaaactcaatgattctcagtttcctggtatttgaaagctaccatgatattaatgtatatgagtaacactcatcataccatgtcatgtagcaagagttttttgtaattttattcattatacaccaggttcctaaatagtagcttttatttattttttttgaagaacttagtttttctttaattaattgggtggattcttaagccacttcaagttctacccaaaatgtaaggaaaaaaaaaggagacgaagtcttactctgtcacccaggctggagtgtggtggcacaatctcagctcactgcaacctccacctcccgggttcaagtgattctcctgcctcagcctcctgagtagctggtactacaggtgtgcaccaccatgcccagctaattttttgtatttttggtagagacagggttcgccagttagccaggctggtctggaatacctgacctcaggtgattcacctgccttggcctcccaaagtgttgggtttataggcgtgaaccaccgtgcccagccaaaaaacagatattttgatagaggtgataataaagttagttttttatgcacatgccactgatttgtacatataatgttctcttaaatttaataaagggattttacattaatagaagacaccgtttctaccaataagcagtattggtgattttattttacctctattttatgtttccagtgactaatgttcataactagagaacaataggtatcagtgattaaaaaatcagtatcagtgattaaaaaatcagtatcagtattaaaaaatctgttctgctcaatacacacagcaaatacctggcaaaagaaagactaacatttgctgtttattttaaagtgttgtcttcagattcacaatgactctaatcaacagttatttctagcatcctagtcatgatcataacaacataatcttgggcaagaattttaattttacaattcttcttcatttcataagtgcataaggaattagaagatgtaagacacaactcttagcagtagctagctttgtaagtcttcttaaatattgttattaaaggtctttagtttttgtagtgttttaattacagtcaaatgccaacaattaaatgtcaattcattaaaatgtcctacacagtcatacattaactggaggtctgtaaggttgtcttttaaagaacttcttttcataaaaacatgttgaaggcaattttgttgtttacctaaaatttctccaaaaataaagtctattttaaaaatcatcttgaaggtattctctcaaataacgggatatttgaaatgcaaggaagtcaaggctctcacttgacaatattaatgtttatctaatatgtacggcagttaagttagttattcatgtatttcacaacagcctagggttttttttagatacgtgaaggtaaattcttttagatgaggaaagttttttcataataagtagcaaaacaagtgtttagtaaggttggatttctggtccattaagcatgtatacttttgtatgtcattagggttgaaaacacaagagaatcttgtgaaagcttatggagggttttacggaagagcagactcataggtagaagaagagtgaaaggtagaactataatgtgggattagacattatgaccactgaggaagacagcaatctccaaagcaggaaatgaagtattgacaaaagcaccaagactttgtttgcatagcttttttttgcgatactctagtaggtaattgatattacctaccccgctttatagtttatgctactgtttgttgttgatctatactttaaattgtgccttttctttttgcatttcttctgtgatagcccaaaaagttattatcattatttttaaagtattaaatgtataaaacaaaaacctttgcgtcaaaactgtgtccatcaaatcaaagactttatgtttttcatcataatgacccttgatgtttctgtagcttcttggacactcagactttgttaaacgccctcataagccaatgttgaccaaggttaaaaacccatatccagtgattttataatatccccagttctctaaactgggagttgccacaaagcccccataacttgctcttctcgacctatatctcatttggatttccatttgttttcaatgaataaggtattggtgtataaataataagtcacttctgagttccttccttatatttcactttatccgttccttctctgtgctaaagtatctattctgttgcagccgcgcctctccatgtcttgaacgtgacaacagcaggtgaactactgcataattctttctctgaacatgttgcctattcctctccccctttcgccatctccttctgcatattccttgcctcaggatgctttagtgtgaagatacctagccaaagagatagaaagattgatgttctccaaattgtggctattgctgaattcccctttctctgtgatgaagagaaagtggtatttttaatttcagtggaaataaagtggggctgttccagacttactgtggactgcctgtcttggtcatgggtctccacatctccagcttcttttgtgagaaaaagtgctacatagagatgaaaaatgttgttccctacaattatgcaaattggtcaagctattttagggttttattaaaggttatgattttaagtggcacttagcagagagttttttgttgttctgggttttattttaaataccatattctaggtgaggcaaaggctgaaagtgtattagtagtgcatttccttgctagtactgctataaatgcaaccttttgatattttagaaattgtactgtagcatgactagtcagtgttctaaaaatacctgttattctgttatttatttaaagttatttttaaaggttcctattagactgctaattatagtatttttattatacagccatccattatggtactacaaattatcagtctacaaaaaagacagttttgtgtttttatttttgaaaacttttatatacatccttatactttttctcaaatgcacgctattgtctttccatacgtgaacacagtggttgataaataattgtttggtgattttaaaaaatttgaaccacttttttcaaagccatatccaagcaatttttaagtttatagaatttggagaattaggaaggaattaagggaattacagaggagaaagagctcatgcaatggtttgtctcacagtacctcagaaatcggatttaatctgaggccctcttgctatgtatatgaggatcactgaagcactctgatgattttttttcctgttctttcaactaactctgaatgctgcaatttcctccccattcccatcccatggtcctcaaagaattaaaaataaaactaaaggaatagtaactttgggggtggaggatgtagtcctcaaatgactggatcatggttttctcctgcctcctctgaagcatgtactgtttagctaatcaaattgtgtatttgtaggcaagtcatctgcataataatggttgcttttgcttttattctttttaaattgtgataacattgtatctcacaatttagaaaacttcaacaagagtttctactttgcatgattgctgaatttcatttggagagtaagagatgcaattaaagctgagtgttaacatgatattttttgtatgtacagtcttaagtcaatgtttagtgcagtgtgtgtacacattttctgcaaaacagctgttttaaccataaagcaaaaatgatatatatttcctgaagtaatagcagtttattttccaattaagaattctttcagagcatctgaaatgaaaggtttaagtaggtttcctaacctagttaacagtaaactgtgcatataattttaatactggaaggcaacttagagtctatttagtataagtctcccattttatggataagaaaactgaaatctaaagatgttaagtgacttacctgaggttacaacattaattcaagatagagatataactagacccagggaagagcatggtacttgctgcattctcctgtgctgtgtgataatagtatttttatatcttatttaagtaaacttcataaactaataaaaacttcatcatcattttaaactacttagcatagttccaggttcattgtaggtactcaataaaggttagtttctccatttatttttcaagtggtatattgtattgtgtttaagatatttaaaatatgtaaaatcccgtaagtgtagagaaaggaagatgatgggaacaagcatttattgaattccgtatgctttacccacacaagatttctcactgtaaccttaagtggtaacaggattatttttcattgccaggtgaggcttcaatcttaaagatcatagatgacaggcagagccatcaatccatattactgcctcctctaaacatatttaattatatgtttttacttaagttattttcatctccaaatgtttatggggattatcttgtcccatttttaatctcctgcaaacatgagaaaaatcacattgattcagtcaactccagtatgtgaacgactcatctcgcgactcacaccttctaacctttctcatttccctgtggtacataaaagtacgtttgcttacaattttttttatgcttatttgcagttgttttttacgtggtagaatacctgtctcctaactctactacctgtccaaatagtggcacttttgggtattctaatatttttaatgaaaatgctcagatgcttacccaattttatattatcaactgttgggattcactgataagcatacctattgtcaatagacttttcatcagcacctagctataaacttgagttatttttcctgttccttcttatttaaagaaaagacttcttttattatgcaattctgtaaattcagcatttttatcagttgtttggcaattccattatttgagtctaatttgtttagagtattttcttgctagattttataaacagttttactcattttgactattaatatttagcttttttatatcttccaatatttttatttctttcttgacatctttctgttttactttcttctctctcttctctttctcttctaaagaaaatttcctcactacaacttggtgggtttttttggtttgtgtttcttcctttagttacttgataaaaacacgaaggcttgttttctttaaaaatttaatttaggccaggcacagtagctcatacctgtaatcccagcactttggaactccaaggcaggaggattgcttgagcctaggagttcaaaaccagcctgagcaacatagggagaccccatctctgaaaacaaacaaacaaacattagccaggtgcaatgatgctgcctgtattcccagctacttgggaggctaacatgggaggatcacttgagccccgaaggtcaaggttacggtgtgctatgatagcaccactacactccagcctgggtaatagagtaagaccctctctcaaggaaaaaaaaattgttttttctctgaattatgcatactggcacctgaatttttccaatttgctttggatttttgtgcaatacttaaatattactttccaggtttacaatgacacagagatacttataggtaaatttatctgcttgcagcttcaggctttaaagtgctattattttgattttcccatctttggtctttcttcatataattttaacttctattaaaatggtttattttgttaaattcaaacttctggtttttgcttactctcattttctactagtcctctatcaaaggaaatcaatgtattaggtctctctatatacattagagcaggaataagcctgtaggagaatatttaacattcaggagagtcgttcccaactgctttcctacatctgaatatagtgattcgaatgaattctgactgctctgattgtccagagactaaagaattaaatttcctcctatgttagccttagacacaaatatatacagctcctcacgtcttgcccttttcactaggttgtacattcgcttattcaacagttatttattgactgcctgctaagtgctccatccacactgtgccaggctctagaggacacaggaagaaatatggagaacatgttcactgttattatggcacttttatggctcctatgtgtggacttagtcatttctcagtgaccaggaaagtaagcagttccaagtaatgacgaaaccatcatgtgacatctggggcttacaccatgtactttgtggcagcagctgctatgtctttactttctgtatcctcagttcttagcagggcacttgacacttaataggagggtaacaaatgttgcattgaaaggagcatagaaacggaactatagagcaagtgagaacaaaaagagagtttcaagagacacagtcaatgacacaatcagggcaagtaatctaacctgtagttacttaaacattgttacagtcaggaacttagctacttcaattcactctttagagaatgggccaccagaagatactctacatgttcttccatcgaggctccatgttatataggccataagccatcactggaataaatgtagtggagaggttatagcacacaacatgagcgtggaaacttactaaatgccttcaaaggtataaatagtactgaggattgataacattaagcaggtgtattataataattccttactagtttgagttcctgtctgtgcaccaatggaggcagcaaccaaaagatgaaaaaaaaaacaaaggaaatattaatcttaattatcagtgagtcaaaaatattgcaatgaatttggaagtagcactagttgaaacttgtcactttttgctactttttcacaaaaaccaacctaagtatcctactcaaataagaacaataaaatggaaaggaaaactttacatctgtctagaagtgttaccagtattttcattcttttgagcaacaaatagttcatttaaaagtcaaataaaaaaaattttaaagaattcatactggaagactagtaataagaaaagtggcaaatattttctcattatgttttggtaaagaccagaaacatcaacacttcagtactgaactgttgattgtacttcccagtttttactccttcctgaaaactttaagcgggctaggtatgaatggaaggtctagcctggcccctgcatgtgggaaggcctgtgctgcctcttgtggtctcatcctgcatgacatgcttcagacaggcactctgggctccttcgcacccatttttattactagcaacaggatttctgtttaatagcatgtttaatgagttctgtgttccgctttgaagaagatgctaagatatttttcttcatttatctaaaaataacataaatgttttgtgtttatatcccataacttactttgataaaatacctttcaaatgttttaaatgtcgtggaggcaatatctaggtgggacaaatccagttggttctgtgctgagcagattataagcagagacatgatacacctgtatgttgctttcctcttcccattttggtgtaaagatcttgcaaatgcaatgaaaatttgaaaagacactaatgtaatttgtgaaagagagtacacacagtttgtatgtctttgtatacgtatacacaacacttagattgctgtgttgtttaatttttgctcctcgacacagtaagtgcctgggagactttaatgagtgttaataccaaccaaatgacaagcattcaaattaacctggatcaggatctgctaagaccatcccaaaggaaacaacttcaaagttaagacaaacccgttctcttggtacacttaaagaaaccaagtcatcttggattatagttctcctttttcatgaacaattaacctagaagaaaaggagaaaaattaatagggatgctgttaacatttctaaattattagctataattttttacattcaatttattacaatttgagaaaaatcatgatacagatgatacagatatcttccagcagcatgagcccagggtttcccactcctgaaatttcacttcaaaaatggtgtatgggcgggcctacttgttccctatccacctgctgttcatttcaattagaatggtatggcagagagattcctactcaataagttaaaaagtacattttaaccagcaaattaaattagttcaattcaaaagatttaattattttgcatttctcctcctttagaatataatcagttaaaaatctacatcctgggtaagatgatgttggaacaggatgcagaaaaactgcaatttggtctttcctctctgctttgtccttgtattatttcaacatgtagattttttaggatgtacacataaggaagcagaagtctttccatttataacaaaaggaaacttgtcaattgttctttatgtaatttcattccattttccttcaaaatcaattaggcttatttttaatttacagtttatattgaacatcaccattgtcagcaaaaattagaattattctttacagattaaaataatataaaaattagaacaacaacaaaacagaattaaaggcattggtataaagtaaaataacttttaaaaacaagcattttaccaccatgcatttaaataaaaaagagagattttgagacaaagcattacgaaaaacaacttgacaaagcttgttcatctgcccccaatatttcaaaacatatctaatcttctattttaatttttagtttcctggttagttttatggtggatgcccgaggtggtgctatgcgaggatgcagacacaatgggctccgaatcattattccacctcggaaatgtactgctccaacgcgagtcacctgccgactggtcaagcgccacagactggcaacaatgcctccaatggtggaaggagaaggcctggccagtcgcctgatcgaagttggaccttctggtgctcagttccttgggtaagggtttctgataaacctcccacttagtcatcgatgagcttgtgtcctctacatgaaatcactaggatggaatggaaaaaggtacgtcaaaccattttgaaagaggatcagcaccaatgaaatttttaaaattggaagtagcacctcaatgcttgactccacttacacgcctcttattttaaggcattaatgagttaaacattcaggttgaataccacttcttctttttggatgttaataatagctgccagacccccaatgtgaataaccagtattttagccgatggtaggtattattttctcatctgagaattaagtggtaaagtcacaaagaaaaaattctgctctgttccaagcataaatgtaaattctcatacagttatgaaacagaatcattatctttactttggaaagcaatgttgcctttacagaatacctacaaatttaatcaatgtgatttttttttcagctatcaaaattgctaccttgagccttatcattacattggctatttagtcacagtttatattaagacaaatacatcaagactagcttccaccgtgctcgttttggcaattttgagcagaatttagcatttcttctttcttctgtttgtttgtacggctgctgttatattaagtggcatttcattgtgccaagaaatgaatagctacagctgaaattaacaaaaggatgaagttttggagggggacaagtttcaaaatattttgaaacaaatcaattgtatttaagtcttggtgcttgaaatactgggagaaaatcctaataatcgtgaactcttttactttgccgatgtcatattgggaagaggatttcttgctttagaactcaggaaatgttctaaagctttgtaatttggaccaaactattagcagattgctccaaattatgttcacacctgaaaaggggtgtgtttatatttcccaattatagcaaccacttctcatgtcctccagtcagacagaccagagctttacaaggagcctgtgaagttctgggttgcatcagaaaatgccattatgtttggagtaattccccaatgattcttttcatattctgtgtcagaccctgttcccctcgtgctcagatagtttaggctttttaataatcttcagatctgttggggaatatgcatgaaaacatctgtcctctgtacagggcagagttttcattatattcccaacagcttgtctttcttgtggagcattttttccccctttttggctagtgccctggcggtgaacctaattagggacagaccggacagctaagtgctctccttgcacagacgcgcctccattgtacactctgggtctcggttccttgctctttgtgaccaatggagggggcagaaccaaacgcagtgtgaaaccaaagttcaccctgtggatcagctggcgacgctggggttctgtggaagacaatacctgaagcttacctatgttctttctttcactgctgctttggatgtactcagtaaacttcacctgccaacggctcctcccccacttaatgagggagaaagtttggtcagccgcattcttcagctggggcctcctggaaccaaattccttgggtaggagtgacttaaaacaaattgatggctgctggccccccattcttctccttcttctgcaatatgatttctcttttttgtcattgtgcccatgacatgtccctttctatgatttaaattctgtataacctatctttagtggaccatttctgacccttgtggtatgtgacttttatttttgagtgatgtttttatatctttccccttaaagtgctgtgaccttcattttcgtttaagcatgagatctgcctagttgtactatgtgctagttatgatgttgttatgatgaatttggagtctgtatcaaagcaacctggacccaaaaatcaaaaccctctacatattttgagaacgaatgtgacctaaaaataatagggcagtgcatgttccggatcctgaatataataggcattggacacaattgggctgtctgctgaggggctcaattagggccacactgtgtacacatgcctattgtttccttgaatgaagaaaatataagcaaaaaccacgagtgcatggctctttagttcacaagtagtcaactttctgacatctcctcatttacgacacatcaaattatgcaatgtgtgagccattttcctcttaaaccatttcgtcattttgcaccttgtcgaaaatgttttaggagattggcagacatcatagatatgcatgtacatttcttttggttaaatgtgttctacttacatttatcaaaggagaagttccagaatgtcacatgcactcacagggaaacattatttggcttaaggtagcagcatgtacctgaggattggtgcccctgaggtggagtgctactgtgtgaccatctgctagccagtgggctccaggggatggcccactatgtccctgtccccagcaaaagaagaattccaggtcactttgcaacagagtcgaggtgcttgtcttgctgttagttagctcctgtccacactgaatgttctgcattgctatgtcaggcctgtgatcgtggagatccctcactttgcggcccttcgaggaaaggaaagggaactggtggtcctgcgcagtgagaatggggacagctggaaagagcatttctgtgactacactgaagatgaattgaatgaaattcttaacggcatggatgaaggtactttcagatgaagcgttttaaaagaaatctaaactggaagcatgaaaatgattcatttctttcttatgacctaggggtgtgtgtatatgtgtgtgtgtgtgtgtgtgtgtgtgtgtgtgtcccttgtggtattttactacagcaggtaatctgctttgctcctgtagtgatgagttggaatgcacaatacttttgcttaattttactcctgttacattcaggaaaataaaagccttgaagatatcaaacatctcattaaagagatgcagcatgcttccatttttagtgtaaacttttttgagccgaaaatgagatagaatagatattgttgcttcataacgaaatgaactgatactggataataaatccatgatttaaaacaatgcctaacttgaaacattagatatttaagatactgataaaaagtgttaagctactgtgttggaaaacttacatctacccataattagtaagttatagaatactataatttttaaactattattaagggggtaggaaaattaagttcattcaatttcctacctataattcaaacagggagttagccagggttgaattgcatacacatacatacacatctagtttaggaacttagttttccattagaacttcaattgctgtaaatctcaactctgtcttggactgcacaaggttgtaatatctcagtatgaaaagaggaaagcggctcttcctcaggtctccatagtttgcacagagaaaaggtcctagacctaatagtagaattcacattcaactttaagtaactacacaaatagggcaagttctttgcctgcatgccaggaacataccaagttttgtatacagctagacactcaagagcaagtatagctgtttatcaagttcttgagtcttctggcactagtttcagatatggcttatggataggaaagagtagcctgaccatcgcttctttaccatttctttctacatcctaccacggtttgaataagaatagaggccaggcttatcttatccaaggggtggatggaggaagaaattatgccctctagatatgttaagtcaatatcttctaagcaaagaaaaaaatcagggtttttattaataaaaattgttccctacaatatttagctgcttctacttcttggaaccattccttttgctgacatttaggtttaggatattttcctctgagatatttacctatcaatgacactgccagtgagcattggtatcttgcccttggatggggacccactctttaactttatttatttaaaaatgagctttttacatgggtattaatagaaagttaatagattaattaatctattactagaaagttaatagattaattaatctattactagaaagttaatagattaattaatctattactagaaagttaatagattaattaatctattactagaaggttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaatagattaattaatctattactagaaagttaaagatttgtgtatgtctggaaattttaaaaataaatataggctagtatttgccagtgcatcagtcttcaatcatgtggaatcagatcctgggactttttacttttactatctagctatgcccaataatcaagaaaaacgtagttgctgttcctgcctctataatgaattgtaaatgatttctaaaaatgaacaactttccatcacctcttaaaattcagtgatctatatagtgcacattttctaaatttaaactagtttgattttttttgtattgccctgaatatctacactaatgcaatttataaagaacccatgatcccatcctcttgatgttaaatgttatttttggaaatttaatggcatcaggggaatattgaaaccctgaattcctaatcactgattttttaatatccacagtgagtacctcagacacaacccttccactggagtaaactcataaacatgactcttactcttccaagatagattttattcctgcattattcccctgaaaacccaaagggctatgttacttcttaaaaccacaataacttggatttgagctaactttgaaatttgcaaagaaaaggagcccagaaacaacttcctttccatcacatgaaccaggaatagaacacgttcatttcattccatatttgccctcatgcctctcatttcaaaggtggccctgcaatgctgcacctagaactaaatgtttatctttctcagtgacctggaaagtcactgagaagaaaggaaacatgcaagctaaatgctgacagatcttgaaatattgcaattttttgttttctggtgttgttaggatagccttgctttttaaaattgtcctgttgtttcaaaaaaatgtgttttgctggcacttctgttcattattaaccgagcgaatgagttggctagaatgctgttagaaggaaatctttgctatgtgaatgaaggtgggtcatttcttgtcttagtactggatagcccagaagacctagaaaagaaacgaatctgccgcatcatcacccgagacttcccacagtactttgcagtggtgtctcgtatcaaacaggacagcaatctgattggcccagaaggaggtgtactgagcagcacagtggtgccccaggtgcaggccgtcttcccagagggggcactcaccaagcggatccgtgtaggcctgcaggtatgcccatgttagatgcaaatgatcctaacaggattgtattctaatgattaaaaattagctttgtcaaggactgttacctttgttttataatcacaccaaaaaggaaggtagcattaatggtaaagctaaagtcaaaatccatatttattggttactaatctatttaaaaattcaacttatatttggacaattaaccaaaattaatctccagctacaaatgttttcttcttgtaaaaaaaaaaaaagaaattagcttttaaatgagaaataaattgttaaagaatcagattattcctagtaagcaagagctgccatcagagatcgtggatcttacaaaattttatgagtgcttagtaataatactgaacttatgattgccatatttgaagcccaccaaacttatttgtaagataaaaaaatactttggggaagaaatttgaaattaagtataatgattcattctttattttaaaatatatacacaaatatatatgtgtgtgtttttactttgaaaaggctcaacctatgcacagtgagctggttaagaagatcctaggcaacaaagctaccttcagccctatagtcactttggaacctagaagaagaaaattccacaaaccaattaccatgaccattcctgtccccaaagcttcaagtgatgtcatgttgaatggttttgggggagatgcaccaaccttaagattactatgcagcataacaggtgagtcacatatgactgtgttcgtagagagttctgaaaaaagaaacttagatcgttgtaaatattaaattacctttgtcataagatgtctgcagggtcatatgcattaattcagggaatacattttaattaactagggaaatgaaaggtgaaaggaaacaactattatttactaaatgaagtctgtatgccaaactgttagatagtttatatgcgttgtcattctaatctccacagtaaccctgtgaggaaactttaaccccgtgttgctgagaaggaaaccatggttgaaagaagttctataacttgcactataaatatttggtggtgttgggattcaaaaccacacccatatgtctccaaagttcaggcttcaagccttcattgaagagatcactaaatctgctgggaaaaaaaatactgtcttgagtaattatacccaatagttcaaaccaaactgttatgttatggaattggttatgtctttatcattgatctattgaactaactttagaaaaacaacttaaaggttttcagtgattaactgatttttggtcttttcaattgtggttgtgtagtcgctttcagacagctaccaaactctccaaagacactcccagaacgttggtagtctcttcataacaatgccatcacaaatagtgagaggcaaaaaaattcacatgaataatctgttctagggctaaataatttaactgataatttctctatcaataattacatggtgttggtattcagtaaatattagtactattattagtaggaacagtaatcatccctggatgtttttgtattgttagaattattattttcatttctctttcatattggcagaatgttcacctttattttgttttctttaattcacccttcttactcgtatgtttcttgtagttatgatagagaaccacgagattattccataagtttaataataatgagtggggggaaatcatatgcttcacttatgatctctttcccagttgctcatttttggttattgctatcatttctgggtatctttcccataattccagccccgtagatatatgattaaccttctataatgtgcaatataatgtcatggatgtgaaataggtgaggcagaagaatatctgtgatacgctctgcccttatagtgattaaataaacactctaggggcctaaacaccatctactctatttattccagcacaatgtctttagacaggtttctcataaacatttctgaaatttaattaaaattattttaaaaattaacaaataatttaatgtattaattgtttaaatacctagatatttgagtctttgtatttttctgtgtcatgtagttatgctgagtatgtattttaaaggcctactagaataaacttccataaactttctttgataacttgttctcttctttaagaaactttagagtcaagacttttcttcatttcaaacatatattcctcctacagccctttgaactaaaattttgtccttatctatgtgatcttaatttctcagtagacatgaaagacaggtagtcaccattagccttcatggtagtttttcaatgtacaggggccatcctttgatattcatttattttttcatttaccttgcaatatttattgagctcttactatttcacaaacattttttggctaaacttttattgcacatcgagaggaacttttttgaaaacaatttcataaaatatgaagtttaagaacaaaagaatatttagattgttcacttttttttttttttttttttttttgagacggagtcttgctctgtcgcccaggctggagtgcagtggcacaatctcggctcactgcaagctccacctcctgggttcacgccattctcctgcctcagcctccctagtagctgggactacaggtgcccaccactatgcccggctaattttttgtatttttagtagagatggggtttcaccgtgttagccaggatggtcttgatctcctgaccttgtgacccgcccacctcagcctcccaaagtgctgggattacaggcatgagtcaccgcgcccggccgattgttcactgttttaacaaactgttcagctccttaggtggtcaaaggatatttaaaaataatcagctgtatacaattcaaaattatcttcagagccttgcaattataataaaagcttcagaatgtcaggaagagaacagaaggcttaataaacacttattcaaataactaccctaaaacttagtttcttgagtggtagtctgctgtttgttttcagtgtgtcattttttagcatgtagattttagtcattttgttttcaatgtgccattttgaggggtgggatttggcttgtgaacacagaaccacaaagactttattttagaatctagagtctggagttttgcctgatttttttcaacaatcatattatttcaggtggaaccacccctgcccagtgggaagatattacaggaactacgccattaacatttgtcaatgaatgtgtttcctttacaacaaacgtgtctgccaggtatcgttatatagcacagaaaagcccactatgatatgttaccctccaaaaaaactgccctttgttttattttgtttctttattgtttaaaagttattttttcattggattttaaatatggtctgcctttgcttttatattttaaactagatctgtcagcaagtggaatagtgataatacagtaacaaagtattaccaatccgattaaaatctaaggaaaaggagcgattgtctgctttgcctgtatgattctgacttagtcagtagcagctgctgctttttccacttccaaagtccttaggaatgataatttcctgttgtcagcaaaatagcctgaactacttttccaacagaatgataacagcacaaatctcaccgtggtttgtctaaaaggcttagaggcttcagtggctcttatatacatttcttatttatgtattacatatctttaaaacgatgaagctatctagttttattgcttatgcacacaataactcaattgattaaagttagctcccattcctttgatctttaattgattgctaagcattgttacctctctttaacttgacattacaactttgtgacttaagtagggcaagagacattatgtccattttacagatgagaaaactgaagttgagagtaattaaaacgtacatttctatttggggtggaggagaaaacataaaagtgcatgaatagttaagtaatggcatagcaatagttgggtgtggtggcacatgtttatagttccagccacccagaggctcaactattgagtccgcagttctgtgtttcaatgtgttttgccaatttagcatctatactgtaatccagaagatgacatgttctgaataagagatatagaccagagggactaaaagaatgagagaagggtgttcgaattgggatagctagagagggtatctgagaagaggtgactcgagacatgtgttggaacctaataggcagataaaagtgaaaaagagaataacatgagcaaagatgcaaagatagaatgagaaggtgtagtgggggatagcaacaattatccatgtagtctataattcaaaaataatacttgaggctgggcctggtggctcatgcctgtaatcccagcactttgggaggccaagacaggtggattgcttgagcccaggagttcaagactagcttgggcaacatggtgaaaccctgtctctcacaaaaaagatacaaaaattagctggacatggtggcacacacctgtagtcctaggaaccagggaggttgaggcgggaggatctcttgagcccagagaggtcgaggctgcagtgagccgtgattgcgtcactgcactccagcctgggcgacagagacgttgtctcaaaaacaaaacaaagcaaaaaacaaacaaacaaaaaacaaacaaacaaaatctaggactgttggttgccaacactttataaaaggtcttacagggtagattaagaagtgataaatcactgcactccagcctgggcgacagagcgagacaacgtctcaaaaaaaaaaaaaagaaaaacaaacaaaaaaaacaaaccctttggaagtataaaataacaaaatgaaaatatttccatctaatgacctcgactttctttgtgaagttagctctcttagggcctgtggtgagggatgaagcttaaagagtgtcataagatttagtaacgttaccatagtgaacaaaaaattgccagtcaatgtcacagacttagttgaggctggaaatcataaagtcattatagccaataatttcttctatgaattatattcagcaatacttaggagttctggagcaggttttttaaaatggttgggttgattccactttggtgattagagttccatggaaaagaataacgaggggaggaaaagctgggtagattttgttgaaaagagtttcaggaaatgaaatgacagctagggaggggggatcaaggaaaatagaaaactatgcagtgagatccttgtcttatgtctgctattgagttcactccactaaaggattccaaaacactaaatatatagttcagaaaactgaatattcagaagagtttccaaaaaagaaaattagaaatacagtatttaatagttgatcttaaacctgatatctttctctcttctcttcactcccttctgctttcccttctttcctcctacctttccttttgttcctgtcttgctatttctttcctttggccttctctcattatctccctctctcacttccttttttccaagaagcatttgttgactactttgatcatattgaaggaactgattttatttttcacatggtatactttgaactttagataactgactttatttattttaataggttctggctgatagattgtcgacagatccaggaatccgttacttttgcatcacaagtatacagagaaattatctgcgtaccttatatggccaaatttgtagtgtttgccaaatcacatgaccccattgaagccaggttgaggtgtttctgcatgactgatgataaagtggataagacccttgaacaacaagaaaattttgctgaggtggccagaagcagggatgtggaggtactgtaccaaaaataataataataatttatgccatgttgttatacctgcattaatagattacatttcaaatatcatttaataaatagaataattaaaaagtgaaagacaagttcgcattttggtcagttagaaggtcaacatccaaaatctgccatttttagccattttggacctattcaataggaatgatctgtgcatgtgagaaggtaagatgattcctttaaagattatttgaggaaaaattatgagttattgataaactcaaagtatgtaagtgactgtagtactttagatgtttttagctttccttgttgtccttattttttaatagtaactaaaacagtctgggaagtatatctttttgcataaatgttgaagcagggtgtctagtgcttttctacattactttttcttatttcagaattttccatcagtgtaggtctttgggtgttgaagtccagtaacctgactcattgtgatgtcaaaagttacccaagcaggccaggtgtggtggttcacgcctgtattcccagcactttgggaggccgaggtgggtggatcatctgaggtcaccagttcgagaccaacctggccaacatggcaaaaccctatctctactaaaaatacaaaattagctgggcgtggtggcagatgcctgtaatcccagctactcaggaggcagaggcaggagaattgcttgaacccgggaggcggaggttgcagtgagccaagatcgcaccactgcactccagcctgggcaacagagtgagactccgtctcaaaaaaaaaaaaaaattacccaagcataagtttaaatttaggatttaaatgtattttggggttgtggaataatgggatacactttttggaatgagaacattaaatgtcaccatgcattaaagattcccattactagtaagaagaaagagtgctggacatgctgtgtcacagatagacagaatgtcagttgtcaatttaaagatggttgtatgtgtattataagaatttgaagttccaagtagtactaccacttctttgtgtaaacaacaagtataattgcagctactttattgttatttctctctgttttcactcaggtgttagaaggaaaacccatctacgttgattgtttcggcaacttggtaccattaactaaaagtggccagcatcatatattcagtttttttgccttcaaagaaaatagacttcctctatttgtcaaggtaatatatacatggaattttgtgatgcatttttttcaagatcaaggcagaatttgacttcctttagtaatagaaaattttcgcttttcagtcatcttcagagttttctttttaaccatatttgtaacgttttacagccctgggaaacaaatcatttttatttttgaggttcaaagtcaacctgaatttttatagactatatttaaggatgagaacaggacaaataatagccaactcattaattaggcacagtgaccggtattttccaaatttgaaggaaagcttatttatctattataacttttaaatatttatgcttagatttaaaaatacacgtgaacttcacaagtgtggagatcaaaagagttctaagtggcaactttttgtaataaaatctctcaaaagacccagcatctcacttaagctagtaaattatctgcaatagagctatagacttgatatattttcataaattcattcaataaacagcatggagacatttgtgtgcaccaggtgtttgttgtctctaaacagagaccaagttagggatttgaggtgatatatgcaagtttcattttagattccaatctaaaagggaccacatatgaaggaataagagattcaggaaataaaaaggaggtaataattctactctgcattattttccaagctcatttttcttcttgtttctcacaatttatttcactaatccagaggtcctaacgctcaatcctcttaggtataggctggcttctgtcgttttttttccaatcctacttcacctactcatttccaactgttcatcagcaatgactctttttattttaaccacttattatttttccaaacatgtgtctgcaaacctcttattaagtttttccaagatctctgctgagtctctttcattgtgccatttctggttcaattgttttgcctgactgatgatagattcttacagatcaccacattaagcagtaactgctcagaggtaatggatccatttaacatagacagctatataattaagctaatgtttgacatcattggtgtgcagaatcattctacaaacaacccaatacaaaatgagggaagtgcttcagtagacatttctccaaagaagatacacagatggtcaataagcatatgaagagatgttcaacagcgtagggaaatgcaaatcaaaactgtgaagagataccactccatacccattaggatggctattattacaacaaacaaacagaaaataaacaaatgttgggaaggatgtggacgaattggggccctaatgcattgctggtggaaatgcaaaatagtgcagcgactttggaaaacactatggtttttcctcaaaaagttaaacataaaattagtatatgattcagcaatttacttctcgatgtacacccacaagaatttaaagtagagactcaattacttgcacaccaatgttcttagcagcattagccatggtagccaaaatggaaacaacccaaaagtccaaaggtccacaaacaaaatgcggtatacacatgcaatggaatactattcagcctttaaaaggaaggaaattctagtttatgctgcaatatggtaaatgaaataagctagacacaaaaggacaaatattgtatggtttcacttatatgaggtacctagggtagtcaaattcataaagagagaaagcatttgtttttatttatttttttgacctctcctcgaagtgaaataaagatagaaagtagaagagtggttgctagggacaggagaagtgaagaatggggaattattgtttaatagatacagaatttcagttaggaagattaacaagttctaaagatggaaggtagtgatgattatacaacaatgtgaatgtacttaatgccaccaaactagacacctttttaggtttaatcatttttatgattaaaatgatacgttttatgttacatatatttatcacaattttttaaaaaaggaatgaaattctgacacatgatgcaatatgaatgaacttggaaaacattacgctgagtaaaataagccagacacaaatactatatggttcctccatttctacatgttcctagaataggcaaacgtatagagacagaaagtagaatagaggttattaggggctgggcaagagggcaatggggagctattgttcaatggggacagtttcggcataggatgaaaaacattctggatagaagtaatgattatacaactttgtgaatgtgcttaatgccactgaattttctacctcaaaatagtaaaaatggtaaactgtatgttatgtatattttaccataattattttaaaagctgagtaagttctgaagatctaatatacagcattaaactatagttaattgtatgtaatgtattatatacttgaaatttgctaagagatctcaagtgttctcaccacaaaaaagggggatgaggtgattgatatgttaattaatttgatacgctaatcatttcacaatgtatacatatatcaaatcatcacattgtacaccttaaatatatgcaatttttgtctaccatacttaaataagactaaaaaagaaagctgaatgatttttaaaaaggctttccaaatggtaataggaaaagagaaaggaaatcctttgagttcttacctagcagtaacaaatgaattttacttttccctttcaagcatcatctagttaaagtaaatactgcaaatcaaatatgggtgaagcatgtatgtctttcttgttcaaggtacgcgatacgactcaggaaccttgcggacgactatcatttatgaaggagccaaaatccacgagaggcctggtgcatcaagctatttgcaacttaaacatcactttgccgatttatacaaaggtatcgtaaaatctgctatagtgcaattcaggtagagtaggaattgatttttaaatcttgttttaggtcagtgcaaaagtaatggcaaaaacagcaattgcttttgcactgacctaataaaatgaataccaacaaagactgattgaaagcatgtgtaataatcacgtttgattctctgtcagatttacgatttccacttaagaaaaaacgtagtgccacctgatttcatgttaaatgcactttgatgcaaaaattctattaatacacattgggcatggaagtaagaaaatttggcttcagatttaactttttgaagaaatttttaaaactaattggcttttcttcattattgttttcatgtgctttcctgcgaccatactcgtgcatttggccctatgaaaatattagagttcatcaccttctgtttactaccaattcacaggtggcttacatattattaaattcagaactgccccgtgatattttattttttctaagtaattaactattaatcttcgaacttatcatattttaggagcatataaactggtgtgatggtgcacacctgtagtcccagctactctggaggctggggtgagaggatcacttgagcccaggacttcaagggcagcttaggcaacataacttgtgtaaattgttggttaaaataaaaaatagttgaaatagttgattagtaaaaaacatatcgccatgttttgagtagatttaaaacattgttgaaaaggagaaatacattaatttctgaccccaagtctacctacaggaattactttcttttgaaatctctccccctcacgtaattcctcgaatactctgatgaaatcaaagaagacaactaaatcaattaaatgttgtggataatttatgtttcattcttttaaatttttttaaccaatatttcttttgaataggaagctctcacatggcaatctataggtggatgcagaagttgtcagtgtctatataacaggttgggaagggtgatgagtggtgactgctgagacctggaggggaagtaggaatatatttaaaatcctaaatcttgacatcacaaaacaaaaaagtcctatacttctttttccccaccacagttgttaaattttatatttgcttaatgaattattcttgtaaatagagatcagccatctagagaaaagctcatagcattaggtttgacattgtaaatttttattaaatgaataaaataaaatattatttgtatatttaaatatacatgttattccaagaattaaaatatagaaatgggtatatcaacccaaatgagcataatttcattgtattttgatggtgcagaatgtattttggggtttgtattgctgattagtagtgagtcagtggaggcagtatgccaataagaacgacaaagaaatatgtactgctgcgggcaagccacctgagtgttaaagaaagatgactgagctttggctgatttcagtgagctttcagtgtgctctaagagaaagcattaacttcattattacattttatttctaagtcaagacatatcagacacagctattaatgctgtgatagtccagtacaattttctaatttgtaactcaaaaagaaaaaaatcccagacattgtacattgaaaatataccttagtatttagtagctcttggctgggcaccatggcccacacctgtaatcccagcactttgggagaccaaggcaggaggattgcttgagtctagtagttcaagaccagcctgagcaacatagcaagaccttgtctctattaaaaaaaaaaaaaaagaaagaatttagtagctctttgttagaataatgcttctaaatattgcctgtgtattgaaaattttccaccatatgcttatttgtagcttttagtattttcaaccaatatctgtaatgattgggatattatcatcactatttctaaagacaaatgccatccagttcatttaaggtcaaactttgagactgccgtggtgacctagtatctggaattagtatatttataatgttggttcttttgtctcttgaatctataaactttgtacttaagccaatcttcttttctgcctgtcttctataaactgttagtaataaaaaaagagtatgttgactgtatgcttgcctgttgatgcttgttgaaagggtatttatttactctttccttttcttctaaatactctctactcttccttctctcttttttccatcttgcatggcatcttggggcggaaaggaatcagagtcagatcaagaacaggaggaagaggtaattttatgacagtgtcacttgttatcggctgtgtcattgctgtaaccactaataagagcacatagttaacctgtgttcttagacggggtaggcggttcttcttagtaattaaaggggcacaattttacttaacctctctaagcctctgttttctcatcttgtggagcaacttaagggaatagtaaagtttccctgtaaattgttgccatgtcgctatgcaatactatatttttccaccaactgctaagagctaaaccattatctcaggggttcttagtcagaagacatctagtggttgaaactctttttgtactaagacattattaatgtcttaatttttaattaaatgtcttagtacattaaaaatgtactaagacattatttgccttttaaacttctatatcctcacaaactataaaggagtctcccagaggctatactacatgtgatgatattgccactctggcaattaatggaatgtatgcttgcatactcttaggttctagcattttctcagccttcatttgtaatatggatatctatttatacatatcacacaccatcggaagtttttcaggctcctcagtaatttttgggagtgtaaaggggccctaagaccaaagagtttgataaacactgagaccaaaaaactttaagaagcatatagctgattccttagactatatcataatgcagaactatgctaataataataatttcttataaagtgggatctttactaagtgttgcacacgcctcatcaatgtcgatctctcacaaacacctatgaggtgtttgttattaaatactacattattgatgaagaaagcaagtcttagagaggttaccttgaataaatagctgtatgaattaaacctgcttcaatatttaaagcaaatgtgtgtttgtctccgttataaagatctgaaaatgcccaaatattataatagaaatgaaaaacataattggaaaacttaaaataatatgtttctaagatagacagatgcatatgttattagttatatgtaaatgttttcaaatatactagttttctttttttaaatgttattccaatgcattcaaaataaaaaatataataaatacccttatacccaccagcttaaaatgtaagcccttatcagttcagaagatgccccggattcgttttttttctgataccttgcaatggagcagggtgagagaggtgactatagaagcactgtcctgccgcacatagccatatacacaatcaacttaagactgaagtcattctttccctcaactgcacagtcactctttgcttcacatactccatttccttcctgtactcagtgaccctaccactacagctgttaaaaatgatagggaagccaattttgccatgttcacaaatcacttttttctcttagataattttcctactgaatactttctggaactatttagggcaatagatccagttcatattcttttcaggatctggaatgctggcttattattaacgataatgaaactacttctgtagaacacatcaccctagtgttgctgtttgtcatcctttcctttttctccactaaatggatacttattattcaatactgacttcaccctttttctgatgtattccctaaatatgtattccaacatcaaaaccagcctgggtcatatcttcccaggattaacatgctagaaaggactttctacctgtagtgtctagaaaacagaaggtttttttcaaagtcaggataagaatcatggagactctcaggaaaaaatgtagcaaattactctgaccttcctatagctatggtgtcacccaacatgtataattatgaataggagctttttgtgcacaccaggggctatgagccaaggcagtatttgtaaccattcaatttatgtatgttttctttcagatcgatatgacatcagaaaaaagtaagaatttaaagaaaattgagtttgtttgaaagctggctaccataaaaagaagcatgaattaaaatgcaagctagttgctattactaaccactatagtaattacatttttatattatccttattaatcattaatatatttataaaagcagcttggccagttaaattacaaatatacctaatttgcgagctaattagcagtaaaatgcaatgattattcatctaagcattcactttcttttgacattcttgttaaccctggtattgctgttatgcttgtttagaaacccaccctaccgttttgtccatttgttagcaaaacactgtcatctcatcattttttaagcactgacatgacagtatcactttttatgtaatgcaatagtgacttctgtagagagctcattatttttgtaggatacacctgcaaaagtgatactgtctaatagttcttagctgaagctaaccccatccaatgcctgccccctcccccatcactcttttgcactttttactgtggtgaagtgtaaccaatgtctttagagctgaggtctaacagacttctgtgaaaactttctgaaaaaaaaccacaaaacaaaaataaacaaaagtgaagagccaagaatgcaaaattaaaaccccctggataaaattactaatcacaacagcatgttattatagggttaattttaaataatgatgcaaatcccaaacctgatctagtagagagagaactggttttgacagaccttaaaagagctatcttagaactcatttcaggtttgtaatatccaattaagattttagtttgttggactatttctagtgactctctggcttcttgtgtggaaactccagttgaattttacagatttctgcttttgtgccccaaatgctttttaaaaatctgatttttaaagtttattgaatatcaataaactttatttcagagtttattttgatttgctgtatttcacagtatattcccaaaatgagaaaacttagaaccatgtttaatatgctcatgtggccctacacaatgatctgagggcttttttaaagtcctaggacaatgtaatttactactaagttatggaagttgctttgaatgaggcttaccctcatgttaaagcattattcagatctagaatgtttgagattctggatgttttcattggtttatataattgaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacctaagcctcaatataccaccttcagcagcttatgcatggactcatagggaaataagtacacttcgccacagtaatgttttacatatctgttctaaattcccgccatcctcctgcccatacgtttcagcaaggccgcctctcccagccgttttactccacctttgctttgcatggaaataacttggcttacataaactgtgtgtgtgtcccgtgtgactgtctctgacttgggttgccatgcatcacattttaactttggactcacttataagtttaatcacaattgttgtttctgttgtttttctttcctttcctttatttccctccttggtctgtccattctgtgtctaaacaaggaggttgctccaaggaaaggaccatgcctcgtagcaccagactgtttgtttcattgttaggtgtgaatttcccttagatgaaatgccggtttgcagctgattcagatgtattttatatagtctttgtatattggtagaactaaacatactgaatttcagacttttatatgattaaaaatgtatatacatcattagatgttattctgagcttgctactactggctttctcctagaggaaatcaactttctgcaatttctaatgctttttttcttattttttcctcatggttggttttcttttttttttcaacattgatctgtaacatctgaacaatcttgagatacctctgtgtaatttcactgcgttctttgttttgatatgtagtgtttttttgtgtgtgtatgtgcgtcttgttttagctttgttgtatgtgtggatgtgctacaagtgagaaaaattaagcaagttatttcctgctcatttttccttttcagttgttttttttttcgttagccttgctttgctcttgtaccctgaggccttgtggatctaccattcccagcccattttgttgcccctcccaccaccaccaccacaggaaaagacgctgtgtcgtttcagtcctgattacatttgccaatatcttttttgatttccattttactttcaatgtttttcattcacatcaaagatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaaggagctggtgaaggctgctgaggaagagccaggagagccttttgaaatcgttgaaagagttaaagaggacttagagaaagtgaatgaaatcctgagaagtggaacctgcacaagagatgaaagcagtgtgcagagctctcggtctgagagaggattagttgaagaggaatgggttattgtcagtgatgaggaaatagaagaggctaggcaaaaagcacctttagaaatcactgaatatccatgtgtagaagttagaatagataaagagatcaaaggaaaagtagagaaagactcaactgggctagtgaactaccttactgatgatctgaatacctgtgtgcctcttcccaaagagcagctgcagacagttcaagataaggcagggaagaaatgtgaggctctggctgttggcaggagctctgaaaaggaagggaaagacatacccccagatgagacacagagtacacagaaacagcacaaaccaagcttgggaataaagaagccagtaagaaggaaattaaaagaaaagcagaaacaaaaagaggaaggtttacaagctagtgcagagaaagctgaacttaaaaaaggtagttcagaagagtcattaggtgaagacccaggtttagcccctgaaccccttcccactgtcaaggccacatctcctttgatagaagaaactcccattggttccataaaggacaaagtaaaggcccttcagaagcgagtggaagatgaacagaaaggtcgaagcaagttgcccatcagagtcaaaggcaaggaggacgtgccaaaaaagaccacccacaggccacatccagctgcgtcaccctctctgaagtcagagagacatgcgccagggtctccctcccctaaaacagaaagacactctactctttcctcttccgcaaaaactgaaaggcaccctccagtatcaccatcaagtaaaactgagaaacactcacctgtgtcaccctctgcaaaaacggaaagacattcacctgcgtcatcatcgagtaaaactgagaaacactcacctgtatcaccctcgacaaaaactgaaaggcactctcctgtgtcatctacaaaaacagaaagacacccacctgtttcgccttcaggcaaaacagacaaacgtccacctgtatcgccctccgggaggacagaaaaacacccgccagtatcgcctgggagaacagaaaaacgcttgcctgtttcaccctccggaagaacggacaagcaccaacctgtatcaacagctgggaaaactgagaagcacctgcctgtgtcaccttctggcaaaacagaaaagcaaccacctgtatcccccacttcaaaaacagagaggattgaggaaaccatgtctgttcgggagctgatgaaggctttccagtcaggtcaggacccttctaaacataaaactggactctttgagcacaaatcagcaaaacaaaagcagccacaagagaaaggtaaagttcgggtagaaaaagaaaaggggccgatactaacccagagagaagctcagaaaacagagaatcagacaatcaaacgaggccagagactcccggtaacgggcacagcagaatccaaaagaggagttcgtgtttcctccataggagttaagaaagaagatgcagctggaggaaaggagaaagttctcagccacaaaatacctgaacctgttcagtcagtgcctgaagaagaaagccacagagagagcgaagtgcccaaagaaaagatggctgatgagcagggagacatggatctacagatcagcccagataggaaaacctccactgacttctctgaggtcattaagcaagagttggaagacaatgacaaataccaacaattccgcctgagtgaggagacagaaaaggcacagcttcacttagaccaagtactcactagtcctttcaacacaacatttccactcgactacatgaaagatgagttccttccagctctgtctttacaaagcggtgctttagatggcagttctgaaagcctaaagaatgagggggtagccggctctccgtgtggcagcctgatggaggggacccctcagattagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcagaaaacggggagaaaaagaggttcacacctgaagaggagatgtttaaaatggtaaccaaaatcaaaatgtttgatgaacttgaacaagaagcaaagcagaaaagggactacaaaaaagaacccaaacaagaagaatcttcttcatcttctgacccagatgctgactgttcagtagatgtggatgaaccaaaacatacaggcagtggggaggatgaaagtggtgtccctgtgttagtaacttcggagagcaggaaggtgtcttcctcctcagaaagtgaacctgagttggcacagcttaaaaaaggtgctgactcaggccttttaccagaaccagtgattcgagtacaacctccttctccacttccatcaagcatggactccaattccagtccagaagaagtacaattccagcctgtcgtttccaaacaatatactttcaagatgaatgaagatactcaggaagagccaggcaaatcagaagaagaaaaagattctgaatcccatttagctgaagaccgtcatgctgtttccactgaggctgaagacaggtcttatgataagctaaacagagacactgatcagccaaaaatctgtgatggccatggatgtgaggccatgagtcctagcagctcagctgctcctgtctcttcaggtctacagagtccgactggtgatgatgttgatgaacagccagtcatctataaagaatcattagctctccaaggcactcatgaaaaagacacagagggagaagagcttgatgtttctagagcagaatctccacaagcagattgccccagtgaaagcttttcatcttcatcctctttgcctcattgtttggtatctgaaggaaaagaattagatgaagacatatctgccacatcttctattcaaaaaacagaggtcacaaaaactgatgaaacatttgagaacttaccaaaggactgcccctctcaagactcatccattactactcaaacagatagattttccatggatgttcccgtgtctgacctagctgagaatgatgaaatctatgatccacaaatcactagcccttatgaaaatgtcccttcccaatcttttttctctagtgaagaaagcaaaacccaaacagatgcaaatcacaccacaagttttcactcttctgaagtgtattctgttaccatcacatcccctgttgaagacgttgtagtggcaagctcctctagtggaactgttttaagcaaagaatctaattttgagggccaggacataaaaatggaatcccaacaggaaagtaccttgtgggaaatgcaatcagacagtgtctcttcatctttcgagcctactatgtccgctacaacaacagttgttggtgaacaaataagcaaagtcatcatcacaaaaactgatgtggattctgattcttggagtgaaattcgggaagacgatgaagcctttgaggctcgtgtgaaagaggaagaacaaaagatatttggtttgatggtagacagacaatcacagggtaccacccctgacaccactcctgctaggaccccaactgaagaggggaccccaacaagtgagcaaaacccatttctgtttcaggaaggaaaattgtttgaaatgacccgaagtggtgccattgatatgaccaaaaggtcctatgcagatgaaagttttcactttttccaaattggtcaagaatccagggaagagactctctctgaagatgtgaaagaaggggctactggggctgatcccctaccgctggagacatcagctgaatcactagcactttcagaatcaaaagaaacagtggatgatgaggcagacttacttccagatgacgtgagtgaggaagtagaggaaatacctgcttcggatgctcaacttaactcccaaatggggatttcagcctccactgaaacacctacaaaagaagctgttagtgtagggaccaaggacctccccaccgtgcaaacgggtgatatacctcctctctctggtgtaaagcagatatcctgccccgactcttctgaaccagctgtacaagtccagttagatttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaaggtatttgccagccaccgggattccctgtgctacgcatgtcataaaattgatatagtttttttgtatgtttgttttatttgatgatttgtgtctcattttctttaagctttctgtagtggctaatgtgtttgtgtaagccctttgtgttttgtgctttctctgtatactcttgtctaagaaaacaatctcaagattgagtaatgagaatgcttatggaaaacataaacataataaccgggcaacagtgatcttgccttttttagcctctgcacgtaataaggccatgcgagctttgagttttgttgttctgaagtcccaagcttagactcaaattaagcacttttgcacataaatatattgtattttgtttcatagtatgaagacattgcttttcttcttatcttcgcatactttaaaataatttgtacttacaattttgtaatcattaggaagccatttgcttgagaagatttcacataacatgaaattctaattgttgtggatctgtttttgattcagaaaggttggatttcagataccattggtaaatactttaagcaaacaaacctaaggtaaaaatatgcttttcatttatgtggtagatgaatggagaatgtactctcattagatgcagcagacaacaaaaactcaaactttgcacagtttaagttgactgtgaggggatgatggctctttgacttataaaaaaggaaaccatagatggctttgaaaagtagcctgtgttcttccaatatctctacaatgaagactgtcattcttaaattgaggttatacaaactttcctataccatggtctaaaatgctgcctatcaatcagtgggagttaaacatgaatgggaaaattatagtttataggagtgagtagtatataagcttaatagcaagaaggcagaaactttgcccaaaagacatatatgcatacagatacaatatacacataaaaatgcatatgcttttatcctcgtttctccaaggtcaccaggaccaaatgttgtttctggccacactaatcaggatggcctgatcagctcatgatcaacatctcttgtgaatctctgatgtgattcctttcagacatgacctggaaatgatctatccctccacaagcaataataggaggtcctagccaattgctctacttctgcatcccatttatgatttctctggtgtttcatgaacaagatggtggtcttcttggtgggcagtattctctccaataatttaaaagtcataagattactagaaatcagcaacttatataattatgtctagaactagtcttgattaaagagatatggaagcagatggttttcatgattcatattagatctattccccattccaccccagaaatcagacacacaatatgatctgaaatgtagtatctagtttgtgctttcaaatatttggagaagtgacttcctttctttgaatgaatcagtactgtggttcctctcctgtcatagacaacctttggccattctgtttttgaccttctccagatccacaggatgagcaggaacggatcgaggaaaggctggcttatattgctgatcaccttggcttcagctggacaggtaaaaagaatgtgacccaggttttcaacaaaacctgacatagatgcatcagtcaggtgtcattcacagcataaaaggtaccccccactttcttgagaaagaatacatgaaaagaagaataaactaagaactagaaaacctgggctctgcatcagctaatggtatagcccagggcaggccttttatcatctctgaaatttagaataatagaactttctatttgaagatttagagaatataccaacattcaggaacctctgttggcagttgtggatatctaaatttgggggagattattatgtttcaaaatcatttttagatgtaatttttatcaaatttaatgtgagatttaaccagggctccttcttttagataccttatgtcaaaaatcttcatagtaaacaacactaaaaattgctttgggtaagtgttaaaacacacatgaatgagatatttcactaatatttttgagaaatgagagtgtttaagtatagaaattttatgttaataatttattaaggaaaagtgaattctaaaatcaatatactttatttacacattatgaattgtatgttttaaaaactatacattttcatctacttgtgacttaacctattaaagcaagattctcagtctggctttttttttttttttaatatcacttgtgactacttcaaagagacaaacattgtaaaataatattcttttcctttccatttcttagatttggtgatgaataggagcccataatactcataaagataactactaatttagagtacatgactggagaagtggccactttctcacttgtaataattttaaagtaattcttacatactgatcagacttaactaattcggggttttaggggagagaatgataccaaactatccgtgattgacttactagataacattcagaattatttattttggtttttaaatatgtttgtatccatacctacatagtaaatgcaatatgtatatatttggtaaaaattcaaatcctaccaccatatagaatgacatagaatgaaaagtaaatatgactctcacacctacttctatcttctagccgtgtgcctcagaagtaactgctaatactttctcatgcttttagaaaaaatatacagtgcctatatttatgcctgttatttaaaagtaagaaaagttttactgaataatattcctcataagtagtctgttaacatatacacatgtatttcattcttttaagtgggtatttaattccactatatggaggttccataattttattaatggcttttgttgatgggctttaggtggtttcccagtaacggcagtaaatattcttgtgcattggtatatttttgtgagtatatctatagggcatattcttagaagtagaattgctgcggaaaagatacgtatatttttaattttgaaagatattgtcaaattgccttcaaaagaggtcaccctatttacccacacacgcatacacacaccccataatgtataagcatccatatgtaatggttttttgtttgttattttgtttttgttttgttttgttttacagagacaggatcatgctctgctgcctaggccagagtgtagtggcacaatcatagctcactgtaacctcaaactcccaggctcaagtgatcctcctgccccagcctcctgagtagctaggacctcaggcaaacactaccatgcccagctaattttttaaaattattttttgtagaaatgaggtttttctatgttgctcaggctagtcttgagcttctggcctcaagcaatccctaccacctcagcctcctaaagttctaggattacaggcatgagctactgggcccacccaatccatatggaaggttaatagtagaattcaaaggaaaattttgtgtcttcttccctggatcaattaatgcttcctcgacctcttattcagttgacatcaaatcaaagaaaggcatttatccaaccaccataatatagctacaactagtatttatcaaagtatccagaaacaggatttataatactcaaaacatcacctatgttaattaaagggagaaactttttttcttttgttatcagtcatttattttccattatcttgcttaaaagtataagcaagtattaatgatctcatttgcattttggaatcaaatgggcctgaattatacatatcttatcattgctgcctcacacttactattttcactatgcagtgataaattctatacccagttttaggggaaaaaatccataattagtactagaagaacaaaggcatataagagtcacttctaatatgtagaaattaaggaactcaaatactcaccacaatataaagaacacatcatttacaaaatcacaaagcaaaatgtagagactgaaaccttgaagttaatgtgtttacaaagtagtattttatcttctagaattagcaagagaactggatttcactgaggagcaaattcatcaaattcgaattgaaaatcccaactctcttcaagaccagagtcatgcactgttgaagtactggctagagagggatgggaaacatgctacaggtaagtggggaactatatgcatattgggctaaagttggacatgtcttgctcaacaaccgcatcttgcaaattcagtagaatagtaaagaagcaaatgccattaatctgcagtacagtgggtccttgagtaatatcattttgttcagtgtcatttccttataacattgatgagaaaaaagaatcaattcccagcaaggccactgtctgtgtatagtttgtgtatcctccccatgtctgtgtagctttttccccagtattccagtttcctcccacatcccaaagatgtgcacatcagtttcactggtgtttctacattatcccattctgagtgagtgtgggtgtgtgtgagtgccccctgcaatgggatggcatcatctcccagcttggttcccatgcaaagtgctctgagctgctgggttaagttccagccacttgagaccctgaactgaataaggggattgggaaaagaatgaatgaattgatacaaattgttgtcaaatgaaaatgtatagagtccatggtaattacacaaatgcatgaaataaatgatgccttaggaaagtactcagcgagcccaccatatttgttattgtttgtttatgaatggcatggtgggaggaggtgctccttacaattttcactttgcaaagatttattccttgattgaaccccaccaccactatgaccgccatcacgcattggttcctcaaaaattgaataattatcttacttatgtttattagtctttcttaaatgtatgtgtaactcactttcacttcagtgtttaatattaaaagtgtttggggttttatttagaagtttggcagtgtttttgtgaccagaacattgttttctaagaatctatcaatgatgttgagtgagaacttagtgaactactgtaagcaaatgagaacaagctactgtcacttctgaagtatgcatgttgcttaaaaactcttgcacgatatgcgtatgaaccgcattaaataacagccctcacttctaacagtaatgttactcaaaccctaatatttttaaaatattgataagtggacacaattgctttacttagcattgtttcactggtagtgcattaccttctgtttctgcttcctttactcataaataacatccagtctacatttatcattccttgtctttacattcttctaagtagaattgtcagatttagcaaataaaaacagaagggtgcccagttaaatttaagtttcaggtggtcagcaaatacatttttagcataagcatatcccttgtaatatttggggcatatttatactaaagaagtatttgctttttatctgaaattcaggtatggtgggtgtcctgtatgttatctgacaattctacttttagggcttttgcccatgctgtaccactttttttatgcatatctcttttgtctgttggcttatttttacaaagacttttaattaggctttgattgtttttttctgtacagatatcaaaaatttagtaaggcagttgagtgaaagagatttttaagagtacctctcagacataataaatgctgtttctctaatgtgtcagataccaacctcgttgaatgtctcaccaagatcaaccgaatggatattgttcatctcatggagaccaacacagaacctctccaggagcgcatcagtcatagttatgcagaaattgaacagaccattacactggatcatagtgaaggtcaaactgtgtgtgtgtatgtgtgtgtgtgtgtgtgtgtgtgtgtgttgtgtctgtgtgtggttaattgaggcactggacctactgtcttttttttttttcagaaggtagaccatggcctatggtgatcatatgttcttttccttgctaccctgaggctttcctccctgttttacacaccctcccacctccgcttcatgctcattctttgttatttcacagataacaaaatgatccattgaattccttttcctcagttccatggtggcacttcttacacttgtatttttttatgctaccttagccacgtatttctaggctcacaactaggactatatcactaccagtgactgtacatttcctcttttacttctgcaccaacagtgcttcataccctcggggacctccagccattggccttaccaccttttcagtgttaaagttcccctaacctattctcattcatttgtggtctctaacactgtttttttttttctctctctctcttatctctattttacatgttgtcttcttccttcaaacctccaacactgtctcttttctttatttatacccagctgatgaccaaacttcctatttcttagaaaataataagaataatcagaagcaaatgtctatatttttccaccacgaatctaccaacatgagtgcatctcaatgcatatacttaactctaccttccatcctattaaaatggataaaatttcttcacttttctaaagccatcatctcttgttttgtactagatttcatctccttttactcaatcagggactccattcctgcaagtatcccttttggcttcctaccactagaccatacccaacagcattaaaccatgctttaatagatcccatctttaaaaacaaaacaaagcaaataactccttttaccctatatgtcccccctgtattattgctgttactccatccatttcacaggaaacctcttaaaagaacagtctgaatttcctgtctctacttcctctcttcccattccctctagagctctataattcactctagtcaatcttataaaattcacctattgtttcctctttttcaaatctagcaggcagttctcattcttcaacttactttgcctctgggtaacatttggcatgaatagtgaagcctgccttcttaaaacattttctttacttaaatttcatgacattcttgcttccttttttttttttttttttttttttaactttactggctgtttctccttcctgtggcaggttacttctcatggatgtgaatgatgatgtatcttaactgttgagcaagagcctcatagcttgtcctcatctcccacctctgtctctatcgcactggtcctgcacgcctggcctccttgccatttctggagcaccctctgcattctcctgtttcagggccctggtattttctgctccctccaccctagcatgttctttcctcagatcaacatatacctttttctctcactttatttaggtcactgctcaaatatcgcctcctaagcagagcctttcctgacaagtctatttaaaatactagccccatttatcctctacctttatcctggtttacttttctcccaatatttatcataaatatatatctgcagaaatgcaagttcagtggggacggaagctttttatatcttatatcttgttcactgctatatatccagcatctaagcagcacttattacatagttggtgctcaatatatatctgttgaataaatgagtcaatagatgaatgccagtcactcctctgctaaacatctttcaatgactcctcatttccctggatataatgaaattccttagcctgtcataaaagactctacataaaaagagtactatccttatagtgttagagtgagtattaatcaagttaatacttgcagtgcacttgaaacggtgcctaacatggaataaattttcagtatgtattagctattgtttgttatgatgattattaactgtactcatcttactcttcagattctgtgctttgactgtctcagtcaattcccacttgccattaggtctccttggcatgtaacacactctgcattttctttccaaattctaaccccatgttaggtgctcccacactcattgactggcacctatgacccagttgctctgcactggaattgaccgttacttgcgtggactcttctacatgatccgtatcttgaaggtggacacagtgtcttcttcatctttgtaatccatgggcccatctcaggatgtagcacatttatcttcttattttttttatcctcttatatttattacttaataaatatccattcaatataggtaagcttcaactaaatacttaaatcattctgcctttagggttctcggtacttcaagaggagttatgcactgcacagcacaagcagaaagaggagcaagctgtttctaaagaaagtgagacctgcgatcaccctcctatcgtctcagaggaagacatttctgttggttattccacttttcaggatggcgtccccaaaactgagggggacagctcagcaacagcactctttccccaaactcacaaggagcaagttcaacaggatttctcagggaaaatgcaagacctgcctgaagagtcatctctggaatatcagcaggaatatttgtgagtttccaaagaaagcctgtcaaatgtaataccaaagaaacaggctattgtggatgccaggcatatataagcataactagtttttaaatactttttaaaatgaccctaccaaacacaagtgccagagctaaaggggaaaaaaaaagcgttaacatgtaagagacataattgtgacagtgtttggggcacagacctacaagaaccaacttccagagctgtgactttgaacaagtccttatgtgctttgaatctccatttccacatctgtaaattatagtaataatacacacttgactcatctcacagggtcaaaagtgtgtttatgaaagcttcatctaaactgtaaaattccctgtagatgacacggccatgacttataatattgctgcacctcatttgctctgtagcacttcaaatatgctctgtagcacttcatcgtgccattgctggttaggagtatggtcagtgatgatgtagataccacagccaatggtgcatttcaaccaagctatgaggggactaatcataaaaatataaatgcaatgcaaactaaccacatagaataaaagactattaaaatgagttggaatagagttggggtgggagtaaagagaagccttccgaagagcttctggctgaaggaagctgcaggcctaatttggctcagaatttaagttccggcctttatggaagccaaggagaaagagttgtttaattgacactgattgtccagaaaagaaaacaaattgtgagaaaggccaacatatccctaaacctgaagtctgagaatagggtgtcatgagattgtatcaaaacatttcgcttgtcatttggtgagttttgtggtcattgacatgagaagaggatgaaatgagtaatgaaattatctcttcttccactgagccacccttgccccatcaacctgtaggttttaaagaaaatataaggaagaaggagaaggaccaaggaaaagatgggaagaagaggagaggataacagagagacattttaggcatttaatatctatggagtgatagattgcactgaataccaaaagaaggcacagaaaaggccaataatcttatttagcagttgaggttatcaaagttacattggagtaactccagactatatcaatgaaaaaagtttccatgtcaacagatgcctctattattaaataaaacagtttttcagaggtacaataagaatttccttgtatttatacttatgataactatattaacatggggatttatgtaattctgccaaatttttattcttgcttcaaaagccttattatctacaaatacttatgtaaaattcctcgcatcctcaatatcaccttgagttataaaagaaaagatgaaactataacttatatacattgtagaggttgggtaactgtaatacattttaggataatttttgtctttagaataataacatcactctctgccagtgctagatcaatgagctacaactctatatcttgtcatattatttttcttcaaatgtcctttcttggccaaatgtacaaaaactattttgactgtcatagactatggaaaaaccagctccatcttgcctttcgatttccttgcttgagcaggaggtgaaatgcaaatgtccctgaagtctcatttggctttttgattccagtgtgacaactccaggaacagaaacatcagagactcagaaggctatgatagtacccagctctcccagcaagacacctgaggaagttagcacccctgcagaggaggagaagctgtacctccagaccccaacatccagcgagcggggaggctctcccatcatacaagaacccgaagagccctcagagcacagagaggagagctctccgcggaaaaccagcctcgtaatagtggagtctgccgataaccagcctgagacctgtgaaagactcgatgaagatgcagcttttgaaaaggtaagacattcctctccactttctcgcccacctgtaacaaagctacaaatcttccagtttccatttctatgatggtttattttttgcacttcaaaacaaaaaagttaaccaaattaattaacctggcacatggaaaccctcaatcccttttaaaatctgagagccgatgaatcttgaagaaatggcgcacagttccagtgctgttgatttgaccatgagccctgatcttatcattggaaagtcttttgctaagaaaaatgaatacggtggtgaaacaatatatctggaggagcttttcaaaattagtaaacttgggcatgaaacctggtggcagagattagcagcaccaggtaagtcagccatgggatgtgctgggaccagcaggcttgttagatctctggcctgccaggtgatgagcacacagactgtggatattgggtggggtttagctgccaaaataaatttttctcattagaggcaagatgatttccaagttagatttttttttttaagatttattttaggaatgactgagaaaaagaacattgtacctaaattaaatgtccaaatgcctgacggtggcataagattgcatcatagcgcttcctttgtcattaagtgagttttaaaattgtgaaaaggggtggggaccatgttaagaaattaaccattggccaggcgcggtggctcacacctgtaatcccagcactttgggaggctgaggcgggtggatcatgaggtcaggagatcgagaccatcctggctaacatggtgaaacctcgtctctactacaaatacaaaaaaattagccaggtatggtggcgagtgcctgtagtcccagctactccggaggctgaggcaggagaatggcatgaacccgggaagcggagcttgcagtgagccaagatcataccactgcactccagcctgggcgacagagcaagactgtctcaaaaaaagaaaaaaagaaattgatcaacaatttattctcaaaatgtggtctatatagttcacatacgtcagaattgattggagagcttgatccctcctcagaaatcctgaattagaatgaatcccagggtggggagggaaagcaagaatttgccttttaaataactccccagaggattctcagccacaaaaaaagtatgagaatctgtttgaattaaacttaatttaatatgaattaaacttaatttaatataaattaaattagatattgttttttcttttaaaaagtaatagaattcaaaaacactttatatttcaaagtgtttttagagcattaatataaagcttagtagtaaaagaagagttaaacaaaataattgaaattttggggggcaaataaagtgaaacagcatgtgtttgggcttaagacacacatttgtttttgttcactgtaagaatgagatctgctgctaggaattatctgaaatcacaactaaaattaggaaagatccaggcagatgagaactgtgtcctgattttggcagttttcttaaataataaattcatgccatgaatgaatttttattccaagtttgcttttgcatagaattattcatctctcaaattcttggcttgaatgagtactactaaaaatgtttcttacatgttatctaggctaaaagttaccaaatttaacctaagaatccataggcttagtgaagttagacttgaaacaattatctggataatacatatgtttaatctatactaaaggaatatgtttgtataagtcactctgaatttcacataatttatacaggcctgttcgacttattcttgatgagtatcaggcatttctcttaagcttcccatgtggacccttatttctcataaccctaacttgggcatccaattttaatcacttttcttgccaaccatatttctaggcagtagattcctgattatatttaaaatataatttggtttagaatttacaggtcttcctttagcagagacaaatgtaaacatataacttgagttttacagtgtgttaagtaaatctacttgagctttctcttttttaaaaacaaaatttcattagggaagagtaattcaatatatgactcctaaggtaatgtgtgctaagctaaaattatgttttttgctttatctctggcttttggccagagccctaaaatactattgaccactttatctcaacttctccatagaattattctaatattattcatagtctacctttttttgatgccagggagatgcactattggttagataatagctacaggaaactttgacttcctgcaaaaagttctgctagaaacaggggatattcctatacctttgggtgaataattccaagcctaagcaccagtgtcagtggctcataagtgtttactgaactgcttagggtctatgtttacagtcaggctttttttttaggagtttaagtaaaagaagtcacatgagcaagctgctttttattttggagagattttgacagatgggttctccaacagctctcagaattccagaattttttttcattcattgaacaacaacaacaaaaaaccaaaacactctatttttgttgatgtctgagaccagcacgtatttgttttcacctctaccaacttgtccatcaaagcctccatgaataaaagtttcacaatacaatgtaagctaaagaagaaaccagtagtgaagtcattccttagcatgttaaacaaagcaatgcttccatgcttccaccaggagctaacagaggaattaggggagctggaggccagctcagatgaggaggcgatggtaactaccagggttgtccgccggcgagtgattattcaggtacccactgttaaattactgcacgtcagggacagtcctgtccccatattctaagagtgatcaacctggatcaatgaaggcttggcatgttccttaggtagtgcatggccattcaaaagcagatcccttaactctcataagttctgtttgcaaacaaatgcagtggttccagctttcctccaggagagccaccaagcaagagcaagacttggcttcttcacttccacccacctcacctctcgcttttctatttttgttgaagttttatctaactttggtcagattctcctaagcatgttattacccacttgagtttttcactagttgacaggattttgtatctcagcaatgcttctcaacatcgcctttgattttctaacattcctcacattataagcacttgggagtagttcctcagaattggtgccaaacaccacagtgacccttttctctcaactgtttagggagacgatatgcctgaaatacccccagaaacagtcacagaagaagaatacattgatgagcatggacacaccgtggtaaagaaggtattgtctagtatatcctaacagggttgattacaaacttcctgtttaaaatttatcaattccatggtactgtcacacaaaaataagatacacaaatgaaatacatttcaggttactaggaaaatcattaggcggtatgtatcctctgaaggcacagagaaagaagagattatggtgcagggaatgccacaggaacctgtcaacatcgaggaaggggatggctattccaaagttataaagcgtgttgtattgaagagtgacaccgagcagtcagaggtgagacaacctgattctctaaaacccatttgatggagaggaacaaaatagagctcaagaaagatgagtgagattgtttattcatattttcctcacttctccctttcatgtggcagtttgctcttagttgcacattcacctttttgttttcatgattctatgtgattttaagacagccatcagggagacttgtaggcattatactcattgtttttgtttggtctttttaaaaatatctattctttatttaattcatggttgaccactgcagaaatccaaaagtcaaattttgaaagaatacaattctatttgctgggcaagcagtatgctgtggagacaccgtgtagaaacgcactgtggtgcttgtgcctggttggcacaccagccttcagaaagtcactctagataaatatttgatattcagatttctgcattgcagagttactaaaatcaggatcgagaaactctttgatttatccttgttttttgttttgagacagagtctcactctgtcacccaggctggagagcagtggcgtgatctgagctcactgcaacctccacctccgggttcaagcaattctcctgcttcagcctcccgagtagctgggattacaggcacccaccaccacacctggctaatttttgtatttttagtagaaacagcatttcaccatgttgggcaggctggtctcgaactcctgacctcaaatgatccacccgcctcagcctcccaaagtactaggattacaggcatgagccactgcacctggcaatctatactttaatttatttctgttttacttccctttttcagggacatatttacttgttttgacaaatagtttgtgaaattctattttccattcattcacatcctcaaaattttatattatacacatgagattctctagaaatctacttttcagtttctcatagcttttagagctcctcctttgagggctaatttcatctttgtaataccaaaagaaattatttaaacatgagaaaagagagtttcttcacatattattatgtctgtattacactgagcagtttcttattcacaaaactgataactttttgttcaaatgactaattaagattgctttggtgttgtggagatacagtcatgatgtagatattaccaataggttatagttcgtttttttctaactctgcttcccattgctgttttctggaaagccagtatgtaactttatagttttgtcctttgttttttaacatagaaaaaattcatcatagttacatttggcaatcagacattgtctattgtgtgtccttcgatcattaggtcactttgtgtgagcccagcattttgtccagtacctcacaatttcaggctgagccagtggaaggccgtagagtcagcaaagttgttaaaacaactgtggtacttggagagaggatggagaaacatctgggggattctagtttagccactgatcttccttcagccaaagatgactttgaagaggtatagaagcatcatcatttgtctttttatgtgtgtgttttatgttgctttgcatttgaaaagaaaatcgtttgtcattgtatcattctatacatgaattcatggaaaggtgcagaataattcaagagggtagaactcctgtttgaataacttgcagagtaacgtttccttaaactgtggtgttcattggtgtcaccttaacagcttttaaaaatccaggtaactaggatttgcttctgctgaatcagactcagaatctctggagctggtatatgattatacatcttgtttaaaagtcacagaagtgtcttgctttgtcaattaataagggaaagaaataaagacattgcaaattatatttgctagccagtcttttcaaatataatctgtgatagacattaaagaaaattcagatatattccatgtccataaattttaaaagcatttacaattacttaagttctggtttccaacaattagaaaatgggtccacggttggccag

SEQ ID NO: 13531 - DNA, 145287 bp, Human; identical to SEQ ID NO: 13530

SEQ ID NO: 13532 - DNA, 19454 bp, Human
acagagctagtcctgctgcctctgatctgaggcagccctcgtcagaccctcctcctcaggtgtacatgtgtgttcaacccactgtctggcagagagggagatggaggggcagggtggctgccagagtggtttttgccctacagccctagatcagcacactgctcctttagctggcttgggtttcttataattgttagaagcaaacctgggcatggtgcctattgtgtgtactcccccagtcatgggtttgctttccaggtcagtttagcatgtgccaatcctaggatgataacagctaaacttggagaggggaaagaactgactgaagtcagggatggaatgtcaaaggagagaaaaaagaaatctatttgtcagaactcatttatacaccctattttgagatacagggagcatccattctgctttgggtaaaaatccagctttttagggagcagtatgattacctttaaagtgtgatgtgcccatatacatgtttatgaggatgccttgtgtatgattataggagatcctattttaaaattaagaaacattttaacaatttggtatttttcagatgcctttgacaatgaactcattctcaaaacactcaaagaaatcactgaagggaaaacagtccagatccccgtgtatgactttgtctcccattcccggtaagtgagctgttctgggccagggatggcacccactgctccgcagagcatccctggtctgcactgagacctccttccttacctctcgcacttcagacctctgtcctacccctgcctaatgccattccagctggtcagtggagtgggtggtggcagcagtgtgtgctgtgggattgtagaggttggggagttcatctgagcgctccctggaacagtcctgttgtcacgattccttaactctgaaggatgggatagtgatttcagcttgagggactgcatgtgcattctgatccacattccagtgctgctgttcctggaacaagatgtaaggggaggggtagaggaagggcaggaagaagagcaaagaaaactgttttttctgctgtcctggtttacttgggattggacaatgtggagaggcatgaggtcaccagatcgtgatctcagaattaaccaagccctccagaaagcttctcagtggaatcaaaccagtcctttccagtgaagcctcaattttagtgctcctgattaggaatagaggagtggccacacttccacctcatcctccttccctttgagtgatgggaatgggctcctagaagattgcactcctgctggccagaccccaggctccttcagagcgtctcagacctgaatgtagaacacacacatcttcccatgagtctgaactagagagcatggtgacgatttggttgcaggaggaagatgagagagagagagagagagaatgagcatgcatgtgtgtgcgttgaggtgtagagggggctgttttggtgcttacctccatgcctcaccagaatcttctgaaacacttccttctatgggccaggttcttctgtgtaggagagaggagagtgaaagatcaggataccatcctcacgcctcccgtgtcactctgttttcctaacccaaccactgcagatcatggaggaatgaatgaaggcatttcgtataggatttggagcttacacgaacatcaaggctgggagagtgaaggcctggaagtttatagtcagagaatcagacaaaatagtccccactgactctagcctgaggcactggagcagaagctggggttcatggaaaagtccaagaaaccaccatgtctgggtttgcagcctcaatctgggagcttatggactgtttgcaaagtttccctgtctcagtattatgatctcctgaatattgtggattttgcttcactctcaccttcgaagtctcttgttggcgtagtaacctggaagcatgtggggcaagggattctgagaattgtagttctcccttagggggaagtggtggtggtgtcacgttgacaagagacattccagcccaccacttcccaagtaaagaattaaaatgcagcatgatggctaaggcaagggcctgcagaagaatgtaaaggagggaggaagagcaggggattcagagcaggttgtatggaggaggtgatatttaagctttagataggaaaggataagaagttgtttgggaaagggatttccaaggtgctgggtagggaagcatttcagagctaggcatggatcagcttggttggggcatggcagtggagaggtgtggaggaatgggagtgggtgtgtgggaaggcaggcagacctcaggtcatgaagggccataggcggcagggccaggagcacagacattttggcaatagggagctacagacgggtctattgttgtagtggaaaggtcattgtggtggcaggaggagagaggatctgcaatgccatttgtgaagaagcctttggaacagccccagtgagagtctgataagggcctgaaagaaagcagtggaactgagcatggttgacaggagccagggcctgaccagtgcagtctaggagtggaggagggaagttgaagacctcgtgcatcatgagttccatcaagttgatatgccaacaaaagaaaatcctggtagaattcccagtgcagacatgtttcacgtttcctcctgatttatctcataccttatattttaaaaccttatcctttagtggctcaaagctcatgtcttagaaactttcactgatcaccctagacccatatccacccctttcctacctccttgcaaatcttaagggccacttaattggacatcgagccattcagggttaactgattccatcccacccatgggcgtttggtacaaacaaaaatttgttgggctaaaatgaagaagacatttacttgttgcaattacatttctctgagcatccttttccccataagccaaatgagatggttagactgggttatctcagatgatctaattggctagtttctttctggggcttcccagccagactctaaattcctaagtggtatattatgccaggtatgactccttgcacattctgggctagtagttgctcaataaatttgttgttgttttttaaaaactctgagctgttatgacagtttttagacctgcgtttggacttgggaaatgattaattctaacttcttaaggcaccaccaacaaattaggcagttaattttctccttccgaaggaaaaccacttttcctttttagtatttatcagttaggcatcctaaaatgctcttaatatctagtgtcagtacagattgaacatccctaatctaaaaacccaaaatgtgaaatgctccaaaatctgaaactttttgagtgccagtgtgacgttcaaaggaaatgctcattggagcatttcagattttggattttcatgttagggaggctcattgtagatcctctctccccctgccatattagggatgccctaaatataatgcagatattccaaaatctgaaaaaaatccaaaattcaaaaattctaaacacctaagcatttcatataagggatacttaacctggatatgtaaacttagtgcagccattgtgttctctgttagtgtgttcaagtggactcttgcacatacattcactttatttttggacaaagccttcccacactctccttggtgtaggggagttgcctagagagtggctcactatttcacttacccattggttctgttttctgaacttctctaggttgccttcttatgcacaatgacaatgggcacaccattttctggcagctgacattcctctagactggtgcttctctaccctggctgcatgttagaaatatcttgggagcttctaaatagtgttgaagttctagctccacttcagactcattaaatcagagctccttgggggtaggatccaggtagggatatttttataagcttcccagatggttctgatatgcatctcagatacaccacaattctagggcatttcctaatcctagtccttttttcccgtcttccctgccccgttctgccacttgctagctaccctagcagtgcctgccttaaaactcagacacaagcctgttggtccaagctgagaaggcatcaggaagtgtttatgggaaggagttccaacggcaccctcttgagctggccgttgatactgacctccttatgtttgcacagatggaactactgttttaagagactttgttttatttggtttgccagtgtgctagtcagggtgagtggaaaccttgcaatgatgattatttctctattttcagtgaattttgagcaagaggcagttggtgacatataaggtgggcataggacagaatcaaaagacaaaacacagtgaaagctgcagcaaggcaaagctgagcacaagcaaggccatctgtgacagcccgtcgcctaaccgtttagcaatgtttcacccttcttgctttttgaaaagtcatgttggttgagcttggtagctcatgcctgtaatcctagcactttgggaggctgaggtgggtgggttgcatgagtccaggagttatagaccagcctgggcaatatggtaaaaccccgtttctaccaaaaatacaaaaattagcctggggtggtggtgtgcatctgtagtcctagacacttagggggctgaggcgggaggatcgcctgagcctgggaagttgaggctgcagtgagtccaagattgcgccgctgcactccagcctcctgggtgacaaagtgagaccctgtctccaaaaacaagaaaaagaaagaaaagtcatgtttacaattagtgcctgccctaggctacccaaccatgtgggttgggtggatgaggtcatgcatatttctgctttattgataaggaagagcagctctagggagctcaggattgacctgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagaggtgcgttctaaaagcctcaggtggccctgttggtggccaccttgagggcgggggagctgggagcctgtgacaggaccccacccgcctgagtctgaagcccatgccttccctgaggcagctgtgtgtcgcatggtccagcccggctgcgtcagtccagccccaggatatcctgctgcccagacacttggtaacatttgagaagggattagtcacttactgtttgggataacgaaaggcttgtgaggtcacagagactaaataagacactgacatctggttttgcctggaaaagtttgattaaatgcttagttccttgcaatttgtttataagacatcaaaatgaagatgctctgatttggggaactaactgtaggacccccgaggataggatcccctgtgcctgaagtactgggcagctcatcctgttagcctgcttctctagccctttattttccagcaggctttatggaggcattatcactctttccagtcagctcaggagggaagtcagctgtgccctccgcaggccctactaagtgtgggcctgcctgtgctaagtccctgtgcttgtgtgctgaaggcacagcagtgccccttggtagaggagcccagcctgtgaactgagctctacagggtattcagcagagagttcgcttccaccaggagagattgggaggcttcatggaggaagaagggttgggacttggatgtggtggggtagggtgacgctataggcaacccatgaaggtgcacggcagagatgtacagacagtggcttgttccgagagtggcaggaacctggagtgtacagagggttgtacgaagagacactacaaagtaggttggggtctggttttagagactgagatctctagtctggttctcggtgggcaagggagagccactgtgaggttctgagcgaggcaagtgaagtggccactgttctgtgttggacactggttctgacaaaggaaatgtaagtgaagcctgtagctggagcagctctttggagactgctctgctgatctagacgagaggcagggctgtggtccttagatgggtgggagagggagcagagttgagatgagaagagtattagcagagttagaatcgaccaggacccagcaagggcagtgggtggaggcgactgaatagaggaatgaaaggtgagaaggtttgagtctccgttgtgtgacagaggcagggagacacaggaaatgacgaggttagctcctagtcacaggacacattattgacagtttcagatattataagctgtatcccagggccctctgacttcaaagtctgggtaattttctcttttcggttcatgaaacagatctgtagtttatcccatttagcaccgtaattgtaagaactattcatgagaccagtagaacctacagaaacaagtcctgagctttgcccttctaagtagtaatagatacatatgctattaagtcagtgggagctacatcttgctcccaggtggggtgagggacagttagttttgtgtgatggaaaaaagaatggaatgggaggagacttttagttctagcagagcccttcccagctagctttgtgactaggctcttgcgacaccccggcttgggtttctttatggataatacaggggagacaggcctgcttttagtgtcacgactctggctgggtaagagttgcatggtcattttggatagataattgaaccctgagcctgacaacccctcatgcttctgccccagggcctggcttgtcaccttaatccacaaactccggccctgctttggttgatctgctcagtgtccatgtcagcttgtcaaattagagaggcagtgtgatacacagggacagataaattttagagtccagcgaattgggctgagatcctggttttaccacttactagatgtgtggcaaattgtgcaaattggcaaattgtgttttaacttttttgtatctcattttcctattagaatgtggtcttatgattggtacttctgggatagttgtgaagatgagaggtagtgcaggtaaaatgcctggtggtgcattagtcaataaatatctatgtggcagatcagaaatctgcttctgctgaaggggtcggtgctgttcgttttctgaattttctgacaagactggttaggtcctccaaggggatctgctccggtcatgtcctcaggagctagtgatgcccggactgatgccatcactagtccagcagtggtactcagtctcagggatgcagtgctgccgagggaggcctcgcagcagggagtgcaggaaccagcacaggagattagaaccaagttttgagcagcagcaagacgctggaaataaagtgcatcctagtgtctaattcaaacagatcatcacggtgtggtttcaacagaacattttcccttcctttcttgcatgggattcttatgtgaaataggagcaattcctacaatggtgctggccctctgggggtttcttagggccagctctgcctctccgccttctctgaacaggctgcctgggcagggctctgctttctcatttcagatctgctaacttcacatgtcacctactgccgagtcactttcctgatggattcatgggacttttctgcatgctatttctacaaattcattctctctccacgtaggacaaaaaacatgcttggcatgtgctttgtggagtgcgggggtgctggggtagggaggctggttagtcagaagcagctgttgagtgagcttgaacattcctggagacttgagttagctccatgattttacccatctgtcacaccctcctgggcatgtgacctccagattctgagttgaccctcatgtgggagagagatctgtgtttgagtgaagcagccctggaaactacctccttcctgatggaaacccttgatcttctcgggattggtttctagcctcatttgccttcatattccctctgtgctctttaccaccacccagctctgaatacggggacagggaggaggtggggcagggagattcaggatggctgacccctcatcttcctcatccatcattctctggttctcatagaattagggctgcactgggccttgggggattcagcccattcttttactatagagtagcacatttcctcatcagatttttaaagtgattgacttcaccattgaggaattatctttattttgggtccctctaagtttctttcttggcttttggctaaccagaaagagcaagtctgggtttggaagggctgacgtggaagcccagcagggaatgtgggcagacttgtagcttcctgccctgtaccctgtcctctgaaaaggcctgtcctggcccagcaaatgtgctggggtcagagcagtgatggaggggctggttttgagcccctggggtttccaggttgtgccaagaccttgtttggactcagtccttggcgcggccctgtttcctgactctgcctgaggagaagggcctttcagtgcagggaactggctggccctctgttgtccttggctcagggaggcacagtctgcctgaggtgatagttctatcggaggttcttggggagcagaggtgggcaaggccttatgatgttgcatgttcccagtgtctgggcaacattctgacccattccccatttgcttttccagcgtggaagctgtagtgggactattccctatcttccttgctttttttccttcctcacgtatgttgtcctatgtgcttgtgtcctgctctcccttcccgcgtggcaacctgcctttccagctgccctgcgggactcctttttccctttgctgcccccgctcagctgggtctgacctgcttacctgaattcgaggttcccgcgctcccacggtgttgagctgctctgtcagggaggcactgccctcccaacgcgtcctcaggttctgttgtggtcgtaatcatcatagaacacatgcttattgaacatgtgctaaggtgccagctatggtgctgaagagttttatgcacatctctgtattcctgaatagtaactgtatgaggaaggtaccattattgtccctgttttatagttaaggaacttaagattcaaagaggttaaagtcacttgtcgaagttcacagaggtaggagttattggggtcaggattcaggtccagggcagttttccccccagagcccatagaggtagaacaagaagcagcttttgggctacagagcagcttcactgtgatttacctcctcctcctactttctgcacgaccagtttcctctctccagtgacaaaacagctgaagccaccagatctacagaaggaagggggctgaaggcccaggctgagggcagttaggaggactacgtgacagggtgtggacgtgcactgtgtgtgcgtgcgtgcgtttgtgtgcatgtgtgtttgtgtgtgtgcacgtgtgtgtgtgtgtgtgctgggagaaggacaaagcttcctccagtgctaaagccttcagcaattgtatgaaaagcatgtgttgcaaaacaatccagcatcaggcgtttgcagggctttaagtaaaagctgcccaagcacgggtgtgtttgttttttccctagctctgatacccttttgatctggtttccttttttctttgggctttatctggagacgtgtgaagaattggaggccgcgctggctgtgtgttttggcggtgctactctggttagccatgtgtgccggagctctggggacttctggggggtgagccacgtggcagctccttagggctccttcttagcgagtctcccagcagatctgccagagcagcaggtcggcagcaggagcccaggtccagcgttgcaggggtggggaaaaccatttcctggctggagaaggctgctgctgggctgggtgggcaagtcctgacacattagcgatcagccaactgttttattaccaggtctcccatggagaaaacacttcgtaaatcgaggagctgttacaaaagtcgaatggcagcatcattagtgcccagctttctggaaatgtggatttcctgacagttttctcaccttctcatcttatagatttcctgtcagcctggatcatagccatgacagcctccccgttccctgtcctctctgtgcatgcacctgtgcatgtgtgtataaagacagaattatttagacaaatggctttcagaagttccgtcacagatataccccatgttcgtttacagtgagtttcacccaacatttgagtctatttactgagaaatggttgggaaggagctgaagagccactgcaaatgattgtagatggatgtggtaactttttggggtgaaagatttagcagctcagatgataaggttagattaagatagcatttaaaatgacatctgcaaagagaggcagttttaattaagagaatctacttccaaactccctactcatggggaaactaaggctcatgtacagcggcagaatgagggtgatcagtcttctttctatttattgacagaagactctatttaataaagagtgtatgggctgcctataattccagcactttgggaggccgaggcagaaggatcacttgagcccaagaattcaagactagcctgggcaacaaagcaagaccccgtgtctaccaaaaaaaaaaaaaaaaaaaggctcacacctgtaattcccagcactttgggaggctgaggcgggtggatcaggaagtcaggagatggagaccatcctggctaacacggtgaaacccccatctctactaaaaatacaaaaaattagccaggcgtggtggcaggtgcctgtagtctcagctactcgggaggctgaggcaggagaatcgcttgaaccccagaggcagaggttgtagtgagctgagatcgcgccactgcactccagcctgggtgacagagtgatgagactctgtctcaaaaacaaacaaacaaaaaattagtccattgaggtggtgtgtgcctgtagtcccagctacttgggaagttgaggtgggaggatcacttgctcaagcccaggaggttgaggctgtagtgagctatgactgtgctactgcactacaacctgtgtgacagagcaagacaccttgtattaaaagaaaaaaaaattttttaaagaaaaaaaaaaaagaatggtaaaagcccctggataaaactgaccgggggaagaaggtagaagacagaagatggtgagtttgttgtcaatttgggcttcatctcagccccagcccaccattctctaggccatggttttcttatctttcactgagtgattttttttttttttttttttttttttttttggcaaacctctgtgcatgaggtaggtggaaatggttaaccatggctgggtcctcagcctggcctgggctccatgctgcagagggggcatgggtgggagctgggagcagtgagctgatgcctgatcagtgggtcgctggacttctgaacgcaggtaagtgcatgcaaggaggcagcgtgcagcccagccctctcggggcccagattgcttcttgttaacagtgagctctccaggagtgccctgcttttttaaaaaattcacactgaaattttgtttggagcaaatgttgcttgaaacaagaaggctgttggcctccatggacagccttttgtttcaaagagcattgtgtcattgccaagtttgaccattgtaagatgtcagaatgtaacttgtcttttccgaagccgctgctgatctgctcttggtcaagcctctcaggattccagcttgagaatcatctagagtaattgtggagcctgtgggagctaggtccaccccatgaagggcgggtgtgtgctggctcctacaccgttttttgattcttgttttcccttctcttacagtattaagggacatcagcgagagaggcagggatcttgagcagattttatctcagtacattacgttcgtcaagcctgcctttgaggaattctgcttgccagtgagttgtgttcttggtttgtttttgttgaatgtagaatttaaaatttgatgatataaacgaaggtgtgcaagtttgtggagctcccctgcctgaatctcactcctctctctgagtgatcctctgtcctgaagtcctaagagagggcagcccttggtccttgtgtcctctgtgttctccaggagccctgtcctgctgttctttctttgggtagccctgtagggtcctgccagtccttaggcaggtcatttaattcccagctagttctaggtttcttgcttggtggggtcatggtgtgagaccgtttactgagggtgtatcatatccaaggagagtcctcagccatttggatctctgaagggtctgcaatgggtgacgtatggatgcactgggtgctgtgccccgagatgttcccctctgagcctctcctgccatcaccactgagccctgctttgagcttgtctttagctcccatttggagactgtcatgccttactggaataagcttccttcccttcacccttgcagactcaccagtccttcctgtggcagctaggaattctctagtgaggtggctttcagagaaggaagaacacagagagttggccctcagcccaggaaagacaggaaggggcatgttgagggaaggctaccagagacaagaggtgtggtgtgctggggctgcagaaggagaagtatttaactcaggagaatcctactgagtcaatgagtcttctccagcttggccaaaccatggtctggctcctgaattatttatagttaagctctgagaccgggaggaagggaaggaagagcttgggacttaacctggtcttggttgagatacactgggaaggctggaatctctgaagacattgaagatttagagtaaggctgggtattggaatttccctatttattctaacaataaacttcattctttttcttctgggaaaatatctcaaactgtctttgtttctttaaggatgttactagcttttacagcaacccatacttgactttggtttaaatgcgggacaggtggactttttgagccaactgagtaacattgatgccctatccattgccctggagactattgagttacaagagtaggttactggaaagagaccagagggggctgaggagctgtgaacttctttccacccagttatctatctgaggacctctcctgttatttttgacttaataagaacacaaaatgaatttattattggatatcagtcatatttaactgtcagttttctacgtttaacttagttgtaacaaagctaaaaattctgcagacgttttctgggttatttctgcttgcttccactgtccagccactctttgctcagggaagatcagctcattcccctgtaagccaggaacttggacctgataaatgtctgctcagttcaagttgggtttggggctgacaccgttgcctttcagcaatcctagggcagaggctgcacagagtaagatgcccacatgcttgaggtgtggtttatgtgttcttatgctagacttagtttgtatgccaggatgcagttacttgtagaatggtctacaaaatctcagtaaatttggaccaacaaaaaagaaaaagaaaaaagaaatatgcctctttgtggcctgactttctttctttaaaaattgggtaataatagaacctatgaactggtcatcagtgaagaatactttttctggttttaccctgtgctaggagtgaacagtgtcatgtttcagactatgtgtaaaagtccaaggtgaaccagtcccctggaaagtttgggtttttctagttcatatttgtcctagtggaatagaggcaattaagtgtttggcttcaaagaccatgttctctgcataggtcataagctgaaacagtgttcagcgttagaaatgagaacttggttgggtgcagtggctcacgcctgtaatcctgggactttgggaggcccaggtgggtggatcgcttgagcccaggagtttgagaccagcctgggcaacatggcgataccccctctctataaaaaataacaaaaattagctgggtgtggtggcgggtgcctgtagtcccagctactcaggaggctgaggtgggatgatctccccaactcaggaagtcaaggctgcagtgagctgtgatgatgccgctgcactccagcctgggtgacagagtgagacgctgtcttaaaaaaaaaagagagagtgagagagaatttgaataaaagctaaattcttgtaatgtagataaagtggataaaaatccatggtagatagttatcaatcgaattatgaactggttttggattaaccactcagtctggaccattttccctcactgatacatgaaagtcttcaatccttctttctcattttcctcattccctgcttatcttctttcattcacatttcagctaaacaaggcacttccttaggtttccccaaatttctattaatagatgcattcactgtgaagttgtaaacaatattatatttgaagccttaaaaggtgctcttctgggctcgctagtatgaatgctgccctttccccatattcccttggagagggtctcgggccagttgtctcttaactgtattaatgcatattaactgtctttctccacagacaaagaagtatgctgatgtgatcatccctagaggtgcagataatctgggtgagtccctgcagagtgtcatcctggagtataatgtctgccctttgtcagtcataatttggggcaggatgtggtgaccctacagggctctgcagacatggctgccctgcttgtctgtgattgtgagccagcagaacctttccacctacacgtctggcctcaggaacaggtccctgggtgtaggcacccatgtgttacggggacagacatgcacttgtgcttctctggcagaatagagggctgtagattaccttttactatcacttcccaatgatgacacttgggtactttgcttctgaggccaccttttagcaaaagcagattccctccttgatctaatttagaatgacctgccatcacggtagccctttctaaagggagctggttgctaccattattgtacttatttttcattttattttattttactttagagacgaggtcttgctctgtcaccaagatggaagtgcagtagcacagtcacagctcatttgcagcctccaattcctgggcccagcctcccggtagctgggactacaggcttgcaccaccacggtccactaattttaaaaaagtgtttttgtagagatggtttcattatgttgcctaagctggtctaaaactcctacctcaagcgacccttccatctcagcctcccaaagtgttaggattacaggcgtgagccatagcacctggccccattgttttatttatttttttggcctgtctaggaagtgtgaatgtctctggactaggcgtagtgtggcagagttgatctgtaaaataggacctggtttcttcattctctttagaatttatttaattttccctccatttaaaaagattatttcttgagctgtttgggagtaagttatagcaataaatatttaaccctgtattttttaagaacaaaggcattcttattcatcagcagaatgcagtcattaaattcaagacatttaccattgatatgacctcttttaacctggagatgttccctatcttttgttttttaagacatttttgaggcgtacaggcccattgtttggtagaatggtcctcaatttgggtttgtcttttattttcttatgattggtttcatgagcttatacagtctgaaggaattatcccaggagagatgtggcgtggtcctctttgtgtatcacatcagaaagcatttgatgtgtattccatttttggtgatgttaaattgacctcttggttgaggtatataatttatttctaatgctaataaaagatagctctctgcattatattttttggagggaaagagggccttccatagggatgctctgtcttaggatggaaaactggaaggttccctggtggaaaggtctcatagctaattgatgtgtcagaaccatggctggttaccacgtctgcagactttggcccgagtgcttcatccagtggtgactgatcatctcctgataagaagcccattcattaagggcttactctgtggtaggcattgtctgtcttactccttagagccctcctgtgaaggaggaggatcatattagctcaggcagagccactgggaagttggatgacttgcctgcaagtggcagagccacttccctggaagtctttctactgtggttcctgcatgcccttcccccagacagactcccacactcacccctgcacccatgcctgcacccgtaacgctctgctggtctctgccccacagtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgtttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaacaccttgattgcctcctctgtcacatgccactcttggagctggagcttagtgatatgtcaatgagagatactcttgtcttttttttttttcttttctttttttttttgagttgaaattaggtaaaatctcaactcaaaaatcaaactcagggaagaggcccactgaggagaacaagtcttctgcattttcttcctgccctgctcccaccttctcgcctctggctgcttggatagcttggtgactccttcctcaccctcctgcttctctgtctctccaagaagccagagctgcctctttccttccctggaagagattttatgggatcgcttcctgatagaagatgggaaggagagggcagaactttgcctgctgtcatatctgaagaatcactggttctttctgcatcccaggggcgtaactgatctgactccttgggctttttcctgtattgtggaatatagagtggaccattgcaggctgggtgtgggtgagggcttcggtaactgatgccggcagcagcgcctcatggagtggcaggggagctctgtctgtggaggggtagtagtttccgcttcctggaggtttgcagtgaggtgaggagagtaactttggtcagggattctcactagcagcgtcatggccaggatgctttacttatttgcaataccacctagtggatatggcaactgcagagcataaaaggggctcggaaaagcagtttttacaaagtatttaaaaggagagtatttaaatcataggtacctaagttggagcctgaggttgaaatatttggggtggagatttctagctttcctgagagctgctgcttggtggtagtgttttctctggaagtacagattcctgacattctgggtggaggggagcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagcatcctgaggacacagggcccctggccttgatggcactgggccgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcac

SEQ ID NO: 13533 - DNA, 19980 bp, Human
ttatcatctcccttgcatgggggcaggccttgctctggctgccctagtcaggtaccacggctggttctggggtgtaactgcctggctttgagtccacagcatagactttcctgtctccttgggagcactgattcttccatggcagcccaatgccatggggcctcggtctcaggccagtaaccagctcctgagcttctcgggagacagagctggctgtctcacacctcacctcacctcacgacgaggtggggtgagcggggcatccgaccatcatccacccatccatcctgatttattcagtgcttctgtggtcagcacaacatcccgaaaatgtgcccgttccgtcggccgctgtggctcacacctggaaccccagcacttagggaggccgaggtgggcggatcacttgaggtcaggagttcgaaaccagctggccaacaaggtcaaatcccatctcttctaaaaattcaaaaaaattagccgggcatggtggtgggcgcctgtagtcccagctacttgggaggctgaggcaggagaattacttgaacccgggaggtggaggttgcagtgagccgagatcacgccattgcactcgagcctgggcaacagagcaagactctgtctccatcagtcagtcaatcaatcaataaatgaatgtgcctgtcctactccctggaacctgcagctaaagggactttgaaaatgggacgagatcttcagatgggaaagcatcccagatcgggtggacccaatgtcaacaaaagagtccttagaaccaggacagtttctccagctggaggcaggggagcacagcagctagactcagtccttgaacacctgtgcaggcccgcccagccctagccttgggagcgacgctgtcagggggaactgatggggggcagcccacccgtttccatttcaggatccctctggctggctggggaaggggttaaggggagacaacagggggtgggcgattccgcaggaaggtcctggaactctcccggccagagatggtggctggactaaggtgcagggggtggtcggggagctgggggggggtgctcagattcctggattttgagggttcaaaaagcagctggacggggcgcagtggctcacgcctgtaatcccagcgctttgggaggccgaagtgggctgatcacctgaagtaaggagttcgagtccagcctggccaacatggtgaaatcccgtctctactaaaactacaaaaattagccgtccgtggaaccagctacttgggaggctgaggcataacaacttgaacccgggaggcggaggctacagtgagccaagatcgcgcctctgcactccagcctgggtgacagagaccccgtctcaaaaaaaaaaaagctactggagggaacttgggggcgtggaaggggtggtcacgggggaagtcccccagatttggacgctcgtaaaaagctcggaagctgggagaccaggagggcggggaagtcgaggtccagtcactgggccagagtccccaagacttgggctggagaaaggtcggaggaaaggaccccactagtccgaaagcatgtccccgcgcacgcgcaccaggcggccggcagagacagggcacagtaaaaggagccgcgcggactccgggcacagctgctgggcactggcagctcgcaaggcacagcgcgcaggcgcgcacgccacttaaggccccgccccctcccagcgcgctgattggcggggccgtagaggggcgggggcatggcgccgcggctgcgcagcgcggggccccgcgcgggcgggtgggcggagcgggccccccgagcgggggctggcgagcgcggggagggggccgaaagggcggcaaagccggcgcgcgcccggctgggggcggagggcgggggcccgcgggccggaacagccgcggcaagtggcggcggcggcagcggcagcggaggcagctgaggcggcggcggcgagtgggggtccgggcggcggcggcgggcccggcggcgggccgaggagccgggcgcaatggagcggaagaggtgggagtgcccggcgctcccgcagggctgggagagggaagaagtgcccagaaggtcggggctgtcggccggccacagggatgtcttttactataggtgaatgagcgcgccggccgcgcagggcctcaacgggctcctcccagcggcctctgcggcggcctcggcgcccctgccccgggccgcggcctgggccccgcgcgtgcgtcgtgcgtgcgtgcgtgcgtcttgcgtgcgtgtgcgcccggcgcgcggaggcccagtgcgcgtgcgccgcttgttgggccgcatggctttcggccggccgttcagggactggctgccggacggcgactgcggcctttgttcgtgcgcgctgggccaggggcgcctggcggcggccagatgctaccggggggcaggggtggagggtgggctgtccctttggttcccgtgagacgcagggggtgccttcttggggcgctcctggggtggcgcggagcccgagggggtggccagccgggatttcggggagcagggctcatgggcggatcggggagggcgtgcgtgaaaatacgggttcttgggctcgccccagtcctgggaataagcgcctcagggtgactggtctcccacgcagcgttgctttttttaaaggtattccccttgactccttccgaggcctctggtcctcttgggtcgtggccccctcagggtggagacctgaggctttcgactttccgagcccacctaacggtagtctttgcgtggatgttactggtggtggaaggctttcagagacccccccgtccccaaattggaacaaggcgctgctctgaaaggtcgcagggaaccccctccgtggaacaaagacttagtcgcctgctgcagccaagtcccagacagtcggccacctgctgtttgtcctcttttttttttttttcctggctcgggaaagatgcttttgattctgggccagctttgattgcgccctccccttggttcagtgtcccgtggcgccttcaggtcccccaggaggggaaagcggaggacgcctgccatgtgccgagcacctgggtaaaggggggtgtgcggctggtccccctttttcccacagctcggggtcgtgggcaggagaccgcccaggtgagggcgggtggtttccacgagccaaggaggggcagaacgaccgctccgtccactgtgcacttcggtcctctgtggttcttgactgtcccggtttggggagataaagtgagaaaagtgagcggggaaaggatggctgtgatcagaagcaatgtgtggggcctcgtcctgcaggaggagctcagggactggttcctggaaagttggaggacagcaagagaggggaaacttggtccccaaatgtgtacccttatgagctggaaccctgtacacgtcctgagatctgcagtgacacatgctgaaatctgggagggcagatgacggggcctgaatgagactggggtcagggagggcttctctgaggacgtgacattgagtgacagggagaggcgtccaggcagcaggaaccccctaagaggtggctgcagcttgggagctagaaccaaggccagcttgagcggagtatcctgaggctgtcatcaccccacctctctcattcccactctgggccctggccctgagcatgagggtctagcagtggagaaaagcagggagaagctcctctacaggctagagatttcaggtttctctgcagagggtgaagccaggcagcccagagccgccctctgcaggtctggggcctcaacccagcccttcatctgaggctgcaggctcccagactgcgttttctgttgggggtgcctggggagagttcaggccatgttgcccacttttttctatacgtgtggttttatcaaggctgttcttttttcattgaataaaatctcagggacatcattttgtgtcaatagatgggcataacctttatttaaaattgagatataattcacattccacaaaagctaccttttttgttttttttctttgagacagggtctcacccaggctggagtgcagtggtacaatcacggcttacgcattcttgacctcccaggctcaggcgaccctctcagctcagcctcccaagtagtgggaattacaggcacgtgccaccatacctggcttatttttatagagatggggttttgctgtgttgcctagactagactggtctcgaattcctggactcaagcagttaacccgcctcagcctcccaaagtgctgggattacaggcatgagccactgcctggccaaagccactttttagaaatgtacaattcagtggggtttttttttggagatggagtttcactcttggcccaggccacagtgcagtgacgcaatcccagcccactgcaacctccacctcccgggttcaagcgattcttctgcctcagcctcccgagtagctgggattacaggcgtctgccaccatgcccggctaatttttgtatttttagtagagaaggggtttcgccatgttggccagactggtctcgaactcctgaccccagcacctcagcctcccaaagtgctgggattacaggcctgagccaccacacccggcccccagtggtttttagtacattgacaaagttgtgcaaccatcaccgctatctaattccagaacattctcatcaccctgaaaagcagctctgtcctcattagcagtcactccccacttgttactcccccagcccctggtaaccactaaccccctctatcttgcatttgcattcattcattcatttattcattgtgagacagggtcttgttctgtcacccaggctggagtgcagtggtgcagtcacagctcactgcattccttgacctcctgggctcaagcgatcctgcctcctaagcctccagcatagctgggactacaggcatgtgccaccatgcccagctaattttttatgttcattattatttatttattttgagaagtagtcccgctttgtcacccagggtggaatgcagtggtgcaatctcggctgactgcagcctccacctcctgagttcaagcgattctcctgcctcagactcctgagtagctgggattacaggcccccaccacaacccccagctaatttttatatttttaatagagacggggtttcaccatgttggccaggctggtcttgaactcctgacctcaggtgatctgccctccttggcctcccaaagtgctgggattacagatgaaagccactgcgcctgccttcttttttttttttttttttttttttgagaccgagtttcgttcttgttgcccaggctagagtgcaatgttgcagtgcaatgctgcaatctgggctcactgcgacctccacctcctgagttcaagcaattctcctgcctcggcctcccagctagctgggattacaggcatgtgccaccacgcccggctacttttgtatttttagtcgagatggggtttcaccatgttggtcaggctggtctcgaactcctgatctcaggtgattggccctcctttgcttcccaaagtgctgggattacaggtgtgagccactgcatttattctttttgagaaggtgttatcgagatacagttttatgtaccatacaatacagtcatttaaagtgcacgagtcaatggtttttcagcatattcacatatttacggatataggcagctatcctcagattcaattttagaatttccatcaccctagaaagaaccccaggcccatttaccactgccttgtgcgcccacccccagtcttaacaaccaggctgtggtctgtgtgtgtctcttgttcgccttacaccttttttttttttttttttttttggagacacagtcttgctctgtcgcccaggctggagtgcagtgtcatgatctcggctcactgcaacctctgcctcctgggttcaacccaattctgcgtcagcctcccgagtagctgggactataggcacgtgccactgtgcccggccaattttttgtattttagtagaaacgggtttcaccatgttgcccaggctggtctcgaactcctgagctcaggcaatccacccacctcagcctcccaaagtgctgtgattacaggcgtgagccaccgcgcccggccttgtttcccttcatcttaaaaggcagaacggcctctctttggggtgaccggaggcaaagagctgttgggagtgttttgtggggtctcttcttccttccttgtggctacatgaagcctgagtctcagcctctggtttcttggtttctttccactgccctgggcaaaccagcttcgactgaacgtcagccagtccagagagtaattaaaagagttaagtctcaaaagtaaatctccgggaagagccctcagtggtttcagacccccaggcacttgtcctcgtgccctccctgaggcgtcctgtcctactggacatgctggagcctgcccgtgtccttgtggaccatggaatttgcccggggttggggggcaggggtggagagaaataaaacttcctgtgatctatgtatcggcccagtacatagatcctggatagaggcgattgagctaagcatgggaccaagcatttctgtgcagtgcctgcagaattgagtttccttctggctatgggagattcttctgagctgtctcagttgtctgacatctggcatctgccatgggccaggacgtctggggcaggggcagaagaggacaggaggagactgccctagaggattctgggaaaacgggaaaacagcaaaacagagctacccaccaatctcaggctgatgcattattaataaaagtgactgttgactgagtttgtagacataatatgtttgaggtacctggcctagtaagcaccatacaagtgctattatttctaaatgattttatcaagataaaagacaccagccaggcatagtggctgccgcctataatccctttgggaggtcgaggcaggaggatctcttgagatcgtaagttggagaccaacctgggcaacatagcgagtccccatctatgcaaaaaatttaaaaattagctgggcatggtggtgcacacgtgtagtcctagctcctcaggaggccaaggcaggacaatcccttgagtccaggaggtcaaggctgcagtgtgctgtgatcacaccactgcactccagcctgggcgacacaaggagaccctggatctaaaagtaaaaatgaaaaaaaaaagaaatgaagcagcagggcgtgatgactcacctttaatcccaaagctttgggagggaagatgggaggactgcttgagctcaggagttccagaccagcctgggtaacatggtgagaccctatctctattaaaaaaatataaaaattggctgggcgcggtggctcacgcctgtaatcccagcactttgggaggccaaggcagccagatcatgaggtcaggaggtcgcgaccatcctggctaacactgtgaaaccccacctctactaaaaatataaaaaattagccgggcgtggtggtgggcagctgtagtcccagctactcgggaggctgagtcaggagaatggtgtgaacccggaagtcggaggttgcagtgagccaagatcgcaccactgcactctagcctgggtgacagagcgagactccgtcttaaaaaaaaaaaaaattaggccgggcacggtgactcacacctgtaatcccagcactttgggaggctgaggcggacagatcacctgaggtcaggagttcgtgaccagcctggccaacacagtgaaacctggtctctactaaaaatacaaaaatcagccaggtgtggtggcgggcacctgtactcccagctactcaggaggctcaggcaggagaatcacttgaacctgggaggtggaggttgcagagagccaagatcgagccacttcactccagcctgggcgacagagtgagactccatctcaaaaaaaaaaaaaaaaattaggcgtggtggcttgtgcctgtcgtcctagctacttgggagactaaggtggaaggatcaccctagcccaggagttcaaggttgcagtgagctgtgattgagccattgcattccagcctgggcaagagtgagaccctatctccaaaaggaaagagagaaacgaagtcctgtccctatcagcagccactccacatcctgcaccccagcctctggcactacgcgtccccttcctgtctctgaattatcctgttctagacatttcttagaaatgggatcacacactgtgtggccttttgtgtctggcgtctctcactgaatgtggcgtcctcaaggtgcatccacgctgtggcctgtgtcagagcctcgctccttttcatggctgagtatgtcccatcgtgtggatgggcgtttgtccgttcatccattgaaggcgtctgggctgcttccaccttctggctcctggggacatccgtgtagaagtgatggtgtggatgcgtgctcatttttcgggcagatacctaagagtggcgtggccgggtcatctggaaactcagtgaagagctgtcaggcttttccaacatggctgttccatcttacatcccaaccatgatgacggtgtgttgggttgggtgcttgtcatcctgtagtgtgacctcatgtgacacacagggcaacccattggtgggtgtccttatgtcctggagaggatgagttgccggcgcttgtccatggcaggctgagagcagagccccgtgtctgagagcaggtctgtgtttacctggctgccttgttgcgagctctccagtcgggttatgcccaagcagctgttagggcctggccccagatcttagaacgagaccccttcccagtctggccctgctgctgtaaccccaaggtggaagaagattgcttttagggctgtccctcacatacctgttctccgtggggtcttttctcaagaatgtgacctaaattccatgtctggaatgttctggacatgtgagccatcctcccagagccggggcccaaagccctgtaggtagtagcgtttgtacccgaactcagcgtctgctgtgcctgacgctgccagggcctacggtggggaggattcagaggggaccggggttgggggtctggagcaaggatccgatgtggaggctggggctagggccagggtgtgaggatcggggccagtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaaggtgagtggtggcgtcacgcaggtgacgtcggcgcggggcgttctaggcggggacgcggccatgacgtgagctgcaggcgacacagcccggcgtcctgagcgcaggaggtcacagcgggcggagggcacagagcggaaggcgcaggccacagggtgcagagcgcaaggcgcatggcgaggacgcggcccgcggcgggcgttccagagccggccggaccgaccctgcgggagcggcctccccggaccgtgggggtcctggcgggcgcgggggacacgaggggcgccggcaaagcagggggtcacccgggccccgcaccccctgaggctccgcgccgccggggcgcccccaggccggactgcatatccttcctcccgcagggcaagcccgacctgaacacggcgctgcccgtgcgccagacggcgtccatcttcaagcagccggtgaccaagattaccaaccaccccagcaacaaggtcaagagcgacccgcagaaggcggtggaccagccgcgccaggtgagctcaacgcacagcgaccccagccttcccggccgggttgttcactttggtgggtggacgtttggaatgaggtcgtacgtggagcggacgtagtgagcgcaggagttccaggctagcctgggcaacatgacgaggcaaaaaacaagtaaaaaattagctggacgtggtggcgcccgcctgtggtcccagcttctggggaggctgaggtgggaggattgcttgagcccaggaggctgaggctgcagtgagctatgatcacaccactgcactccagcctgggggcagagcaagacccagtcctgcggtcccctcttggaatgtgcagggtattggtgccaggatacgccccaccctcaacccccagataccaaaatctggggatgttcaggcccctcagaaaatggtctagtatggcctcacgcggtgactcacgcctgtaatcccagcactttgggaggccgaggcaggtggatcacctgagaggtcaggagtttgagaccaggctgacccaacatggtgaaaccccgtctctactaaaaatacaaaaattagctgggcgtggtggtgtgcgcctgtaatcccagctacccgggaggctgaggcaggagaatcacttgaacccgggaggtggaggttgcagtgagccgagatgacaccactgcactcctgcctgggcgacagagcgagacccggtctcaaaaataaaataaaaatatttttaaaaaatggaaatggtctaatgtttgcacgttacctgcaggtattttctagcttgctcatgaggtgtggatgcttgtgacgttccttgtgtgtgttttattcatttttttaagtttttcactttcgagacagggtttctgtatgttgcccaggctggtctcaggctcctggcctcaagtgatcctcccaccttggcctccaaaactgtggggattacaggtgtgagccaactcacctggccagttgttgtatttatttattttttttccccccaaatattttcagtctgccgctggttgggtgtgtggttatggaacccacagatacagggggttgactgcccatatgtgactgtgtaacctacttcttaaaaacctgagaaccgtgtgtattttctttttgttttttcttttttttttttttttttttgtgacagagtctcgctctgtcacccaggctggagtgcagtggcaggatcttaactcactacaacctctgcctcctggtttcaactgggttcaagtgatccttccacctcagcctcacaagtagctgggatttcaggtacccgtcacaatgcacggctaatttttttttttttttttcttttttgagatggagttttgctcttgttgtccaggctgtagtgcaatggtgcggtctcagctcactgcaacctccacttcctgggttcaagtgattctcctgcctcagcctcccaagtagctgggattacaggcgcccgtcaccacaccggacttttttttgtatttttagtagataaggggtttcaccatgttgaccaggctggtctcaaactcctgacctcaggtgatccacccacttcggcctcctaaagtgctgggattacaggcgtgagccaccccatgtgtattttttattcttatttacaaacgtccactggatccctggctgtggaaagcctgggcagggtctggagacccaaggcagtgggaggggagatgccccattgggacccacatggggcaaggaggccaggtgggcctccctggagcccagcaaggacctggagtggggagagggcagggccactcttgaggttcacatatgtgtctggggcagctcttctgggagaagaagctgagcggcctgaacgccttcgacattgctgaggagctggtcaagaccatggacctccccaagggcctgcagggtgagcgggcaccctgaggggaggcggaaggggatgtgccgggtggggtggaggtgctgcaggtgccctcatctcctggcagggtggatggctgttcctgctttgggtgcttagggcaaatctgccagcgactggggcaggaggaggggacccagtggggttggggatgggtaagggcgcttgggctgggcccttcattcttgaccttggagaccctgcgggtggggctttgtggcttccaggtgtggcgcaggcctggggctgttttcacctgcaggacgtgcagttttgccatggagatcctaaataaacaaacaaggacagctgactttgcttctgtactctcccagcacgtccacaccacagaacaaagaatgcagctcttgcatggttttggtggttgttttttgagacagggtcggctgggtacagtggctcacacctataatcccagcacttggcggggctggggcaggagtttcacttgatctcagaagtttaagaccagcttggacaacatagtgagaccccatctctacagaaaatacagagcaaggccaggtgcagtggctcacgcctgtaatcccaacactctgggaggccaaggcgggcggatcatgaggtcaggagatcgagatcatcctggctaacatggtgaaaccctgtctctactaaaaatacaaaaaattagccgggtgtagtggcggccgcctgtagtctcagctacttgggaggctgaggcaggagaatagcgtgaacctggcaggcggagcttacagtgagccgagatcgcaccactgcactctcctgggcaacagagggagactccgtctcaaaaaaaaaaaaaaaagatacagagcaagaccccatctcaaaaacaaaaggcagcctctccgtggcccatgctgaagtacagtggcgccgttactactcacagcagcctctacctcccgggctcaagtggttctctcagcacagcctcctgagtagctgggaccacaggtatgcagcgtgacacctggctaatttttgaattattttgtagagacaggagtctcactgtgttgtccaggctggtctcaaactcctaagctcaatcagtcctcccacctcgccctcccaagatgctgggattacaggcgggagtcgccacgcctggcctaacttgcttttttttctgttatgaatgtagtaacacaagcgggagagggaatttagaaatggaacccaagttggggttccttccaagaaggtggcagctcccattcttggggcatttccgtggcctgtctgggccacagctgccccgtggtgacctctccacttgcggctgtttgtccactgcctggcaggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggtagccccttggcctggtcccctgctgctccaccctgtctcttgtggccgtggggaccctgagtgtccccgtgtgcctgcgtgcttcccgtctccccacgatgctgctggggttttgaaacagaaacagccagggcaaggggacccatcgtcggagcagtatgaaccgtttcacccgcgtcctgggttcagggcgagccaggcaccccttggaggaatgttcttgaaaagagtgtggtcctttgagtccgtgaggactggctatgctgggtgctgggctccatgttgggccctggagacggagggacagggcaggccaggagtctctgccttcagggagatggctctgggtgcctgctgaggggcagttctgatgtgcagagcctcggaacgaacagcagggaacacggccgctcagaaacaggcaacagtcaggtgaggctgagcagcccaggggtgagcggccctcctgcggggcctcagggccgaacccacttccagtgtgcagagtggacgcaaggccgcctggtgacggaggcgcctgcaggaaactctggaagtgctggagcgaagacgggacctttcacgttcagtgcagcacacggcttaggtcagaggaaggaaaggaaacttgacggttccagaaagaaggagccaagacccggaacggccagggaggcgctgggcatgcgggtttcctgtggcagcagccggggttaaaggcccctgggcacaagaagagaccctgtgcccccacacagggtgaacagatggacctgagacgccacccccacaagcacacaaactgtgggcgccaagggttccatccggagcggctggcggcatcctcctccggccgtggtacctctgggccccctcttttgggtttgaggtccatttacactctctgcgcgctcagagaacttcccgaaatgaagatggtgaaataggaagaattgtcaacaaaagaaaagaacaagactgtgaaaaatagcagacagatcattaaaagccctgcagaacttgcagaaataaggccgggcacagtggctgacgcctgtaatcccagcactttgggaggccgaggcgggaggatcacctgaggtcaggagttgaagaccagcctggccaacatggtgaaaccccgtctccactaaaaataaaataattagctgggtgttttggcacatgcctgtagtcccaggtactcgggaggctgaggcaggagaatcactggagcctgggaggcggagttgagatcctgccactgcaattcaacctgggtgacagagttaaaaaaataaaataagaacttatagaaatagaaaagggcattgaaatgaggaactcggtggtgggttccgcaggaggtagggtcctgtctggaaagatgacgagcaggtggtggctgcagtcgagtaggtgagccagggtgttccgggtggtggggacagagtgagagggagcagctcaggtctgcaggagccgctggagagagaccccggaggcagggggcggctgagcctcggccacaactggggagaaacaaagtcagctttgcctgggactgaaagcagaacagagacgggctctttgggcagccggagagggaggtgggcagaagcacgtgctgcggccccggaggcggcaggcagaggagcggccaccctggagtgcctggcatcagcttgtaggccccgaggaggaggccccccatccctggtggtgggttgagacgagggtgtggattctttttctcaggccgcccgagccatggtaaaggagtacacgctggtgcatagtgggcagcggaaaggtgacccccggcctgcgagggtgggggctgctgcgggctgatggtagctgattttggtgaggcttgcttttttttttttttttttttttttttttggcagaatctggctctgttgcccatgctggagtgcaatggcgccatcccagcccactgcaacctccgcctcccgggttcaagtgattctcctgcctcagcctcccaagtagctgggactacaggcggccgccaccacgcccagctaatttttatatttttagtagagatggggtttcgtcatgttggtcaggctggtctcgaacgcctgacctcaagtgatctgcccacctcggcctcccaaagtgctgggattacaggcatgagcctctacctggcctggtgagggttttcctgccccactcagtgcctgtcaagggacaggagcaagggtttacacagctgagccccggggaggctcagggccaagtctggggactgaagggtcaggcccctcccttggtcccagtagaggtggcaggggggccatctgggagggtggcggacgctggcgatggccagcggcagccggtcattctctgcgtggattgtgaagggaggggtggcacgggccagggctggtcctgggggggtgcctgtggatccctcgggcctcccctcccagctgaggtccccacgttcatcctgtgtccatgtcctgctggccgctcaccttggtgtaacgcaaggtccatgtgtccccaggaagcaggaagagctggtgcagcaggtgcggaagcggctggaggaggcgctgatggccgacatgctggcgcacgtggaggagctggcccgtgacggggaggcgccgctggacaaggcctgcgctgaggacgacgacgaggaagacgaggaggaggaggaggaggagcccgacccggacccggagatggagcacgtctagggcaggtgctgcggggccacgggggctccctggagtcgggtcctggcagtggggactgcctggtgaacacagatgtgcttgggatgacgggtgcctcccaagagcttcccatctccctagaagagcccaagcgtccccgtcccgtggagtcgctaaagccagccctccctgtcctttccagaggccctgccgagagcccgtgctgcctgctggagccgcctgcagacgcggtcctcggccccacgtgaaccaggctcggcggcgaagcccagccttggagacacccaggaggaaggccgtgctcctggctccctcctcggcccgtccccacttcccggggcctcggggcacacagctggggctgcccccacccgaaagaccctccacgctcgtcctctacagagtccggcttcgggaagtgccgggtgctcctgggccctgcctggctccctacgacctttgggctcgaggccagctcctccccatgcccgctgtcccagctccttgagactggagagcagccagcaggtgcccggcagctcggcgccacggcttgctgacagctgggagggtttctcggtctggaggcgtagttttgaaactcacatcacccactgtgcagcgtgaggacgggactctggtctgctgtggggggcatgcaggacggcgccactctctgccctgccatgcggctggtggtgccacagagcctcaccgtgcctgagtggcatgcccaggaggccgctctccttcagtaaatgtaacacagtcgaggcacgtcatcgggcagccttccctgtgtgccaacgccagccttcgcttctgaaaaccaaactccagccgctgccagtcgggacttggtcgcccggcgctgccagaatgctccactgccagccggcccccctgcctcggtttcccttctgtttagtggcgacacaggcacccagctttggggtggtgctgacgctcccaggggtgccaggagccactgggacagggtgaggctcccagacgctcctcgaggtgcccagctctccagggagcttctggcccaaggccgtctgagggatctgctccttaaccccccagtgccttggcgagggcaggttccaagccacagacgcctgccccgagtggactctgcggccagtccctggtgccctcctggccctgctgcccagtgagggctcctacgggtgggttcattggcctgggcccagcgagcccccacctgcattgaccttaggcccatagagagggcctgtcccggtgctgccccagccaggatctggtcgctgccccagggggactgatgggcagagtcgcccctgtggctggactgtgaccatccctgatggggcctgaccgcgggagctgaggaagcgccgctccaccgtctgccctccaaggacccgcatggaggcagtgggctggcagcttcctgctgctccctgtcagagtcaaagcacaaatcctcaggacgggctcaagggccagggcagccgagggaagctccaggtggggaccacgtcttcctgaggttggtgcccactggctgggaccctttgcagtggggtggcctcccctctgtctgcctggtggagggagccgtgggcgtggggacgtgactgaataaagccaccatgggtggatgtgcttggagcctggagttcggtgcgtccgctagactttggtgcccacgtttgagcttctgtctttggttgggtgatgaaaggctgaaagcggtgtggggacagggccagcaggtcccccaacctcgcggacattcacaacccaagagtcaggcttaggggtattcagagaagaccaggccggcctgggcatctgtgggcaagggccgtgccccctgaggtgccgctggctcagcctagggatcgtgggtcttggccctgctgccccggtgaggaagatgggctggggctcagacccagcaccgctccttccaaaggaagggaagcaggaggggctgcctggcagggagggccccccaggtcctcaggtcctgcacagccgctgcagggaggggagctgtgccccgggaccctggacttcagctcactagccatggccactggaagctgctttctggacctgaaggctgggaggccaccctcccctcatctgcccggcactcagagacactctgtttccctcttcccatctcccactgtgtccctgtctcccttggtctctctctgtctctgtctatccctgtctctatctctccctcttgtctctctcttgcgccgtctccctctctgtccctctttgtttcttgctctctctcctgtctctctccctcggtctctgtctctgtctcttgctgtctctccctctctgtcgcagcccagcttcctgtcactgacagaccccgatcagtccctctgatcccggggttctggccatgtcctggccttggtctgagatgtgatgatccctacccctgccacagggccctccccactggaagcccatccaggccctgggctgtcgctgttgacgaagcttgagggtcctttcctctctccctgaaaccttggggacccccacaggccaaggcaatactggcctttgctagaggtcgtgcccggtgagaagtgagttgtaggcgtgggcacctgaggggccagcccagtgctcaggccctcgtcaaattccctgccctggaaaagtctcagaccctcaggctgaaccccctgggcgcaccgaggctccacactccagccccagaacccagacctggcatggggcggggaagcctgagctcccaatgctgggatctttcgtgggggcctcatgaccagcctgccctgtgcggtgcctggccccatcctcaaaggccacttggctgcccccagccccgcccatgtctcagccccaagaccttctgggactttttttttttttagacaagagtttcgctcttctttcgctcttgttgcacaggctggagtgcagtggcgtgatctgggctcactgcaacctccaccttctgggttcaagcctcagcctcccgagtagccaccacgcccagctaatttttgtatttttaatagagacagggtttcaccatgttggccagtctggtctggaactcctaacctcaggtgatccgcccgccccagcttcccaaattgccgggattacaggtgtgaaccaccatggcagcccttctggcacttgccagcagcagcaagagcctcacgtgtcccccgcctcccctcagaccaagctccccaccgctgccgccacagagggtaccagggaggagaggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggc

SEQ ID NO: 13534 - DNA, 6625 bp, Human
atgcctggacagggcggccatcaggaaacaaataatacaaacggtgactgcccagggagggggccaacagcgtgctagcattgaggccaggtctgtttcactccagaactgaaccctgtgccccacgaaagtcttaccagccttctcctgggctcccagggtagagtccgggctggggaggctagtgcctcgggctccctgcctgatggtcgccctgaggtcacagggaccaggagccctctctgtcccccgccctcccaggtgccgagcagagagatcgacaaggcggagggcaagttctggacacactggaaccgggagaccaagcaggtgagtggctcgccccgagcctggctccttcccacccagccctggcggccctagccctgccctagccccacccgtgcctgctgaacctttctccgtctctctagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagactccacgatatccttggggtctccagatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacagcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcatcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcggggccagtggaacccttcttcccacagccccagcctgttctcagggccgctggcctaagatactccctgcggggaaggggcttcatcgggcaccccaacccagagaccccagggcggcagccccacccacagcctcagacgcagcccctgcctgcccctgccgtcaccgctccctggctgcaggaaggcagctaagaggggcacccttgtcccccgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggggcagtgcccgggccgtggcggggggcatggatttgttgcagggtctgcagtactgagaacagcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagccgcgtgcccacccaccgcagactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggtgcgcgcaggcaccgggacacggggcaggagcgggcgggggcggcgtggcctcgtggccgctctcaactcctccaattgcgggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggcccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcgtaaaggagcaggtgactctgcggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcggcggctgcaggggcggcgcggtctgcgccttcttgcgcgcgggggcgctccgagggcctgcgggggcaagtgcgcgctgcgctgtggtcactggctctgtgccgccctcttccccgggcgcaggggacaagagacaggcctgtgccctgaacccggctctctctgcctgcctgtgcggccccgggcgcaggtgaacccagccccgggtgccccgcagctgc

SEQ ID NO: 13535 - DNA, 9127 bp, Human
cacgcacgtcccctgatgtgagtttcatgtcacttgaccaggaaatgcttgaatgtcctccagagaaaaatgaggcacttcatgaacctgtccgggcggcacccacacaatcctgcccgcctgtgggccgtccggagacagaacctcccaggcagctgtaagctgttgtggcagcagggactgtaggagttggcgtggcctgcagctgacggcgccagcatggagagggtgcagttctccctggtcctgaagaatgtgtggccaagaagcccgaggcggggagggttccttggggccagagggtggcgttcccagcaaaggacagtccttctggtgtcacagtctcctttttcacactggaatgttctttgttttgtgaagggatggcgatggtcacagtggtggtttctcgaagtttacgtgacaacatgtaaaaatgggcatctctaggtgggcttttgtgacatctgaacttctgatggggcagccgtgatactgcagtgagctgggaggtccacctcaccagttaccatgcttgatcattttcataaacttgcccagggaataaaaactggttggggagggctcctgggcccccatagagtaaggggtgacttcaggccccaccacaagtcagcagtacagctggcctgtccctcagcatgcccctgcacacctgcggccactgtggcctgtccctcagcgtgcccctgcacacctgccgccactgtggcctgtccctcagcgtgcccctgcacacctgcggccactgtgccctgtccctcagcgtgcccctgcacacctgcagacactgtgacacatcactgcagacgcagtagttcagatgacacggctgtatcagcttctggttctggggtcagagtccaaacagtccacagggctccattccttctggaggctctgggggacaactcgtttcctgcctttcccagtgtccagaggcacctgtgtcccttgcctcggggccccttcctccccattcacagccacagcgcagcctctctgactctcagcctcccgcctcctctcatgaggtcacccaggatcacctgccattttaagatcctcaagcccacctgcacatcccttttctgccatgaggggacatgttcacaggtcccagggattaggatgtggacatcttttgggggcagtgattcactcagtctcatgggccccatctctctgagctcacccaagacccttaaaccagggcccggggccaacattgagcaggcaagggaaagactaccaggagatgagaggaggctgcctggaactcagatttgcacagagcctgaaagggcgtgggagaccttggcagaggcctgcatcaggaagaggatgttggggactcagcagagccccctgcgccacaagcagatgtggccgatctcccaggtgttactcagtgaggatgcgaagatcagtgtcctcactgatctccgcctaacaaatttacatcgagcccaagagattaggttgggacaagtaagcgtagccaaccagagagggaattcagaggaaggcgtgaacactaggggcttgggcagtccgggatggcttcctggaggtggtgactcgtttgtgagatcttggtcttgtcttccctttatgccttctctgggctccctattacaatttcaggtctccaggccttggcaccctgggctggagcggcttcctctccatccctcatgcctggtcacttggagacaggctccagcttccttgtgtctgtgcctgtccacagtgggcctcagcctcctggaagagactgggtgcgctatggggtggccccctcagggctggttagaccctggcgctgggagtgcagggtgaggggcagtctcgagggctccagcccagcccgcccagggaggtcccagcagcagccccgagttctgagccatcttcctcactctcctcttggcctccacaggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggtgggccagccaccgtgcagctgcctgtggtgggtgctgggctttccagggcagccctggagagggtgccagaggctcttcttgggcctccgcccaggctgggcgatgcagccccgtgtccagacgctcccctgttgcccccgagcagccacagctcccatctgtccaccccagagagcagaccctctgtggctctgagtcccatgtggacatgttttgttctgtccacagccttctgttttgcattatttaattttctgggagtggggagagctgatgtcagtccagccagatgtggtgaagggcagcctttgattttagcttgtgcagaggcaggggtgagccgagtcccctcagcaccgtggacatcggggctggagcactctttgtgtaccctgacatgccccacgggcctggcctatggcaagggctctgttaccgtccccgtcttccagatgaggtcatgggtagagggggtgccacagccgcagatggtggagttagactttgaactccagcgtctgagacaagatgtgtgcgcccggctgccccagcttagggcctgcagatgggcgggtctttgggtcttcagtgtagcccatttgcttttcttgtgcctgtgtctgccttgtgcctactgctggcgtggtggcgtgggcagtggacggctccctgcctcgggagtgaccggcggtgctgtcctggctgtgcctccctctgactcagaaccaccaggaaggtggtgtcgggggctccctgggaacccccactgctcgaagcctggcccacagccccaggtggtgacacccgtgctcacgaaggcctcccgctggatcccccgttttcagaaatgcttgaccactgtcagcggtagccatgcctctacagaaggggggttctgcctccatgcctctacagaaaggggatcccgcctctgagggccttgacggcagcaggccgcgatcttctgtctaacgggcccctgttcttcccctccaggacccgtacttcatgaagaaccacctgggctcctatgaatgcaaactctgcctgacacttcacaacaatgaggtgcggcctctgcctggctccgggcggctcgcggcgggctgagtggctgacgtcagggggacctgcctgtgtctgtccgcccggcctcgagtcatgcgtgtttcctttccactccaggggagctacctggcacatacgcaggggaagaagcaccagaccaacctgtgagtacctcatgtccctttgatgcctggtgctccagcagccgttggctcaagtctctgtgagcctcgcgggccactgctccacagccggggagccagcctggcctgagcctccctgggcgctggagtacggttcctggggagcattagagaacagaggcatggatggctgaggcgggcagatcacttgaggtcaggagttcgagaccagcctggccaacattgtgaaactccatctctactaaaaatacaaaaattaggccaggcatggtggcacacgtctgtaatcacagctactatggaggctgaggcaggagaatcttgaatctgggaggcagagattgcagtgaaccaaggtgctgccactgtactccatcctgggcgacagagtgagactcttgtcttattaaaaaaaaaaaaaaagagcagaggcatggagttgttggaagggccccagccagggacagtgaggagcatgacaggaagagaacatgcctgtcctatccctgtcctcagccaaaccccagggcccctcccaggcccctggccctcctcatctctcagcttgtagtgagctccaaggtcagggggctcctggcacctgggcccatggctttggtgcctgtgtgtggaggggtcccagcagcacctccatcctgtccgcagggcccggcgagcagccaaggaggccaaggaggcccctgcccagcccgcgcctgagaaggtcaaggtggaggtgaagaagtttgtgaagatcggccgcccgggctacaaaggtgagtctgcccgcagcggggccggccacagccgctgccgtgacataagtgtgttctttagtctccagtgcgggaggtgcagccctgatagcctcctccctgagccactgttttccggccttggtggccgtccctcacccacctgcagcctctggcgttgtgtctgggagctgtcaggctgggcccgataagcacccatctcacccagcagcccatttcccagctgagccacagtctgtgccctcctgtccgggtcttgtggaagcttctgggaattcttgccaagcaaaagagtggaagtggaggtgtggtgagccctggcacatccctccggttaaccttgaagcctttgaaggaggacagggagaagcggctgttagaggcagctcctcccggaccctcagcagtgggaatggctagaggtgaccccggttcagaaagctggggaagtgaccagggtggaagatagagacttgtgtccatagggttcaggaaggcgggcacgctacccagcaagtgttctttacagaaggcggggacagcctgtgtgcctggcctccagacagaagcctgcagggcagaggtcccggggcaggtgcaccgggtgggcgagggtggctagagcggcaggctcctggtggggaggccctgacaggtcctgggcttgggctcaggacggtgaggcggcagagggcttgtgagtgtgcgtgtctgaggccgcatggagagtggccgggcggcaggcagcccagcagccattctcggggtccaggctgctgagctctggcgggaagggcatcctctctcgctcaccgtatacatggtgtcagccctgttcaggcggccccactcgaatcccagagccagggtgccgagggcccctccctacccagtggccccaactcctgctgggtggtatcccagcacccctggtgaagggctctggggattgggacaaaggagcaccatcctcggtccctgcctgagtgactccgcaggtagctcagctctggcgcacctgtgccttcacctataccagaatcccagagcctgggcggagattgtctaatggttgccagagctgcagggcctcccccagggtcccgctctcgttcagtgggtggcattagcctgccccaggttcctcagcttcggagaggacaagcagccgggacctgagagctttctgtgttgcagtgaccaagcagagagactcggagatgggccagcagagcctcctcttccaggtgagatcagggacttgggcgtggggggcggccaaaggcacccaagaggcggctctgccacccggccgtgtccctgcagattgactaccctgagatcgccgagggcatcatgccacgtcaccgcttcatgtctgcgtacgagcagaggatcgagcctccggaccggcgctggcagtacctgctcatggccgccgagccctacgagaccattgcttcaaggtagcgtggctgcggggttccctgggcccccttgagatgtgcaagccagaaggatctgcataggctgggcaggatgcccctcccatcaggcttggggtcccctgggccccccccaagtcggagccagaagggtctgcacaggccgggcagggcacctctcccattgggctctgcaggagggcctgcttgggctccactgggccaatgagaagggaggccggcagggctgagcgccaggcctgtgaggcctttgccaagtgacctcacttcctgggccaggctgctggagggcttcctacagcctgtccccatgcctggacagggcggccatcaggaaacaaataatacaaacggtgactgcccagggagggggccaacagcgtgctagcattgaggccaggtctgtttcactccagaactgaaccctgtgccccacgaaagtcttaccagccttctcctgggctcccagggtagagtccgggctggggaggctagtgcctcgggctccctgcctgatggtcgccctgaggtcacagggaccaggagccctctctgtcccccgccctcccaggtgccgagcagagagatcgacaaggcggagggcaagttctggacacactggaaccgggagaccaagcaggtgagtggctcgccccgagcctggctccttcccacccagccctggcggccctagccctgccctagccccacccgtgcctgctgaacctttctccgtctctctagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgcagcgctgccctactgtgtcagtgtgtgtgggagtgccaggcacagcaccatcccccagtttgggccgactggggagggcctggggcccgccaggagacacctgtgggaggcctgagagatggctgtaccttggagatggcctggtggaggacagaccccaccagccagctaggaggggatctggggtcctgttctggggagggaagagcagactccacgatatccttggggtctccagatagcccaccaggggtggggagggtgagcagggacagggcgcccccactgacttgggaccctcctcctccaggcccacacctcagcacccaggacatctgggccccccgcccccagcgctgtctagtttggttgcctggccgtcactcccagcctggttcccactcctgtgtcttctggggatggccctcaaggacagcatgttgacacatcaggcccagctctatcactggggagggagataggctgccagggacagaaagggctctttgagaaggccactctgcctggagtgggggcgccgggcactgtcccccaaggtcgcggcagaggagataggggtctgtcctgcacaaacaccccaccttccactcggctcacttaaggcaggcagcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcatcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcggggccagtggaacccttcttcccacagccccagcctgttctcagggccgctggcctaagatactccctgcggggaaggggcttcatcgggcaccccaacccagagaccccagggcggcagccccacccacagcctcagacgcagcccctgcctgcccctgccgtcaccgctccctggctgcaggaaggcagctaagaggggcacccttgtcccccgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggggcagtgcccgggccgtggcggggggcatggatttgttgcagggtctg

SEQ ID NO: 13536 - DNA, 5999 bp, Human
ctcagcctcctaatgtgctgggattacccagcctgcaatactttttaaaaatcaaaatcaatgcccaagtatccatgaggaacaaaatatcaaaattgtaaataaagacagaatctgactttgcacttatcccacccacctccctgatcttccttatcttcagctcatgttggccatgttggtcaggttggtctcgaactcctgacctcagttgatccgcccgcctcggactcccaaagtgctgggattacaggcgtaagccaccgcgcccggccgatttaacttttaaattgaaattataaaatataaatatgtatgttgcatgcgtaaaacattgcataaagttacataaaacgttgcaaccgccacggtccccttatcccccgcctccagcccagtgccccgcccgtccgtccctctcttccggcgctgagggcgcagaaactcggcgcggccaccagatggcgccaccgcgcctcgcagccccgggacatttcgtgccccagcggtgggcggcgcggaggaggtgggatgcgtcagccggacccgcgggccggggagccgggcaactggggaaagtgagccgccgggcggaggccagaccccaggctggcgggggaggggactcagatgtgagtcacccgggagcccccagtcgaccgtgggagacgttgtcatgcggggcctgccagcctcgctcctgaacagccttcccggggcggcggagtcctgcaggcggccgtgcctggcgcacacgcgtggctccaacacgaactagcctatggcctcaccaagcctcagtttccccttttgcataatgcacataagcatcccccctgcttcccaggtcttggattaaatcatccatgaatccggaggggtggggggtaccaggtccgcaccacgcactcaatgcaggtcagcgcccaccccggagtgagaaataaaagtagccgtcatccttgcacgtgggccctgggtggcggcgtgcagccggagcctgcaccattcccctcaacaatggctttctcccgggcctggaggcctccgcacgggcaaaggctggaacgccaggcagccggcgggggcggggccgcgccacctgcacctcccacgcgcaccccaccctgatactcgcggggtcggcgaggaggcgcccactttcttctccagagcgccccgggctttgcaacctcccactttcggggccctcgaggaggcctcccgcgaccaccaggtgacagctgatgtgtattgggctcttactgtcagccgtattttatgccatgctctgcaaaccagcgaggccggcgctgcagacccattactcagacgggaacagagaggccgggagaagcgaaatcacccaggggctggggtcgtcgcagccaggagagactccggccctcaccaccacctgggcgagatcacgctgcaaacggggccccttcccggtgcagcccctccacccccagcagaacttgggaaaggcgcggtccgggactctccgcggatcgggaggggattccaggcccccccgaaagtccgggccgcctcgcgcgctggaaatcccgcgcgcgccccgaaccgcggctcggctgccgggaaatcaggagaaaaaaacttctgcttttttttcttttctggcattcgcggtcacctacccggcccccgcgcgccctcctcccggttctcgcccccacgtggggcgcccccgcacgccgctcctccccctcccctccgtcggccaaccgcagagctagctgcactcgcccttgtctttccaccaataggaggggcgaatgactccactgaggccacgcccaatgttcaagtctataaaagtcggtgccggaggctcccagctcagatcgccgaagcgtcggactaccgttggtttccgcaacttcctggattatcctcgccaaggactttgcaatatatttttccgccttttctggaaggatttcgctgcttcccgaaggtcttggacgagcgctctagctctgtgggaaggttttgggctctctggctcggattttgcaatttctccctggggactgccgtggagccgcatccactgtggattataattgcaacatgacgctggaagagctcgtggcgtgcgacaacgcggcgcagaagtaagtagccggggctgccgccgcctgaggtcagccgggacgggatgggtcgggttgggccgggccgggagcggaacgtagcacccggtggtccgcccgtcactgatccctctttcctggtctcaggatgcagacggtgaccgccgcggtggaggagcttttggtggccgctcagcgccaggatcgcctcacagtgggggtgtacgagtcggccaagttgatgaatgtgtgagtcagacccccttcccgggctgggcgcgggtgggacgggacctcccctccgctctggacgctttccgcacgcttgtcttgcatggagctgggacttccccaagtgccccccgctgtggatgcagagcttctctgccgttttgtggatcgggggctgccgtatcctgatgtatcgtctgcaaacacccctcccgccgtgggcctgtctccccctaccccatactttgaaccgtgtgccctcccctccccccaccgtcaccagcttgcagaggcaatcccctgcacccttgcagtttctcttttgctcttgcacgctccttttttgcaaactccccctgcacggtggcccctcccctgtccccggctgacccatccctaccctttggccccctcagggacccagacagcgtggtcctctgcctcttggccattgacgaggaggaggaggatgacatcgccctgcaaatccacttcacgctcatccagtccttctgctgtgacaacgacatcaacatcgtgcgggtgtcgggcatgcagcgcctggcgcagctcctgggagagccggccgagacccagggcaccaccgaggcccgagacctgcattgtctcctggtcacggtgagtcgggcctctgccctgccccgccacgcccgggcacctgggccggtgtttgtcaacaaagtcaggctgactggtcctgcacagctcagcgctcagccacgtttggcatgtcccgtgggcagccgggctggggcctcctcacccaggaagctattttgagcctgactgttttccccacacaggggccccgggagagggaggctccactaaaccccttcttttccctcctacagaaccctcacacggacgcctggaagagccacggcttggtggaggtggccagctactgcgaagaaagccggggcaacaaccagtgggtcccctacatctctcttcaggaacgctgaggcccttcccagcagcagaatctgttgagttgctgccacaaacaaaaaatacaataaatatttgaaccccctcccccccagcacaacccccccaaaacaacccaacccacgaggaccatcgggggcagagtcgttggagactgaagaggaagaggaggaggagaaggggagtgagcggccgcccccagggcggagatccaggagctggcggccgccgatcagatggagaaggggggacccaggccagcaggagacaggacccccgaagctgaggccttgggatggagcagaagccggagtggcggggcacgctgccgccttccccatcacggagggtccagactgtccactcgggggtggagtgagactgactgcaagccccaccctccttgagactggagctggcgtctgcatacgagagacttggttgaacttggttggtccttgtctgcaccctcgacaagaccacactttgggacttgggagctggggctgaagttgctctgtacccatgaactcccagtttgcgaattatagagacaatctattttgttacttgcacttgttattcgaaccactgagagcgagatgggaagcatagatatctatatttttatttctactatgagggccttgtaataaatttctaaagcctctggttgcttgtatgttttcggcttctagaacaactaggacccctgccccctccccggggacacgcttcaccccccacaacccccgccagctcaccaggaagtgttacttaagcccgttagcagctccaggctcccgtgcagaaacagtaccccttctctccgcagcaggcgccgccaccgactccaacaaatctatgcctctttttttttttccttctcctcctaccctgcagcaattaagagaccggtttattacgaaacctggccgccgtgccaccactgttactggctgtgcaggagccaaccccaagctctgggcacatatggaggcatttcagcgggagggggtgctggctgcagcccctgaccgcctaggcggccaccgcagcccaaggtccggatcggtcaagggggcacctggtaccacacagcgaggtgagctcagggcttgcaaggaagagcgcttttggaggcttccccagggagtgcccccccagcccaccacagccttctccatcccaggataggcctctcttttgcactaaagaaaaaaactttttttatttccgcaaactaaaatcaacaagcagaaaaataccccaggaagtcggcctccgggccagccgggcttggcgcagtgctgcgttttgcctgtaaaccgaaactgcgagccctggccagccacctcctacttctcccaaagttgcaggcgcggtggtgactccccctgccccgggctgggagcgtggcccagcccttccgtgcccggcctcagtcttcccgccccgggtctgcagagtgggcccgccctggccaggcgccgggacgacctcggttcccctctgccctgcagcccccaagcctgggaactaggggggagtggggagggggtggggtggtcctgcccgcaggccgcgacctttccacggagcctcacgtgggcgcatgaggaaaaccccagcggctccctaggagtcacggggatcgggggagccccgacgggggagggagagagagaaggagggggaagtcccagagggagaagcggggaggggagaggatcccgcctggggctaggaggaggggagaactgaagtggggagaggggagcccaagaaggggaaggggaatcccccacagccctgaaccaacagggaaaccccgggaggggggtagacaggtaggagtcccgaaggggttgggggaggggagaatggaggcgaagaggcgggagccccgagggggtagggggtgatggagtggggatccctgagatggagcccaagaggggagggcacctgggaagagtgacagagggcgaggggctcttgagggattggggtgcgggagaacatgtggggccaaaacccaagggggctccaggtggggaaggaccaggtggggcaagggtgcgcctagcggcggcctggaaaagctctggcttttctttttctttcttttgagacagtctcactccatcgcccaggctggagtgcagtggcacgatctcgcctccctgcagcctccacctcctgggttcaagcgattctcctgagtagctgggaccacaaggacccactaccacacccactagtttttgtatttttagtagagatggggtttcaccatgttggccagactggtctcaaactcctgacctcacgcccgacttggcctgcaaaatgctgagattacaggtctgagccaccgctcccagtctctggctcttcgttggtcaacctcgtagggtagggaggcgaggccagctcggagggctatgcccccggggatcggatggtctgtctccatccggattgttccattcttgctcctcggtctctagaactgtgcagcaggatctcaggctcctgagccccaagtggagacagggcatggaggggccccagtggtgggaccctcagccaggaccttcacctgtctgtgcctcagtttctccctctgaaaaatgggggataatgctacctagctcatagattgtt

SEQ ID NO: 13537 - DNA, 7965 bp, Human
ctcagcctcccaaagtgctgggattacaggcgtgagccaccgtgcccagcctcaggataaactcctaatggggcaaacggtataaaccaggaggcccccagctcctgggatgcttctcctctctccttccccactcagggtgtggattgctttttttttgttttttttgtgacagagtctcgctctgtcaccaggctggagtgcagcggcgccatctcagctcactgcaacctctgcctcaaggtgtggatttcaacgtgcgcagtctcctgggacctcagcagggcagaggatcatgggatgcagagtctcttgggggggtccgtggaatcccctaactcgggagtctcacccagggtgattctgcccccgccaagggacactgggtgatgtctgcggatacttgtggttgtcacgactgggggtgctcaaggcatggagtgggtggaggccagggacgctgctcagcgccctgcagtgcccagggcggccccaaatgtcaaccgcaggagttaatttctgcctcaacacccgaatagcgaatgctcgtagcagagatgcaacaacagccttctggtgcagtacgaaatctcgaaagacaggcaggcgcggtggctcacgcctgttaatccccaaactttgggaggtcgaggcaggcggatcacctgaggtcaggagttccagaccagccttgccaacatggtgaaaccccatctctactaaaaatacaaaaattagccgggcgtggtggcgggcacctgtaatcccagctcctcaggaggctgaagcaggagaatcgcttgaacctgggaggcggaggttgcagcgagccgagattgcgccactgcactccagcctgggtgacagccaggcccggtcgcaaacaaaacaaaattaaaaccatgaaaggaatcaggatttgccaggagtagcatttttgcttggtaagaacaaaattttgtttatacatgaaatataaaatattttattaaacctcactgcaaagtggcaactttttgctaaattcataatttagtctacacacaagctatgtacccgtatgtgactgccaagagttatatctttgcttattaaaagcaaagtgcagttcatacctgagattttttttctggatttaaccaggaggggaaatatttttgctaggtaagtccacattttacctcacaggcgaaacagtttaccgaacttgaccaccaaagaaatcgttttttccttgggagatccacattttagttcatacatgagatgtgtttctgaattttaactgccaggagtagtgtttttccttagggtaagtttcagtttccacaggaaaaatctgaatttatctgcaaggagtaaaatttttgcttaagtccaaattgtacacgaaatattttactaaatttgaatatctttaacattggaagttctttttttttaaacactggaagcattttaagaactgcaagaccaaatttaaaaaaataaaaccagtaatatcatcgatgattaccaggtgttactggaaataattctggcgcggttggacaaccccccaagcacccgggggcctacccaggggaggggtcccgctgcgtgaagggaccctagggaggacgacgtggaccacgacagacaaacgggcactcgaagacccccgaaaatcggccccagcgagccgcccccgcccccaaggcacgattgtgggggcggggacggctcggggcgcgcgcagcgcgtacccggcgccacggcagccccgcccccagaaggacgcgcgcaggagggggcgtggcccgaggctcaccaaccaatctccagagagcctcttcctttccctttccctttcaccaatcaggcgctgggaggggcgggcgcgactttttttcccggcggccccgcggctctgcccctcgtgcggtcgcgttcccggcggcgcggggggcgtggcctgggcgcagcatctataaaggcgggcggcggcagaggcgccattttgcgaacggcgagcagcggcggcggcgcggagagacgcagcggaggttttcctggtttcggaccccagcggccggatggtgaaatcctccctgcagcggatcctcaatagccactgcttcgccagagagaaggaaggggataaacccagcgccaccatccacgccagccgcaccatgccgctcctaagcctgcacagccgcggcggcagcagcagtgagaggtaagtgccccgcccccgtccgaagcttccagaagcgccggccgcgcaggcctgcggggggccgtcctcggggcgccagataggtccccggcgcgcgagatccgcccctttgtcaaggccagaatcgcgccggggacgaggtaggcgcagggcgggcctggaggtcccccccggccttagcagtgctctcgggggagtcgggtttggggggcaagggtgcggagttggatttggggggcaccgtccggggcgcctgatttgcgggaggggcatgggtcggaggtcggatttgggcgcaggacggggagtcgggggaggcgtgtgtcttttgcggggttcgcgggatgggactcggtttcggaggaggggagaggcttctggtcgagggttggatttgcggggcgcagactgggaattcggtttggaggaagggtgtgcggtcgggtcggatttgggaggcgcaggatggggcaatctggttgggggcggggtcggccttggggggctggtccgcggacaggcagggcccgcggggctggtgaatctgcacttttcggtcccggccgtcgagcgtgcgctgcgggagcggggagcgctttgcggtggacgagctcccgcgggtccctgttgcctcgatgtggcccctgcacgcgacggacctcgtgggccccgtttttcgcccctgagcgagtcggtctggatggcccgggacgcgccgggcgaggccgcgcacgtagacggcacccagggcttctccgcgggggccgccggggagctgggggtggcgcactccgacagcccggcagcgccctgggaagacccccgccgcttcccgggaagacgcgtcccgcttccgggggcgcgggtgccagctgcggttgtgggggagcccgcggggtctcggtcgagctttcccgactgcgtcccccgaggtgggcgtcgctcagccccggatcgggaggttgggccgcggtgctggcggtgccgcggtttgggggccgtgcaaaatggaggcaactttggggcctgtttaccctgcgcagcaaatggctgctggcgctgccggctgcgcgattgtgaaaatctcccccggggcgcgaggccgcgtctgcctggatgacgcaaccgggagggcccgggcctggagcgggggcgggggggcgggcggccgggagccggagcggggcgcgtcctccatgaggtcaggctaggcccgcccggtcttcgcggggacaagcaagagtcccagattttggccgtagtgcagggtggaaaggggaagccgcgacagaactgaaaaggggaagcgctggctgtcttggtggccggggggtgaggctctgccccggcggggctgcgtgaggggaaggggccccccgccctgggaaggttgggctgtcctgggcggcgccgcccgaggagtcggggctcagtgaccgctgcccttgtaggtgcttggggcaggcgttggagctgccttcgggaagcctcgggggtgtgggaccgggtgggcccctgcctgggcggggcggggtcttctggccgaggcaggggtggggatgtgctgaaggccgcccgggcgccctggaggggtctccgcccggagcctggcgctgcctcgtgacctgcatcatcttcagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggcctgctggggctgctctggggccacaggtacttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtggggtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagtagctgggcttacaggcgcctgccaccgatgcccagctaatttttgtgtttttagtagagacgaggtttcgctatgttggccaggctggtcttgaactcctgacctcgtgatccgcccacctcggcctcccaaagtgctgggattacaggcgtgagctaccgctcccggcctggggtccctttttaaaaagtgcactccaaattcgtaccctgggattctaccctccaagggatgccaggcagtgtcagagcttttctgtcatggggcatgcacgtgggtgggtgcagcggtgctgctcaacactgtggtgtcaggacggccccacccagaggacgatctgggccccagggggaccctggagtagagcgggcctcagggtagctgctaaggcccaggaggtaggcaggtgggtcgggccagccgagacgctgacactcgctgcagctttgcagttctcctggagttcgctgaggagcagctgcgagccgaccatgtcttcatttgcttccacaagaaccgcgaggacagaggtaggtgacccgtatcgcctgcagtagggtgcgtgggggtgcctgcgccgccccttcattctcagcccgcaggcacggtctccctgcgggggtggggggtgcgggcggggggttctggtcggcaggggttctgacggcttctcccccgcagccgccttgctccgaaccttcagctttttgggctttgagattgtgagaccggggcatccccttgtccccaagagacccgacgcttgcttcatggcctacacgttcgagagagagtcttcgggagaggaggaggagtagggccgcctcggggctgggcatccggcccctggggccaccccttgtcagccgggtgggtaggaaccgtagactcgctcatctcgcctgggtttgtccgcatgttgtaatcgtgcaaataaacgctcactccgaattagcggtgtatttcttgaagtttaatattgtgtttgtgatactgaagtatttgctttaattctaaataaaaatttatattttacttttttattgctggtttaagatgattcagattatccttgtactttgaggagaagtttcttatttggagtcttttggaaacagtcttagtcttttaacttggaaagatgaggtattaatcccctccattgctctccaaaagccaataaagtgattacacccgatgcacctggctctgtggtggtgacgctggggactggtgggaggagtgcctgggaccacagagggccctgggtggaggggtcgcgggggatttggcacccaggcagctgcgggacccctcccacggaggagaccccctgggctgggaggccgggccctcagcttggcgccagccttgccactgctcgcttgaagccccttcctgcctcgcgtccccttccgccccagcctgggcctgcgcatggggatgtctgtgctcccaactcaacttttgagttcgccgtgttactggccgcccctagggacctgcagcgccgttcggggcagcagcacttccggcggggtcgtggcctggagcgcttccgggtctgcaaccccgccgtctgcccggccgcagcgccacctgccggccgcatccgggagcgccacccggaaaatcagggccaggcctggccgggaaaccggctggaaagggaggaaaggaggaactcgaaaagattgtagacttggcgagcgggccggggggatattcagccgtctgagcggtggtggggtcggccgggaggacaaacctggacacagatacccccagctcatttgggcagcgcaaatgcagagaaggggcattagagctgaggccatgcaggatgaataggagtatgaagcagagtagagggggctgttttctggtgtaaaaaacaacttgggcaaaggcgtggaggctggaaagtaacctccagggatgaacgacatggggttggagactctgaggagactttggaagagccctgtatgtattctgaggcactggggagccatgggaggtgtttgagctggagagggacctcatatctggggttggaaagatcctcccaggactgccatggggaatggaatggaggggcaactctgagtctccaggaaggaagccacaggcaagggcagtgcagtgtgtcagaggcataaaggaagactccatccccctccagtgagtctcctctgtgcctgtttattacatcatcctgtggtattaagtgagcacctactgtgtgccaagcctggcctttgcccccagggaactcacagccttgcggacagtaacagaggaataaatgctcctgagagtgggcggagaacgcagggtaaggagctagcgatggcccagagtgggcacctttatttgtttagagaaagtgaaactgtagccgggcgcggtggctcacgcctgtaatcccagcactttgggaggccgaggcggacggatcacgaggtcaggagatggagaccatcctggctaacacggagaaaccccgtctctactaaaaatacaaaaaattagccgggcgtggtggcgggcgcctgtagtcccagctactcgggaggctgaggcaggagaatggcgtgaacccgggaggcggagcttgcagtaagccgagatcgtctcaaaaaaaaaaaaaaaaaaaaaagaaaaagaaagtggaactggaacagtatggcagagggaacagcctacacaaatgcttgggggcgcgaaagaagttggtgtgtcacggaggaacagggagggaggcagggtgggcgcagagggattggggggaggtggcagggaaccgcggggactgttttagggaaggtgagtccagaccccgctgagatgagctgggtgtctaaggtcccagggagccttcccttcccgtgacaccaccaagcaattctccaccagggacaggggcattcacatgcccaaaatcactggccatcttcagcacaagggggtgctccagagccaggaatgcctctggtcccggcattggcctctcatggagacaatgacagaacccacgcggaagagcgccctggctgctggggaaggcagaacacagagagacattgatcagcggggttgtccacacctggaagtggcgtgggggccctggcttcagagagctgctgcccaacacaggaggcgctggccagcccccagccctggaggggcagctgca

SEQ ID NO: 13538 - DNA, 15778 bp, Human
cggaacccaaggcctgtgatccccacagggtgtttctggcaccggaacgcaggggccacatccaggggggcagtgcttgtgacgccggtgccttcgtttctgatgtggcttactcagctgggagttcctgtcctaacattttcggcgatggctgtgcacccacggcccctcttcacccgcggcccctacgtcctgccggttggcaggaaacctcttcccctgcacatctggggcacagcagcaaactgtggtcccccttcttcagtgagggtggggcttctgtctgtctggagccctagaatggggccaggggtggctggggcctgggtcagggaggacccggcaggatctgtgcagacaggcaggtggcctgcggtggctcccggtgcagggttcttggcctcctgggcgggtacctggcttgagggcgacgaggtgacagccgcgtccctggggttgcaccacccgagcgtccagttaacaccacagctgccacccttcagttctgcacgtgggggctcctccctcctccccaggctgcccctgaccacccttcagttctgcaggtggggctcctccttcctccctcctccccaggctgcccccgaccacccttcagttctgcaggtggggctcctccctcaggctgtccctgaccacccttcagttctgcaggtggggctcctccctcctccctcctccccaggctgccccagaccacccttcagttctgcaggtggggctcctccctcctccccaggctgcccccgaccacccttcagttctgcaggtgggggctcctccctcctccccaggctgcccctgaccacccttcagttctgcaggtggggctcctccctcctccctcctccccaggctgtcccgaggctccttgctggggaccgtcctgcctcccgtcggggcctgcgctgagactgggctccatgccagccggggctggctggccccctcgctccagagagcgacctgcacagagtcccctcagccatgagcccctgtccagacacggcgtttctctgtgggtggcaacaggctctggggccctcagctctgggctcgggagcatttaaggtggtgcagactcagcgaggggctgtgggctggggtcccaccatcccgggagcagggactgcgtgttccttctcaggaccagaggcttctgtcttttcccctggggtagaagtttgctgcctgccccgtgcccagccttgcttaggtggctgttggctccgctggtccctcaagccccgccattccctcctcagctccgctctgcaccgaaggggatgggtccgacccagcctggcatcatcacagcctcgagtggcgtccagcctgccccgctccaccagtggctgctggagaagaacccgagcctgggtcaggccctgggggctcctgcatcagtgcccggctctccggggcctcctgccctccggcccactctccccgctctcagcatcaaccagtcgccatgggcaggggcagctcggtggctcctgtgtccctgcctcgggcctgcctgctgtcatctgcctccctccctctttcccagagcggccctgggcctggatacggggactgttgtgtggcccctctgtgtctgggggtgcgactgctcccctggcttcaggatcctcagggcttctacccgggattggcagtcatgctctcctggcagtacactctcccacctgtgccacccacccacccacccacccatcccgctttacagaaagccccctgagccctaccctgttcgtccccaggcagccacgccgagatctctggcctctgatgtcatgtgatgtgtgcttcccagctgggttccgggcagggacggtgctcatcatgccccggccttcagagctccttccagcccagcagtctcctggctgtgtcctctgtggcctccgccccgtgtcctcagtggccccgcgggggccttgccggtgctcacctgtgcctctgtttctctgcagctgtgagccgtgagctttgaggcggtgggatgtgtcagcagaatgtctcctgcccccgagagcgaccccgaggccactgagaagagcagcgcggcctggccggcccgaacgcctgcgtctcagtagctgggagccacgggcccacgcccgcccaccggccgcagtgatgttctagccacagaggagccaagacctcaggtttccagagacttgggatttgcacggcagcagagtcaccgtggagaggccagggtatcacaaacttatggattttgacaagaaaggagggaaaggggagacggaggagggccggagaatgtccaaggccggcgggggccggagcagccacggcatccggagctcggggaccagctcgggggtcctgatggtgggccccaacttccgcgtcggcaagaagatcggctgcggcaacttcggggagctccgcctaggtgaggccctgctcggtggtaggtggggtcgggaggctgctggcagggccgccccgagtcaccggagcctctggtggggccgcccggggtcactggagcctctggcggggccgccccatgtcactggcaggtgcgttgaatcatcagtccgtcgtggtgcgagtgccacttcccttcgaggaggttctgtggggagagtgggtttctggccctgtcaccttttcgggaaacagttctgttgggaggcaggtggcccagagcaggccaggccacgccgcaaggagcccgatgttaagttgtgaatgactttcatggcccatgtgcacgctgggcgaagccccggctttaacggcaggtgcctgcccggcactcagctcgtgggaggtcttggccagcccggagctggcgtcaggtggctggagtgactgttctgtggtgatgatactgctgtgtgccactcccagcttcaccatgtaaaaggccgcacctggcccacctggctccgtcccttctgctcacaccaacctctcccgggtcggggtctgattgcccgggcaggcgtgaggagcagggccgaggactgagcctctcattggccaggggtgccttccctggggtgggggtgcctgaagatgaccatcaggcctgggggagctctgagcacctttggggccgttcccagtctgtgattagctgggccagggagctgaatcatccccggaaatgtggttaaatttattgctggtgctgccggagctcctgcgggagggcatttggcgtctgttgctggggttgtccggggaacccaggtgcacccccagtcagtgtctgtcgtggtgggaatcagggtccctgggaaagagcgcaggatgggcaggtccgagaggccacggcagtggatcggcctcacgtgggcacccatggcaggcggtgcccatggcacccatggcaggcactcagcccgatgaggttgtcagatgagggaaacaggcccacgcagtggtcatgatgtggctgcatcttcaagagcggccgcccaggggcgcaggagcatgggctgtggcggcctggaccccaggcatgttttgtggccctgcttcccacctcctgcctcactttacccacctgttaaatgaggatgaatggtagttgccactcgtgggcagaagggttcagcaggcagttatgcggcagaagtgtgtgtcctatgagtcaagcagcttctcccaggcgagggcagctgttggggtcactgttggctgtttctgtgttcccattggttgcacccagggccccaggaggccggggtttgagaccccacccgaaccagatcccaccccagcccttggggaggctgctgggattccacctctgcgcagaggctgggcttgggccacgaagcctcactgccggtccgacggcctgtggctcaggaggcccgggctccgtttctcagccaagagactgagcttttcccaacaggagctgtggcctcccaaccccgtgtgtgtgtgcacgctcagacacacgtgcagacacatgcagacatgtacacacgtgcccacaaatgcacatgtgcacactaaagcacacgcacacaggcgcacacagccacaaccacgcatacacaggcacacaggctcatctgcacacacatgcctggcacagccccgtgacctgcagcctgcggggtatggcttttgggaacccagatggctatgtgggtcctgtccttgggcggcggttgcaggctgctgaatagtgcaggtccctgtaggcagatgagagtgacgtgggtgatgccagctttttttttttttttttttttgagacggagtctcgctcggtcacccaggctggagtgcagtggcgcaatctcggctcactgcaagctccgcgtcccgggttcacgccattctcctgcctcagcctcccgagtagctgggactacaggcgcccgccaccacacccggctaatattttgtatttttagtagagatggggtttcactgtgttagccaggatggtcttgatctcctgaccttgtgatccacccacctcggcctcccaaagtgctgggattacaggcgtgagccactgcgcccggcctggtgacgccagcttttactgagttgcggtttgcgctctcttcagcctggcattttgggcgctgtgtgcttcgcgggcagccgcacatcgtggtttctcaggggtgccgggaggccgtccatcggaggacacaccagcccttcttcatctgctcccagcgcagggacgcttggctgtttctggatttgggcccttctgaatagaactaactgcccaaatagaactgaatagcactgggctcctcgagcactccacgtccccagcactcaggactgttggtggctttgatgttgagcctgttgtggactccggttgttgaatgttgttccgttgtctagaatgttctagaatgtgtcgttttttctgtttttaaggtttttatctttgatttaaaatattgactatgctctccttagatgaggctttctgtttttatcctgcttgggatccactgacttcttggatctctgtgttggtactttttcaaattaactttggaaaaatgtgagccattatttcatgaaacgtttttccatctcagctttgctttgctttgttttgttttgtttttgagatggagtttcactcttgttgcccagcctggagtgcagtggcaccatctcggctcaccacaacctctgcctctcgggttcaagcaattctcttgcctcagcctcccgagtagctgggattacaggcgtgagccaccatgcctggctaattttttatatttttagtagagatggggtttcaccttgttggccaggctggtcttgaactcctgacctcaggtgatccacctgcctcggcctcccaaagtgctgggattacacatgtgagttaccgcgcctcgcctgctttgtttttttttttttttgagacagagtctcgctctgtcacccaggctggagtgcagtggcgtaacctcagctcactgcaagctctgcctcccaggttcgtgccattctcctgcctcagtctcccaagtagctgggactacagccgcccgccaccacacccagctaattttttgtatttttagtagagacggggtttcgccgtgttagccaggatggtctccatttcctgacctcgtgatctgcccgcctcggcctcccaaagtgctgggattacaggcgtgagccaccgcgcctggccttgctttggttttttgagacagagtctcactctcttgcccaggctggagtgcagtggcgcgatctcggctcactgcaacctccgcctcctgggttcaagcaattctgcctcagcctcccaagtagatgagattacaggtgcctgccaccacgcccagctaaatttttgtatttttagtagagacagggttttgccatgttggcaaactcctgacctcaggtgatctgcccgccttggcctctgaaagtgctgggattacaggcgtgggccaccatacccagccttgctctcattcctgggttctggttctgcgtgtgacaggagtgcttggccctgtccccaggtccctcagccctggctgttttccgtctgcctctgtgctctcctggtgtcaggctgtgcggctgctgctgctgctgcttgaaagtttactctttttctgcagcctccaaccccagaagtccatgtggtgaatctttgattgcttagtggcatttttcggtttcgtctgattgtccattcgctctcagctgagatttcccatgtgcacattcactttggccatcttttcctttaaatctttgaacatgtttgtgctgtttcttagtccattttgtgctgctgtaacagaatgccacagactgggtcatttatttttatttattatttattattttttgagatggagtcttgctctgttgcccaggctggagtgcagtggtactatcttggctcaccacaacctccgcctcccgggttcaagcaattctcctgcctcagcctcccgagtagctgggattacaggcgcccgtcaccacacccagctaatttttgtatttttagtagagacagggtttcactgtgtgttggttggctaggctggtctcaaactcctgacctcgtgatctacctgcctcagcctcccaaagtgctagggttacaggcatgagccactgcacctggccagatcatttataatgaacagaaattgatgggctcaccgttctggaggctggtgagccccagattgagggtggcgtctggcaaagaccttcttgccatgtcatggcaagaaggcatggtggaaggcaggacggcacagaccggagggggctggattcgccctttagtcaggaacccactcccctgctgatggcattcactcatccacgagggcagcgactcagatcctctctctaggccccagccccagccccagcagtgctggattggggaccaggttcccaacacatgacccttggggggtgcatcaaagacacagcactgtgtggagtgacgtctgtgctgcttcttcctcccttgtcacggtcacacctccctcactcacctgtgggacagcctcactgggcgtggccgtggtgtgtgccgtgaggtgtggagggtgccgtctcccggcttgagcgctgagtttgtccccgtggctcaccttgtttctgtcaggttggtttcagcgttgctggggcaaggctgagggtaaacatgagcgactccaaggccagggagccctgtgccaaggtgtggaccttttgggttctcagctgaagtagagaatccagggaggaccccgcactccggccattggagctgtggcgtcctccctcctgtgtgtcccccggaacctcctgagcctctctggagctgttctctgccaggccccgtgggctctcctgccctctgcatgcatcgcgagtactgccggaggaggcccctttggctttcagagcccagagcgcccgacctcctccaggagtctgcagatccacaggcctcagatgctgccacacccacccagcacacacccaggtctctgacacgccagccgcacacagcggtggggttcaggcgaaggtttcttccacagtgcagagtagaagagccgggaaggaccccatcaccatcagatgcatcagagcttcaaaggcccgcccatcaagacgctgccaagagcatgaggccagccaggctggggaggacgttggcgagcatccgcctgcccgtcagggagccacagctggatgatacatcgacagacagcagagggacggtgtagcacacaggcgagggcttgtcctcctcagcctgggggagcgcagctcagtgcttggtggtcagcacgtgactgacactttgccggagaaggggacggctgcccgcaggaagagctacacagccgtgttcgccggaactccgctctggagagtcagaactggagacgggagggcgtgcctcaagggcagatgggcaaaccaaaccccatcctccctgtgagccgcggcacagcaccaggcgggcacacgcagcacgacacggcgaggagcccaccgcaggggcagccttttgggcggggaaggggggatgaatccactgtgaatcccacctccgaagggcagcgcaggaaggacacgcaaatgctggactgaacctgcagctgattcagggggcagtgtcctgagctctaaaacttcaaacctggggcagtgtcctgagctctaaaacttcgaaatctgaccaggcacagtggctcacgcctgtaatcccaacactttgggaggctgatgtgggcggatcacctgacgtcaggagttcgagaccagcctggacaacatggagaaagcccatctctagtaaaaatacaaaaattagccaggttgatggtgcctgcctgtaattccagctactcaggaggctgaggcaggagaatcgcttgaacccaggaggcagaggttccagtgagccgtgatcgcgccagtgcactccagcctgggcaacagaacgagactctgctccaaaaagaaaaaaactttgaaatccctctaaaaataaaatggaccggtggatggtagctgtgaggatggaccgtgtggcaggtttagttctggggcctcggcaatgagtgttgggtgtttggggcacggctcctgttgttttacgaggagaatttcctaataacgtgttacactggggagaacgtaggaggggagcccatttgttctgaaaacgcggggaccagccctggtccccggctcaggactggaggggttgccctggtccctggctcaggactggagagaccagccctggtcccgggctcagggctgcagggaggcacctggtcttccctcgtcctcacgatcctgcaccctcaagatgccacgttgttgaggctgtttagggaacttgacaagctgattggaaactgtgctgaaatagagcccaggtagtgatgcggacagggcagtgccagaaggagccccagcgattcctgtgctgcaaggcacgcccaggacggggcactagccgggggaagaggctctcagggcccaggtgggaccccagcctcagactatgaggtcatgactgtgtacagctcagccaccgggctttgggactttgcatccaccttagcagggtttccaaacccattgtctccacggccaccctgccagtccagctgcagcagggcggaacaaagtggaggcctctttcttgctttcttttttttttttttgagacagagtttctctcttgttgcccaggctggagtgcaatggcaccatctcagctcaccacaaccttcacctcccgggttcaggcaattctcctgcctcagcctccctggtagctgggattacaggcatgcatcaccatgccaggctaattttgtatttttagtagagatggggtttctccatgtttgtcaggctggtctcgaactcccgacctcaggtgatccgcctgcgtcagcctcccaaagtgctgggattacaggcataagccaccgtgcccggccacagaggcctcattctgcagcgtatgctactcgggcaaaggcagctgactgcagacccaacacggtgacccagctggatggtgcctgagagacggggctgccccacatggtgccctgtcatgccgcgggacaggtcgcccagcagatggtagctatggccccagtgccatcctgggctggagacacatgggtgccagacacgttcatgcctgtcgtctggcccagctgccgtggggagccctccagggccgtgtgcctgcagggaccggcctgttcacctctaggctcacccctcgggtgctgagtcaccacagtgggtggggccgtgccccctcccaggccggcttccacagctgcccctgcagagcgcctctgtgttaagggctggccgcctccttcctcagggggtgtaacatgtaaaaagctgcaccctggcctgtacaggggctcccgcctgttatcccagccctgtgggaggctgaggcaggcagatcgcttgagctcaggagttcaagatcagcccgggcaacttggagaaaccccgtctctactaaaaatacaaaaattagttgggtgtggtggtgcgcacctgtagtcccagctacttgggaggctgagatgggaggatggcttgagcctgggagacaaaggctgcagtgaactgcgatctcgccactacactccagactgggcaacagagcgacaccgtctcaaaaaaaaaaaaaaaaaaaaggttctgggcctcgtaccttctgcgctttcatgagactcagccctggaagtcctatgtggctggtggccccagggaacaggacctgggctcctctcttctaacccatgtgggccacaggtccctgtccatctgtgctggggctcacctgggggccgagggcctcgggcatgtgggagatttgtctttgagaaaggggtggaggagtgtggagcccttggggctgcctgcaggccgtgagagacctccccagtgccgcttctgtcctgggctagggaggtgggggggcgggggaggaggagtggcagacactgaggcggtgaccacacgggcagggtgcaggtgtcgggatgacttggcaggccatggtgcagtgctctggcaggctgggcccaggccctgctgctgggcagtggtgtcatttggagggtggtccttcagggaccccctcctgcctcctgcctcgggggtgggctggggaggtcggggctaggtgggccctgtgctggcggtgctgatggtctctgtccccgcaggaaagaatctctatacaaatgaatacgtggctatcaaattggtgagtcggcccctccaccccacccccgctgacgtgccccccagggatttcagggcagcgacccggtcccctggtgactcgctcttgtgcccccaggagccgatcaagtcccgggccccgcagctgcacctggagtaccggttctacaagcagctcagcgccacaggtaccgggcggcccgcgggtggggcgggggctgcgcaggggcagggagggggctgccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctggtgcgcggcgggcggggcggggcggggctcggagggaagagggtggccctggaggggagcgcgtgggacggggaggggcccggccgacaccgccgtgcccccctgcagatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaagggtgagctgcgcgcgcgcggcggggggcgggcgcccggaccccgctgaggctgcgcccctgtccccgcagagcagagccgccgcgacgacctggaggcgctgggccacatgttcatgtacttcctgcgcggcagcctcccctggcaggggctcaaggtgggcgaggaggccgggcaggcgggcggggacgcagggcgggagcaaggctgaccacagacccccgcaggccgacacgctcaaggagcggtaccagaagatcggggacaccaaacgcgccacgcccatcgaggtgctttgcgagaacttcccaggtaaggggtccctgcgcccccgccctgtgccccccaccccccaccccccacccccacccccgccgaggccccgctggcgctctctctgcagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctggtaggtgggggggtgccggtatgtgggagcgggggaccgggaaactgccctgagggagatgggaaccggcgctgcagcccatcctgacccctgctccctcacccacagccgacccccatcggcaccgtccacaccgacctgccctcccagcctcagctccgggacaaaacccagccgcacagcaaaaaccaggtgaggcccgggcgggaccgaccgccccagggaggggcatgggcggccagcgtgaccccctactgcccccaccaggcgttgaactccaccaacggggagctgaatgcggacgaccccacggccggccactccaacgccccgatcacagcgcctgcagaggtggaggtggccgatgaaaccaagtaaggctctggggcggtgccttcggggaggtgggggtgccctgggtccccatgggggtgggagggcctgaggcctgggctgcccccgccctgcaccccggtcctcctacctgagccactgccctcctcagatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaacccaagtgtagagggatttgtctgggctttccacgaagcttgacctggaacgggcgttgcttccatccccatcctgcctgtccgggacgagtccggagcggctggcggcctccggtaacagaaaccgactgatgaggcggaaggtaaggaagatggaagcagagggcagagctgggctctgtctggggagagggcaggagacgagtgttcacgtaccatggaaaggggaagtcacacacatgcgacttggccccgggggtcccgttccccgacactacacaaatatacctgaaagcctcagcgacggggcccaggcaggatggtcctggctgctctgacggcggaaggcctccttgactccctctgttcacgcagcagggcagaaaacatctccacgggggccacgacactgtgaagggaatcagcagtagctcccagaagaacagcggaaactgcaggcaggtgaagaccttggcagcactagccccggctccgccccgtgccttctccccagacaacaccccatacccggcagcaagggtggaagaccagtaccaccgtaatatgttgtgacaaagcagaaataatgcacctgtaagagtcagatggcaagagggaaatggaatgagctcatcgatggttttcccggcagtagcttggggataaggactacttgtcatgtgctttatatatttacccacatgttaaccttttctgatgctcttcatttctttctgctgatcagaaattacatctgggaccgggcagggtagctcactcctgtaatcccagcactttgggaggccgaggctggcggatcacgaggtcaggagtgcgagaccatcctggctaacatggtgaaaccctgtctctactaaaaatacaaaaaattagccgggcgcctgtagtcctagctactggggaggctgaggcaggagaatagcgtgaacccgggaggcggagcttgcagtgagcccagatctcgccaccgtactccagcccgggcgacagaatcccaaaactacctctgggataattttcagcctgaagaacttcaatatttcttacagtgcagctttttttttttttttttttgagacagggcctggcctaggctggcgtgcagttgcacagtcatagctccctggagcctccacctcttgggctcaagcgatcctcccacctcagcctcccaagtatctgggaccatagacgtgcaccaccacactcagctaattgttttgttctgttttgtttttaggtagagatagggttgcctgtctggctctgttgtccaggcacttgcggaggacgaggtgggaaagtgaccctgggatgagaggcgtgagccaccacgccgggccgagtgcagctttgtcggtaacaaattacaaattagcatttgttccctgaaaaaaatatttatttcacctttcttaataaggatgtttttgctggtagtggcattccaggttgacaaagtgtttgtttgggacagagtctcgctgtcacccaggctggagtgcattggcgtggtctcggctcactgcagcctccacctcccgggttcaagcagttctcctgcctcagcctcccgagtagctgggattacaagcgtgtgccaccacacctggataatgtttgtatttttagtagagtcggggtttcaccatgttggccaggctggtcttgaactcctgacctcaagtgatccacccacctcggcctcccaaagtgctgggatgacaggcatgagccagcatgctccactgacaaagtttttaaaacgcggcggctcacgcctgcaatcccagcactttgggaggccgaggctggtggatcacaaggtcaggagatcgagaccatcctggccaacacggtgagaccccatctctactaaaaatacaaaaaattagccgggcgtggcggcaggcacctataggcc

SEQ ID NO: 13539 - DNA, 314798 bp, Human
  misc_feature (1)...(314798): n = A,T,C or G
cactttaacctggaatgtcaagataattaagacaaaattggattattaagattattattagtgagggcaaatgacatctaagatagccatgttaaaagtggagtatcatattaaaaagacaactagatcccagggaacatcaatagagtttaagtccattgaacagatactgaattctttttcataatctgccaaaaaaaggttagcttgaaaattttcttttagtttctcaaatatcacactgctgcagtacacgaacctttactcattaataactaaggtcctgatttttttcatatgctttgctcgaagatgtagtattttgcagccatagacagtcttctaagatctctcctagtgttaacccacctatcctcacctctcccttgagatttttctttattttttgatgaactatctgggcttttaaactttgttaaccttttttgaggatacggtcacttaatctcaatgtaattttactttccacagtcaaaaactattgtgtaatactcatgcactggatttaaatgactgctgcctctccttcctttctttttatactattgtggtctaggtaaggctgattcttccatcatttgaaccaacaggccaggcttgggttctcataaagcagaccttccagcaggagcgaccaaaggatgacactgtcacctgaaattggactgctgttgtacctgacttgggaacatctttgaatcagacagtagaagtggctgtcattttcagggacagtagaaagtatgttggctctcatctgccaagtaggcaaacacaatcttttttttttttttttccttccaacgttctagggagctcagcctcagggctagccgcagccccccacaccccggggctgcggtgggctgcgcggtggatcagcctcagcagcccctgctccagcctgtagggtgaaccggccgctttcccagcaaaggagcaatcgagctgagggtagcgcctcctccgcaggagggggcgggagctcggctgagaaagctttcctagggagttgccttaaagaaagaaagcggaattgtcgatcactccagttgccagttttatacaattttaagcagtcgtcgccactcgtttcccctttgcaaaactgcaaatcaccaccaaccttgcatcaaatagaagtggggagggaaaaaaaaagcaaatctccttctcccttctcaccctccctttcttctcaccctcccttcctctcttactcgctccttctccctccctcccttctgcggctgccgctagtctctcggtctggctctctctccgacgggacttagcaacttcttatttctcagccccttgtccatttttttttttccatcctttgccatgaattggattgacagaggcgggggaggctttgctttctgccccagggaatggcgattcgcgtcctggggccgtgccggggagaatcggcagaggagaaagaaagagtgatagaaaaagagctgcaggaaggaggagaagggagacctccatctgccgcgggcccggcgcgctgcagcgcagcgcagcgccgagctgcgcctcggaatggcccggagcccgccctgcgcccccggctcctccagcgtcagcggctcctgcgcgcgggatgcattgggcaatttttgaaatcctgaagtaggaagagaccccggaggatataagtcgggggtgggggtggagcagagaatctgtgaaagatattcaaagagagaaaaggggaatcctgatcgtttctgcccgtgcttgttttcaacttgagcgtgctagcctttaacttgaagaagtctcattggagcatctagcattctccaggagttattcgaaagctgaaactttcagtggattgtgggcctggggagaagaaggattccgagggtggaattgggaagagcgtgcgtgcgtgtgtgtgtgtgtgtgtgcgcgcgcgcgcgtgggtcggggcgggggcgtcggggggccactgggaattcagtgaagagggcaccctataccatggcagtgcccggcgacgctgcacgagtcagggacaagcccgtccacagtggggtgagtcaagcccccacggcgggccgggactgccaccatcgtgcggaccccgcatcgccgcgggactcgggctgccgtggctgctggggagacctggtgctgcagccgctccggagctctcggaaactttcctccgcgctgtgcgcgggctccctgtcctttctgctggcgctgctggtgaggctggtccgcggggaggtcggctgtgacctggagcagtgtaaggaggcggcggcggcggaggaggaggaagcagccccgggagcagaagggggcgtcttcccggggcctcggggaggtgctcccgggggcggtgcgcggctcagcccctggctgcagccctcggcgctgctcttcagtctcctgtgtgccttcttctggatgggcttgtacctcctgcgcgccggggtgcgcctgcctctggctgtcgcgctgctggccgcctgctgcgggggggaagcgctcgtccagattgggctgggcgtcggggaggatcacttactctcactccccgccgcgggggtggtgctcagctgcttggccgccgcgacatggctggtgctgaggctgaggctgggcgtcctcatgatcgccttgactagcgcggtcaggaccgtgtccctcatttccttagagaggttcaaggtcgcctggagaccttacctggcgtacctggccggcgtgctggggatcctcttggccaggtacgtggaacaaatcttgccgcagtccgcggaggcggctccaagggagcatttggggtcccagctgattgctgggaccaaggaagatatcccggtgtttaagaggaggaggcggtccagctccgtcgtgtccgccgagatgtccggctgcagcagcaagtcccatcggaggacctccctgccctgtataccgagggaacaggtaagcactggcaactcctctctcggctcttggaaacttgaaacacttggcaaccggcgcagagtggagagaatccgagcgctgggaactaaagggaagatagcctagaaaactggtctaacttcagaattaagaaactagcaggttttttttttgttttttttgtttttttttttttgtttttttgccctctctttcacacagtagttttataacctgaacgactgaaacacaattaacaaaactagatggcatgtgtagggtcttccacagctgggccaactttttagatctgctacacctggtgtatggcttgcctactcttttcagtactcttacgctttccttccttagcagaaattttagaattaagtttagattttagcaatgagtgatttttttaacacatagattttactagatttctactttttaaaaagtaaaatctttttaatgaaatgatattaaacatttatgaaaaccagtaaaaagattctagagcaaagcaagctgtgcttgaaggtgaggaattgatacacattttctggttttgcagtaagttttatttggagagactgcagctgatggtgcccaatttgtttttaaatataatttaggggcatacattattacatgctagtgtgttttgtatcacaaacttcaacttggggaataatatgtctgaactttggaattgttcaaaattgtcaactgcgttttagtgtcaactaaaaacaaaagagttctctttagtatgtgcatacttaagtggatatttataaattcaaatggatttatgcagattttacaggaaatactaattcgggaggccatttctaagattgctggagatgtatatcttcccacaacgtgggaggaggaggaacctgggattataaagttgtaaataaaactttagtcacttttggggatgagtctccttattatcattaagtgatttaaaactatagaacagttgctataaagggcataaaggaacaaatcccaattttaaatgcatactgtgtctaaaaaagcataccgaagggtatgcctccctagttgaagcagatttgttcacctctctatttgaagtggatttgacacttgatggggaggaggagctggttggatacagcaagtggaaatttacatttttccctttaaattaatgcctacctgtggtactattaggacaactttagggagcaagagaatatcctaagataaagtaagctttttctttttaggttattctgtggataatcatttgggtatttctaagaaatagcagtcaccatatggtgtgggtggctagttggtttctgaaatggagttgattacacagatctatggctgtttgacattattgagcagagtagatgacagcatcatagtctgtttattttaaagcaaatgtagttatttgctttttgtttcgataaaacaaatgtttcttgtctttaagcttactctaagagtggaggggaaaacaggccactgactgatagttttggtaaaaatttggaaattgttaaaatggagtaagttatctatttgagggtaaactaaccattttaatttcttttcacagttatgggagagaatgtcttaaatgaaaacaccaccgctttaagtatgttcagaatacactattcattaacttatagggaaataggatgttactattgcaaaattcacaaccataatttctaaggaaaatctgggatttaatcacaacttgattccaaattgatatcatttaccctgtggaattattttttaaaattttatattaacatttataagttaagaaattaagggtggatagaagataagaaggtggttaggtaaattaaccagcagcattcatttaacccacacatttttattgggtttctctggtttaaattgataaatggagaatttgaattatctacgaagttatcaaaataagcattgcatatttaatgttttgctgattaatgctgttggaaaatgcataatcgcaatctatttctgtaattttctttggtcactattttttttaaagactgtgttaatgaagattattctaaagtgggaaactttgtcttatgcttgatggaaacacaagaatacatttagcagaaattgagatacttgaagttttaatgagggcatgggtgagtgtgtgcgtgtcactgaagactggtttttatatatgacccattaaaagttgttgctgagcataattgtggggagtgggtggaaactaacacagtgtactatcttataagataggacagtatctcatatacgttagccttactgtgtgaaaagttcaggagctacccacagtaaatggcttatctgttttatcataaggaaacaaacttctgattaagggtgcaaagtgtaccactgtcatttgcatactttgtgaagtcaaacatcaaaataattataaaataagtatataacactcccctgaatgtcatctgctttttttctgaaggaatgtctactttcaactcaagacaatactcataggcaacaagtgaattttaaatagtcatttaagaacttaaacgcacagtctgtcagagtcctcttgagaatttatttgcactttgctcattgtgaggcttaccagtgagagaatttcatcattttcttctctgtatgaatggcagtggctggttactgatgaactatccctcttcagtgaccctcagttccaaaagtgcaaagagaatatatgataaaaattctcataagagaaaccaattgacagatacatttttctctctccctccctttttttctttcaagaactgtaagtctgtagcactggtgtctgtgaatgcaagtggaaatatctttattctcaggaaaaaacaaagtttatagttctttaaagtttaaagaactataaagtttgtttagcttttagtttagtcctgacaacccagtgtccgcaatactgaggctgattttgtagatgagtgtgtcaaactacttttttggctgccagtgttaagaaggcaagtgtctgttaaggtgtgtgtatcttttctaagtggactttcgcatcccagagcagatatgtctctctcaaagtaccactgtgccctcggcccgaaacatgggaatatacagaggtacctagactttcttggagtattagatattatgcatgattaatatgttatttttcaatgtaaaattttaattttgcaatttttttgttattgcaaattgtatttgaaggggtgtctctccattctctttataaataaagaactataattggctgctcattcttctctaattactgagaccaccttacacattcacttttgaaagatttcaaaccaatgcaattttattttagttacctgttaaggaaaattttatatttttacctgtggtttcaggtaaatacaaaggcatatgactgtctccattaatgcatttgtaccacttaatgacagcatttttttgggatggatacaacatcatccattttgatcttagttgtcgaaagaagagtcaagtttttcaccactgatgtgagaaagacacttttaggagagaaagcaaacaacagcaaagcaaaaataggagaaatgggtatggtgtttgatggtaggcactggatgggaggcattgttattctttgacaaaaaacttgcttatttcttctcaaaatgtagaatacattgtttaaattcctaaatgcctgtcaatgtaacatattgttcaaattgagtaagtttcagaaataatcacggacttttaattaaattgtagcttctacatttcagtagtgttactcagtttatggtgattcaaagagcaatcttgattacttatgacttggtgacagaattaaaattaattaatgtcaatttctgaaaatactgaaaagggaaaacaagatttccttatcccttgggaaaggtgaaggaaaagaattttttgtgtgtcggggggacaaaaattgtaattttactttgtgaatacagatatttaaagcatactgaaaaagttttttaagtgacataaatagtcagtgaatctatataaatttacagaggctggaaggagtgaaaacagtaattttactctttctgtattgagtcgaaagtgtaaaaagttaaaactgtagaactgaaagaaatgctgtgtatgctgggctgtcatgttaattaaataaacaaccagaacagtgactctgtgtatgaaatacattttgaaaagccttgggggagggggtgcaggcaggcaagggtgagtgacactggcatgaaaaaacattcattctatctgcagtgacatttgtgtgaatttgttgtagtctattagaaaattcagatctgagaaataatctcttcagagcgctagttgaataaaggctttaccaaattgaattttacttctattttaagcaagttctcattctgtcaaggtaggatgtttataaacctcaaaattagaagtatgcctatatattttaagatttttccattaatatggtttgtgtcagtcagcccagtagagtcaatgttgacttcattgaaaacgtgtgttattttatctatcaaaagaaagagtttattttgggattaggataggagttgtgtttttgagaaagagttattgttgtgagttatactgtcctggatgtgtgaagataatcaatgcaactattgtatcatgcctttgcattgggcgatggggaaatgtcttatgctcccggaagtgatgcataaccctacaggtttatggtgaattgtttacttagctgccatatgtctcctcttcagtggagtcttcctgctccatttctgtgtggtgtttatatcttcttaaaaaaaccctcaaattgagattaaaaaatattatgcttatattctgcattcatgtgtttaatgaacctctgtgaaataattctgaagaccctcagaaagtccagtctcctattcttgcacctaaagatgtgttccattaatgttcaaatgaagataattcctttatatagaaacttgaatccttttggtaattacctatatatactttcatgataggtagtattttttattaaaggagattttttgttgttgtttgtttttttagtaaggctactatggaattgttttaactttgaactgagaatgtatgtttgtgctgttattgatataaaatatacagatttgatcactgagaaaaaagtctaacagatgtgcctgagttgtagtttagaggaagatgtgttgtataacaatcgtaaaaaatattagttgaccatacctgttcattgtgaatgtataccactgttttaaaagaagatgctacccatagctaatgttacccattatccataaaggcctttgatcaatcaacctaccaggtctcaaatcaacacattttatctgtgcattagtccttgtgctaaaaatcaaaaataatatacagatagatgtgacacagcatttgtctctgcaaagtttagagcctagtgagattaacgagaagtgaacataagaaaaagggaagtcacagtgaaatatcttagataatggagaaatgcatataataacttggagcaggtttttaacctggctccaggactcattcatctcctctctgaaattgtatgcagaacttcatttgttcattcttaggagcaaaaagtcttagtgtcataggttttcagaaggtcctcaacacatagatggttaaacataaatggcttagattttaagcaactttacattttgaagacatggagaatgtttttgaaaatggaaattactttggtgtacctttacagtctgctctgaaacaaaggtaaaataatatttcatttaggacatgttacacttcaaaatagtacactgattgattgtatttatgtcgagttagtttatgactgtaaatagctggttgcactgatattttaaatgcttaattctgaaaaggctgtagttagtagactacaattagtctgattttagagagaaggaaactgagagttagctatatgtgtgaagatagcccaaggcaagatggcttttgtccatttcctctttgacttgactgtgctactgaggaaacagtaggaaaggagtcaggctgctaactttaaccctgggtatcatttttaatttttcccatggagccaactctaaattctcattcagcattagaagactgaataatcagattgagtgtcagatgtgtaaataacacaaaacttgttaataccaggtagcctctggaatgaattattcttgactttgtcacgtaaatgaatatcagttgcactgaaaagtctaactttgtggagtcttatcaaacaaaagtatttagcagtggcttaaatattgaatatttttattttagattttcaatatgtttatttttgtatgttcaggatttccaaattcaaggcaaagcataatctgcagattggtaaggcatttcttcattagcaaaaacagctggtaatttttttcacctgttattttgcagtgtttccttagaatttcattaaaatataagtaaatagggtaaaatatcagaggaggtcatgaagaacattaccatttcgaagatggaaagctatttgagagaagtcacaaactaagcaatgtctgtgtttttgatttgattagagctgtcatttgttatttaggaatctgtgaatgattattaaagctttcaagtatagccagtcctgctaacataataataacattacattaagggcactcatgttctttcctcctgagaagatgactggttacagggggcacatattgtttgctgaagtgtgtgtatgtgcatgtgcatgtgtgtacctgtatgtgcatttatgatttgtgtgtgtgcatgtgtgattttcccctggcagaaaattgctttggttgtatcaatttagtgaagaaacagtgtcacccagtggctttgatgaaaacagtcctataaacattatagataagcactgtccagtagaaatacaacacaagccatacatttgattttacattttctagaggccatacacacccaagaaacagatgaaatgaattataataatatgctttatttaacccagcatagcatgtcaacatgtaatcggtgtaaaaaaaatgaaatattttgcattctgtttttttgtgagtctaaatatcttgtgtgtgttttacacttaaagcacatttcagtttggcctagccccatttcaagtattaaatagacacaggtggctaatggctaccatattggacagtgcagctctatatttttaaagatttgtaatatttgagatactaatgtcacctcttcagttataatgaaaagtctttgtagatttaataacaatatacagtctttaaaattatatgtgtaatcttgatagctcatttttgtaccactctaatagttgccaagtctatttgcccttttttcttcatttctcattattgcatttattttaaaatatgattattttcatcggagggggagatttagcagagttccttaataaaagacctttatattaacctgatttataacacagtatcaatatttccagttaattatgaatttgcctttaggagtttggtatgtaacagggattgcttatggatacactgtaaacacaacacatgttcatgatgattagtctataattgggttatctaatgtctctttagaaatgaaagtgcttatgtttgtaggtcattatctttgtaacttaggaaactaaaagtcacaagcctgctcctagctttaatggatgaaaattgtaacagtgtctgtaaagggctaacttttcactactgtttatataaataccactttcatggaaacacaatgaaaatggttcattctgtgtatagagcagattggagattttgatagtgtggaatttttaaagtaggaatttagattaggtgagttttggagccattttctgagttcactccggtttgcaatttcaaactgatttcagatgaaaaagtctggaaatgtttaatgtcatgtcctctccatcacctttccttatactctatgaattcgttaacaatagccgtaattccaattctacatcaagaaataaagagaaaattatatatggcattttactttatatatagatatatagattaacttttaaaaatacatttattatgtgtataacgtttatatctgtgtgtgatgcttttagtgattgggacagggtatattacttatttttacactgcagattaatatagacagattttatatcatagatacatagattttcacttactagaaattctaaaaagatcaaaaggcaatagaatcatggtatacaaagaagcacatttggacaaaatgaaataatgtggatgctggctcgcttctggtaaaagctgacttaatttagagttcttgaagaagctagctgaagaatgaaatgtcattgtaacacacatctgtttcttgaaagagtttatacttgaatgtaactagtcactgttagctctggctaattttgaagttgatttaaattaatatagaggttgttctggtacttttttttttggtcagtctttttctgttctccatctctatctacatgcacattttctttcatttcattttctttttacctaatagagtcttctccctccgaatgtgtttaaaattttaaggaatgccattctgtctctcccagtaccttgttagaatattgaaataattttatgcaagaatcttgtggttttggtttaataggattttagtaaaaattttccatcttgtgaagtaagtttaaataactgaatatttatgctatgtctgtggcaagtgtttcctcctctccaggtataaaccacttaaagagacctaatggaagtttgaagtcatagagatattattcagtgggtaatgtttaattctgtggcaacagttatacagctatgtggaatcagcatccttagcccatttttaagctagcatgaacacaaataaatgaaatagtttttatttttatcgtattttagagatccacttcagaaatgctctttagtgagcagtgtttgtcctcgtgatatgaaacatccccttgtttgggagttattatttcagggtccagcctcagcagcagtctctcaggaagtttggaagggagagagcctgctgaactgcttatgctgtattgagaatttgctttctagtctcaggaactaaggaagtcagattcagattaagacaatttttattataaaaggaatcaaatttttgtagcttccttttctcagccataagcatttcatttagaaaattctggcccagtgtcttgcttattgtaagtgctggctggatggtaggaaaaatggatgaaaaagaaataaaagacttttaacctgaaatatttatctccccattctcctgaggttgaggtagtgactaagttgatttaaggaaatttctatgggaagaagagaagaaataagactatcaacaaagctatacattttcagttttaatatggtgtttacatttttgttacttaaatattttcttgcatatgttacataaggggttgcatttgcctgtgcccttactggtaggaaatcccatgttcagcatgagtcctagataattatttttagctcactctcaactgaaaataaccaaagctaccaccaagatcattgtagtgtaaacctttgaaaaatttctgaaatttgggttcatattttagaaaaataaaatgtcaagtgtttttcacattcaactaataaattgagagagaacaaactctgactttattttcttccattccatcccacagggctctgacaggtgctcttcagctatcaccttttttatactctagtagtctgcattcttgttagaggttcttactgaatagctgtattttctgaaaagtctaatgtaaagcaaatgttatctccttagcttttaattgtgatcaattacaaaacaaagtttgagatggttgcttccagagatgacattgtgaaattgactttttaaaaatgtcatccaactgccgtgctggttccatcatgtggaatgatctagaaatttggtagcataattgcagaatcaagttgaactgaaaaatcagaagcttatagggttttattgcagtgataaatttagcttttcagtcatttttctttggtccacctactttttaatagaacttgacttgtgaaaatcaaaaaatttaagtcaaataagaatgttttgttgttgcagttttaatacttagagaagatacagtattgttatatcctctcactgaaatcagagacatatcttttgagtatgttaggcagatgatcatgacattagatgaactaggaatacaatatttaggaaaaaagtgatttcgaaccttatggtgtcaagtttctttttatctgtacatgtcaagtgttctcacaggcagactttttagagagattgctatcactgacaacttccagagtttgagagttttttgaatatactacttaaaaaaatctccatatggttttcatttgaaaaaacatattacaaactgagacattcactataaattaaattgaaataatcaaaatataattaagctatttgtgagtttacattttgcaaaacattttagaagcaaaatcatttaactttgtttgcattttgagacaaggagctaactgtgtgtatcatcttgagtagtgtctgtttttattcctagggattgttttccctataattggagttgttttttgctaggtaagtaggatccaaataacagcatagttattaaggcagtagcctcgttttgtccacttctcgtcattcctttttacttaaataacaattagatttgctcatcttaacccctttacagagctacagctagagcttttaagtgtttttggtggaacttccttaagcaattaactagtcctaataaaaagtgtgagaattagattgggaatgttggatacatatataactaaacaccgattaagtaagttatctaaaaaataaagtggcattcagatatgaaaaccaccataaaaatgagtgccaaaaactaatggtagtatttttgcttgtgcacaaagaagactagatcaaaatcaaatgaataattcctcagttttcaaaaaatattttatggtcttttgagggcataatattagtgcatgtaaaaactagaaccctttatgatttgaaaagaggagaagatgctgagagagacactcttggaagctgggcaggaaatccagccatgcattgcctcaaggtctgtcattagatcaaaagcactcaggggacgatggtctgtgtaagaggtcctaatgctattcacgaactctcctgacattcattagtttccaagacattgattcttattctttaactttttagcacatttatcattttcacttatacatgtatgctaatagcaatcttatgtgaacttttacctcttatatgaccagaattgattaaaaatgtcggcaagtaagtttgttatttaatatctctgaactttctctattttacattgaatatttgctacattgtaagcattacagtatgactagattcttctttttttctaacttctcccctgttgataattattcttatataactataatgccatgttaatcaaactattgtttatgaattataacagtaaatgcccctggttaatagattaatcaacctgccttagatgcttttgaagtctgtgaggacattgcttaatttcacctacatataattacatatcatttgacactctctaaatcgagctgtttattgtagttctcaaaatttagtgtgaataaaaattatttgggaaaactattaaaatgcagacgtttaaatactagattatagatcctgtaaccttccagatactctgatttagttaagtgtagagtgggatcctgaaatctgtggttttaaggaacacctcagttgcttctgttgagaatcacaggactataaacttgtgtctactgaaactgtacaggaagttctgacttttgcaatccaattcaacaaacagtttaaaagtgcttggctcagacaagaagggtcagtatcatggggaaaaactatacacacgcactatagtttatgaacctatgacattcataaatgtttcactttgatttcatttctttgaagttcaaaaaaacttcattgatgatacctcaaagaagttttcttaaccaccctggatatcaatttcctcatctgtaaaataggaataggaatatcagcttcactacctatctcatatggctgttttaaaggctaaatcaaaataaattgctatacaaatgttaaatagaaagaatatatgcactctctagactgtcacagaccaaagcttgtaatatataccagtttcttaaactttcaaaactttagtgaccctgtctgtaccataagaataatataactgatttcttaacgttgcaaaggttaaattaatgtaataatggacagaggttcttgttaaacactgtgcccagctgaacatgaataatacatattcttgcccattagggccaggtcattgaaggttataatctaaatttcagaaagcactatgtaaaacaatgcaaacaaatttgcatttgattacaaaaactcacaagtcttacaaaatatgaaaatttaatggaagttaattaaaacagtattagggagttaaattgtaagcaaagccactgccaaatgaggcatcctaggagccagataaggcaacagtagaaggagagagatctgatagggacttcagatgcttcgggtgcttcattgaaaaaggcttaagagagatatttaaaaaaattggtggagtctttgaatgtcttcgtaaaaatgatgcttttgagggtcggttgtgtagtgtgtcctataaccccacgtacagaaacttgatttgtgctttaaatttgacttgtactctagctgccattataacctatattttgtcttgaaaaacaaaattattttcaaaaattttagtttcatttttcatggtaaaatatcagtcattcccaacccttttctcattatataccagtggtgccattattctcaaatgacagggactttctgcttattaactgtataatacagctaagccctggctcagctgtggccctcagtggaaggtagtgagtgtttattttatcacataaaaatattcctcaggatgctgtctctttttaccagcttccacagggctttactctaggccttaaccctcagaccactcttcttccagatttttccacttattgaatgatctttcagtctagtctgaggtagttattttggtttggccctaggagcagcaggagtcctgtggagtctcagtctactcctattggtttcagtttataaattctgcctggagtggtcatctctttcctaacttggttacagacagtccatggatttccacttttgtgacagaagatggaaaaaggtgaggaggaggggacagcagatcacataggccatgaggggtcactgcaagactcgttctgaggcagatgggataccatcaaagggttttgagcaaagaaaggatgttaccagccttatgttgaatagggtgtctcatattctctgtgttgagtgagagtaggtgttacgatgtaagaaggaaaccaattaagattgttgcaataatccagagatggttgggagttggaccaaaatgataatgtcaggggcagattttaaatatatattgaaatcagtactgccaagttgggtattgatgggctggtatttcctttgaggacagacagagagttcctttaatgttttctcttattttagagaccaaataataaaggaatatttatctttatttcttgctttaaaaatatctgattgggttgacattttttttttttttttctctaattttatcttctgcctacaccttccggaagatatacaaactggagacctgacattcgggaaagtcatgaaatctgcttacatggaaataaattctaatcaagcatctcaaactcttcaaaagttttttagtttgttaggatactataacgttttgtgtaataaaagttggttttgaaattttattttgatataaatgtctttatattttaaaatctgttttaacaagatgaaattttaataaatttgtgtcattcacatgctcttccttttaaagagatgtatttgcagctgatactctacctatcttttttaaaaattttaatttaatttaattttaaaattccagaatacatgtgcaggatgtgcaggtttgctatgtaggtaaacatatactatggtgctttgctgcatctatcaacctgtcacctaagtattaaacccagcaagcattaactatttatcctgctttttttcaccctgtcgccccacccgacagactccagcatgttgttcccctccccatgtccatgtgttatcattgttcagctcccacttataagtgaaaacatgtggtgtttggttttctgtttctgcattagtttgctaagaataatggcttccagctccatccgtgtccctgcaaaggagacgacctcattcctctttatggctgcatagtattccatggtgtatatgtaccacattttctttatctagtctatcgttgatgggcatttgagttgattccatgtctttgctattgtgaatagtactgctgtgaacataaacatgcatgtatttttataatagaatgactcacattcctttgggtgtattcccagtaatgggattgctgagtaaaatggtattactggttctaggtctttgaggaatcaccacactgtcttccacaatggttgagccaatttacattcccaccaccagtgtaaacgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatatatataaatatatataaaatatatatataaatatatataaaatatatataaatatatataaatatatataaaatatatataaatatataaatatatataaatatatatataaatatatataaatatatataaatatatataaatatatatataaatatatataaatatataaaaatatatataaatatataaaaatatatataaatatataaaaaataaaaatataaatataaatatattaattatattaatatattatattatattatagtatattatagtataataaaaaaatactaaaaaaaaattgccattctgactggcatgtgatggtatctcaatgtggttttggtttgcatttctctaatgatcggtgatgttgagctttttttcatgtttgttggccacataaatgtcttcttttgagaaatgtctgtttatggcctttgtccactttttaatggggttggggttgtttgtttttttcttttttcttctttctttttttctggtagagttggggtttcaccatgttggccagactggtctccgtctcctgacctcaagtgatccacctgccttggcctcccaaaatgtgggattataagtgagagccactgcgcctggcctttttcttgtaaatttaaattccttgtagattctggatattagacctttgtcagatgaatagattgcaaaaattttctcccattctataggttgtttgttcactctgatgattgttttgctatggagaagctctttaattagatccatttctcaatttttgcttttgttgcaattgcttttgatgtttttgtcatgaaatctttgcccatgcctatgtcctaaatgatattgtccagattgtcttctagggtttttatagtttttggctttgcatttaagtctttaatccatcttgagttaatttttgtataagttataagaaaggggtccagtttcaattttctgggtatggctagccagttcttccaggaccatgtgttaaatagggaatcctttgcccattgcttgtttttgtcaggtttgttgaagatcagatggttgtagatgtgcagtcatatttctgagttctgtattggttccattggtctatgtgtctgtttttgtaccagtaccatgctgatttggttactgtggccttgtagtatagtttgaaatcaggtagcacaatgcctgctgctttgttctttttgcttaggattgtcttggctgtgtgggctcttttttttggtttcatatgaattttaaagtagctttttctaattttgtgaagaatgtcaatggtagtttaatgggaatagctttgaatctataaattactttgggcagtatggccagtttcacaatattgattctccctatctatgagcatagaatgtttttccatttgtttgtgtcctctctcattccttggatgctctaaatatcttaagctctagtatagcaaaaacatgagactttcaaagaaaattcaaggctttctctattagtctttgaatagtctgacaaatcccaattccatcaaagacatattgccaatacatcccaggtctttttatagaggaaatacttctattttgtatccatattaactcagactatctgttgacatacagagcacttcagtgataggtgctatataaatatttaaattaggatagctgattgctctgtaagttaggagtttgctaattctacattgtggttaatttctgattatgaaacattttttacatactgcttgggaacaacaaaagataagatattttaaaatgtgtgaaatgaagagtttttaaatcacatgggaaaatacttttgatgagtggaaagtgaaatcatgaaacacaattgaggataggccaaattcacagcagaaaggaaacttgtcaagatgttcattcttgtttatgtgggagaataatgggttatttttacgtacttttatatcttttttctgtattttgtaagttttcaaccctccacacgtattttacaatcagcaaaacaaagctttataaagaaatgtattcctttgacattgttcctttggatatgttcacagaatatttattagggccattgccttagtggtcgtttgggttggagacatggaaattgcacctccaggtgcttttaggaatggtaatgtgtgatattcagtactatataaaacacccttggaagtaaaatccttttgcattcctaatttttgtcccagatggctggacaggcttaaaatttcttataaaattggagatcctagtggtacatgatcctccaaggtagatccctgaaattttagatcggcctacagacaatttttgtaactttacctgaaggtagcgctttatgaaaatatatacatccacgtgtatgcacatatataccgaaacatgtttcagtttttaccaaggctttttggtgtctttttgttttagacgtggcaacaaaactctaccacgtcaactgatacattgagaagaacatgaaaacaaatgttgttctactaaggagagaaaattccttataaaacatgtaggaggagagtattgagactacctcactgattaccaggctaataaggttacaaataaagatcaggttcataatgatttttgtttaaagtaatgagcatgttttctaaaaatgagtaatttctatgttttgttgttttcgtgtatctgagttacatacactgtatataatattgattaacttcagtttcatttcccaggattttgttgagtattccctgcatttcctgcgtaagactaaggaactttatacatttccatttgttgttgcttgtttgaataaatgaatagagaaagaaaacaatgtgtacataatattttttaaaatggtgccacatctaggattattaaaatgctttttcatttgaagagctgtacaattttgcagaaataaatttgagaatattaaaacagtttctataactactgagaaaaatagagagtgtgctctcacttaaccaagaaaaaaatctttctagaagaaaatatgatagaatcagagaatgtaaacagaaaaatcacttttactcaatcattccacccagtttttacggttctgtcgaaggagagttagcagaatagtactagctgattatgcttgcgatggttaaggtgacagagactggtagccatttcctttctctctctctctttctgtgtgtgtgaggaggaaagggggcaatcagtactgaagttagcatttgggtagaatccagatctcagccttgcaggtcagagatgcaatttttccataaaactagaggttatccactgaggaggcacactaataatacaactatatctcatcaatcagaatgtcaggttattaatggacacaggaatttaactgtaaggaagatcagagtgccagtacttactagtcagtgcttcttgtttttagtgggaaagtcacctttagcatggttggctcctagactgtagctgaggatctctggcttgtgggaattctccttggaaaacttacactgtttgagttttttattctagaacgtttgaagagtgcccacaacatcccagaaaatgtggggattgctgggggaagattcagaaatgaaccatccttgcaccctccctgagtaaagatactacagtaacaaatgattatactgccaagggataaatactttgaaaaacagaaagtcatgagaactttgccctccagaaaggtcatagctaaatttaatgctcaaatactgtcaccctcttaacatggatttctggtaaagttctgtcttcctgtcttttctgacttttccttttgatttatgttttacattctcacgtgtttatgttagtagtaggctgactataatcaatttcagtacaatataaagaatgtatctaaaatagaaaaaaaaaacccagtgtattcgtaaaagaatatttctatatatttcccctatgggcataaggcccagaggatatgaggtagggaaggattaagatgtgttgaagagctggacatcaggtgtggagtgcatactgggttgtggaaaagacaggtggaaaagacatgtgaaaaagacacatagccctgcttttgtgctgaggagtagaggtgggatgctgggaaattttaagaggtaagataagggggatgtggggccggtgtggagaggggagcaggatgaagacttgagtgttttaagattaggttgaggaatttgatattttatgtgtaccaaacattatattttttaaccaaagagtgatgtgaacagattaaacatgattattctagcagtggattaggtggggacccaaatggacacaaggaggcgtttaagagggtattgtgaaagtcctgggtagagacattgaagatttattaagatagtagtggtgggcaggaaaggtgatttaagaaaaaaaaaaaaaaaactgcagttgggaggattagcttgtgattgatagtggaaggtgttaacaaagggcatgaacgccacttaaaactgtgaacctgagaaactagaaagatagtggcgctggtcactgagaaaaaaagcatcagatcagtttttgtttattttagtttcggggtgaaggagggaagatgatgtgtttggtttggacatattcagtgtatgttacttttgcaacctcatgtgaccctgtctccttgaagctgctcaattttcttagttcacaaaaaaatattttaataccacaaccacgttagttcaccgtattttcctgattagtatgtacatgctttttagaactggagcttcttgtgcccagcctatcactacaaacacagaaatgttgtaggctttggacatttcaatttgtgcaaagactatcaccctatttaagattagatgttaagcacggtcctaaatcttacagggcagatgactttttactcttggtgctgaatcctaccgatgaaagatattactgagtcagtacagacttcagcttctgtgtaaccctctaacgatccccagggcaatatactgttgtaacctttgatcacacttaaaaagtacatgggcaaggttcttatccttgagcagatgagtgcttttcatatgactagttaaaaacttactttatcagtagagacaatctaggctgtcgagagaagttaaccttgtaaaattatcaggttgagttccactttgatgtttttcttgggttattctagatgcttactatagtttgtcttttgtacagttaatatatgtgtgtataaattaggctatattcaatgatgctagctagcatcatcgtgtgtgtgtatgtatacatatatataacatatatattctcatatatatatatatatatatacacacacacatacatgcattatacatatatatatatatacaattccggaccgttgactctggatcaagggtccggaagtgcaatccactgttgattctttgctcacatagttaagtttcccacattgtacaatcttcaatgctttcactactcttctagacttgtgtttatatatcatagtaaatttttggaggacttttttttttccgtttatgtatgtgttacttttcctgaaaaacatcagtgctgttgtatcacaggattggagggaaattaaaggtagagctcaatttatgaaatgcctaacaagtgatcattgttaagcttttgcctaatcactaccataatagggaactaagtccccttccatgccattttgttctccccttttcccctcctctctgtttagatatggtcttttgaaattgaggagtccagaatctggtacaacagatatggtatgactggaacaaagcgaagggtggctgtcacctcttttgtagaacaataatttgtgaaccttttttacaatatacacttgcctaagcatcaaccctcaacctacagagcatcaacgtgtgggtgagcaggaagggggacgtgtaattttgtcgtatgcctacttacgaaccactagtctagttaatgagacccttaacacatactaggactgcacttgcttttttttgtcagcataataatctatagatgtatattttgtttgtatcagctaaagctttgaagaccttcacatgagttaatactacactccattcatctgtcctgtgcctttggtactttagaccttctgtttttgtttggtcccaatgcaaataggaagataactaaggtttctgctttgttaaataacttctggtgatttatgtatagctagaacagtgaaaactgggaggcaaaaacactacataaatattaaaacaatttgacaaatttataactatcactgtaggtctaaaatgtgtaggtctaaaatgtacctggactagatgtggtaacacatgcctttagtccaagatactgaagtggctggggtgggaggattgtttgagcccagtagctcaagatcagcctgggcaacatagtgagatcctgtctcataaataaataaataaataaataaatacataaataaataaataaataaataaaatctagctggacattatggaaaacagtatggaggttcctcaaaaaactaaaaatagaactcccatgtgatccagcagtcctactgctgagtatgtactcaaaggaaatcagtatgctcccatgtttattgtagcactgttcacaatagctaagatacagaattaacttcagtgtctatcaacagatgaatagatgcagaacatgtggtatataaacacaatggaatactattcagccttaaaaagaatgtaatactgtcatttgcagcaacatggctagaactggaggtcattatgttagggaaaataaaccaggcacagacaagtacttcaagttctcacttatatgtgggagcctaaaaagtggatcttgtgtaggtagaaagtagaatggtgattgccagaggctgggaagggaagaggggaggaaggaatgaagacatttggttaatggatacaaacatacaattagatggaaggaatacattctagtatttgatagcacagcagagaaattatagttaacagtaatttattttatatttcaaaatagctagagtggaagaattgtaatgttcctttattagtctgttttcacgctgcctataaagacatacctgaaactgagcaatttacaaaagaaagaggtttaattggacttacagttccacatggctggggaagcctcacaatcatggcagaaggcaagggggaccaagtcacatcttacatagatggcggcaagcaaagacagagagccaagagaaaaagtttctccttataaaaccatcagatctcatgagacttattcactaccacaagaacagaatgggggaaactgctgccatcattcagttacctcccaccagttccctcccagaactatgggaattatgggaggtacaattcaagataagatttgggtggggacacagccaaactatatcagtctccaacacaaagaaagataaatgtttaaggtgatgtatcatccagttacctgatttgattattacacattgtatacatatatccaaacgttacatataccccaaactatgtacaactctgatgtatcaattaaaaagtaaagaaaaacaaaacagaaaaaaagctggaaaaggaaggcttgagatttgatgcactaaattctgtgtacttttggaaataatattaacataaggtggcaccgttaatggtgaaatgaacttttcatcctaggtgcaccctttgagatggcaggcacaatggctctttgtcttctacaagggtgattatcacatggtaggctttttcaaacactaacctgccttcgattctgatatgttctctctagggcacctcccaacctcctgaatcaatgctgtagtgagccacagttactgatgtgtgtgtcacatccatcaggtatgttgacgtgagagaaaaagtttacaaatcgcagctctataaacttgaacctagaagggcatgaacctaatttgtggaccacgcaagcatttactttcctgtacaaagttcctgtaaggagaaatttaaataaatatagtgtagaggaagggcctttccaggagtttctttaacatcagtgaaatattcttgcaagaggcaatatttgactcagtattttcattggtcatttagattttacttttgactttaattactggtattctagccttcaatggttgactgtttcatgtttctccagaaagttaggtttcatttttattttctatagtttatgagtccatgcttgtaacttatagggaaatcataaaaacagaacagagtgtagttagaacactgaacttctaaaaggatatccctgccttagagatggtatataatactttttcatgagttgggataaataagaaacctctttgtggcactttgggcaagaaaagaagttttgctgtagttaacattgtgatgaaatggactattaatctgaagagttgcacctggaattttttaactaatgtagttaacaattaatttgtataataaatagctatcagagaagcattataatgatatcagatgctacatattcttctcaaagtactaaattttacaattataatctccacagaagaaaatacgattttaaactgcaaataaaacatgcaagaacttgaatcttttattctgcttctacttgctgtgacttttcatgtttttaagtagggtattgcattgattgtcaactgggccaaattttgcccctgcctgaagatattatttagtttttaggacttgaagagtgctactggtttgacatctgctaggtaaagttcaggagtgttggtaaacatcctacagttcagaggacaactccctataagaaagaattatctgactcaaaatgtcagtaatgctaaggttgagatatatcttagattattgtgcatttattttaatccatactccatatggaaagaaggatggaatcaatagaaattgaatttttcctaattatgaacatagtgatagcaggatctgttgatggagggattcaaatacagcgcagtgattaagatgctggatttgttatcagggttgagttctggtttccactctagccacttgttagccatgtggtcttggtaaaatgattagtctctctgagacagaatgtcatttataaaatgtggataataaattctaccttacaggtttgcttggatgaataaaattgcttgcagcctggaaagtattacatgttcaataaattgtagctactgttctatttagaatataaactgatattggtagcatagtatttatatggttatacagagagtgagatggtagaaatattaacagaaatgaatttcttgaatataaatatttctttacagtttaatgaagagctgtagtatttacacatagtattatatatgtatactatgtatacacatagtatatatatacatagtataatatgtatactatgtgtacacatagtataatatgtatactatgtgtacacatagtatatatatacatagtattatatatgtatactatgtatacacatagtatatatatagtattatatatgtatactatatatacacatagtattatatatgtatactacatataactagaatagaatcattatatatatatatatatctctagcaaagcacagtaacataggtatataactagaaaataatatttgacaatttggggagacctatagagatgcaaccttcaagacagtaaactaacgttaaaaatgccaaattattaacagaggttatcaatgaggttcgttaaaaagaaaaaatattttcccttttaaaattttttattcttttattattttattttagcgacaggatattgctgtgtcactgtcactcaggctgaagtgcagtggcatgatcatagctcactgtaaccttgaacacttacgctcaagtgaccctctggccttggcatcccaaaacactgggattacaaacatgagccactgcacttggcctattcttccatattgtcatattgcttaattttgttttcaaaaaacatacattccttttgtaatttagaaaacaagtattataaatgaaaaaaaccctcatagctccccaatataaatggtgaaaaatataatcgttaaaacattcctcttctaatttataaggttacccctttttgctggtttatctctattagttggttttcctcttcagtcacctttctaaaagtggataagctgtaggacccattaacattttactggcatgataaagctggtcatgttgatgcctttatcgcctaagctggcatgtagtgctattgtgaagccagtacagtttcgtctgggtggtgagtagaggaaaagtgcagaagaatttagaacttgaatgtctaaagccagaactctatccttgaccaagtcttccctaataatttattaaaaacttcaatagaaatatagaaagcatattatttaaacttccagttgacaaaaactggaagacatacatactagcttagatgattgagtatcagtttcaaaatatgcatagagttgaataacgagtaaacattaaattttaaaaatatttaatttaaaaatatttaaaaggagaaaaggtaaatttctataaatttagatttaggaataattttataatttcatgatgagagaagctggaccattatctaatgcccgttacctaagggttagtttgccacagttcattgaactgtctcttagactagattttgaaagcaaacttttcagaatcctttgctatgtttgtagcattgtgaccagttctgcttgctgtattttaagaggagtattgatcactatgaagtggtcagaaagcctggaattagtcaaatccctgctctgccatgtattaactctgtggctttaggtaaattgtaatgcttaatctctcaaagcttaggttttcttatatagaaaattttttttaagctaccccagaaaaatgttttggggattgactgagattataaagatgctaataataataacttaataaaccttgtatgttgcttactctaagccaagctaaattctaaaaatgtatgtttgtaagtacatttaattctcattagtactctgaggttgatactgttgttctcattttacagctgaagacacaggcacagtgagcctgtctctatatatgtctctctatatgtctttatatatgtctctatatattctagtaaatcatagttaaaaatttttgtgcatatgagtgctagacatggtatcatgtgtttatatacctttgttaatttttgccagaagaaggaagttgggcttatctcaataaacgttttgagcccttttggtacctataaagatacatataaagaattatacttatggtatatctcaaaactgagtttgtttcctataacccatactaaaaacaatttatcaagttaatatagtaatatattgtgtaagtatacatgtataatatagtaagatgtatatgataatatatgttcaagttaatatagcataattagcaaaatcataattgggttcaaataatattattgactgatactttaaaatatttcccaactattatgctgttccatttacttttaaaaaaaatagagatattcttttcaatttagagtgtaaaataattgcctcctccgtatatattttaaagatggcctataaactagattcattaattcaaaattactaaaataggcaactcagtaacaaagagaatcagctcattttcttagatgctaacaaaactaattatacaaattctgacaaagtggacattgcaaatgaatgaaaataaaaggattgttcacgatcttattgattaaataaggagaggctttgactgagtagatgatttattgaatacttaattgaacattaattgattatttaaatcattttaaagaatcagtagtattcatccctccatgagaatgacaggttttttttttttgttttttttttcgggagtactggcaatcaccatctgattcagtctaacgttttttggctggggcaggaactctgaactttatttccaaatgagtaataatgataaacaatcctagaggaaagtgggaaaatgcctgatggcttattggcgggaaaaagaagggtgtgtgagaggaggaattattcagttatcactggtctggagaagaaagagcatggcccatttgcaaaaatgattcttagttcacttttttttttttttttgcctttagtgatattatgggtaatagcgataaatttttattttctcaatttatatatatcagatttctcactctgtgtcatcaattaattcattcaaatccatttccaaaactttaatctcgttaaccttgccaatactgttttgaaaatctgtcttgagtttctgagttataaacagcctcatattttcataaatatgaaagaaagccatcaaaaaaactgcacttatttttttagccttggtttctctgtattctgtaaaatgatatagcctaataagagagctttactctagtggccttcattatagcccatgtgcaggatgattctgaaatatataaattaaatgaatggaaacagacatgttgacaagtttgtttagcaccaacgattggatatgctattcttaaaccaaaacttttgtttactcattcattcctagaatttcagtattttaagaagtctcagtgctacaggatttcctgtatttttttaaaatgtggtaacatatacataaaatttaccatgttaaccatttttaaatatacagttcagtgacattaagtacatttacattgttgggcaactgaaaccacagtccacttccggaactttttcatcttcccaaactgatactctatgcacatttaaacaacaacttcccattccctcttcctcccagcccctggtaactaccattccactttctgtctccatgaatttaactattcttgatatcttatatgagtggattcatgatgtttgtccttttatgactggcttagtttacttggcataatgtcttcagagttcatccatgtcgtagcacatgtcagaatttccttcctttttaaggctgaataatattccattatatacgtatgccatattttgtttatccatttattattgatggatacttgggttgctttcactttttgtttattgtacatatgttgctatgaatatgtgtgtatgaataggaagatttttatattgtttaaaagtggcaataatgtgaactttttgtataacatcaccaagttgacaaaggagctgcagcaaatgtgggtggttttactgcattttaaaaactagaacaccttcttaaactgatcctaatcaatcagctcctcatggaaagattagagcttacaggaagagaatgaaaggcatacatgaaacacatttagcacattaagacttaaattttcatttaaaactgaaattttattgcttggcttgtctttacatacaggattcagactattaaaaagctgatagaaaaagcttaaaatactattattttagtaatcctagagaagcaaagaagcctcttaacaaataacaaaaatgtgggcataaataacacatttatttcaagataacttaatgcttttttattaggctctttttggaactaatgaaactattatccaaggaggagataaattaaatttccacctacaagatcagtatagcaatattctgaattcaaaattctgttgttaaggatggtgtaaccatatatgacaaggcttttacaaactcctttttgaacattgctttaagcaatcatttgtgtatttgtattaattttcaatctaatcattccaaatgaggcaaagttttgtgtaccagtgattgaattagaagaaagaacaagttattttgtatagtctaaaagctttgtaagaatcctctgcttgcagtgtttgcacagttctccattagccctgtcgtgttttcttcttctttgagacatccattagtagatactttaacactaatccgttttctgtcccaaatacataggagtccaggagccagggatgcaggtgtcattttaccttctagtagtctatttttgtgttctggtgcatgtccgactgagctctatttttaaaagtacggagctgcttgctacctgaagccagagagatactgaagaatgaaagacctcgagagtcctgctgtctaaaggagtagcacagccagacactgatgagggtggaggtagtagctgagtcttttgttataaaagctcatgttgactcgttaacattggtttttttttttttttgttttttgtttttttttttgagatggagtctcgatctgtcgcccaggctggagtgcagtggcgctatcacggctcactgcaagctccacctccctggttcacaccattctcctgcctcagcctcccaggtagctgggactacaggcgcccgccactgcgcccgtgaccgcacccggctaagtttttgtatttttagtggagacgaggtttcactgtgttagccaagatggtctcgatctcctgacctcgtgatccgcccgcctcggcctcccaaattgctgggattataggcgtgagccactgcgcccggtcaacattgttaatattttaatacacatttttgtttattttgtttgttcttttctctattgctaattttcgcccagtatgctaagcattttagagagatcatgaatcctcattttgcttccctttgtttgctcttttcccttttgctaattttctcctagtatgctaagcattttagagatatcacagattctcttaagattagaggtatgtattattatttatttttaaggcaaaagggattaagtaatttacccaaagtctcactgtttatcagatgcagaggctgggtttgggtccgggtctgtcttgtgctgatggcttcctgtttctgttacactagatggccaaaacatcactggaacttacaggatataactttcttcaaagtggtaatcattatacccagtccttctttccgttttctactctcactgtcctagtttatggccgtatcactttgtagttggatgggctgttgcagtaacttctcaactggtctccctaccctcatgccatctgaatattaatttattcattgaactaccacactacatcttcttgatgtacagctctaatcaggcagcagttttgttgaatgttaatatttaatcatgtaaatcctttgataaaaagtagtttgtagttgttttttgcctttcaaatgaaataaatacctccttgtttgggattcaggaccctctctaatctacccttcttaacattcagtcattttaaactgctactgccttcatcacatcaattttctagtgactttgaagcgtgccttttctctctcaagacagagataggtagatctcttgaggtcctacttctgtctaccacattattgccctctgcccctaattctcatctctctatcctgatctccaaccagcttaggttgaaattttacccatcttctacctgcttcacgatgtgttttctgatcatccccgttggaagctctttctccttcctctgagtctccatagcgctgtatctattgctgtcttacggcacttacattctccgtcttggattgtgaatagttttataagtgagggtgagttccttgaggatgatcaatgtataattgagcccacctctcctgcgccccacattatttattgcagtgccatgtagatgcttaacaaatgtttttgaggcaatgagatatcatcataatttgaatgcaggtagtgcttggaaatttagataatatcttaagtatatgttatctcattaaatctgataacaatagtgtggaatttggtgattatccccagttgatgaatggtacttaggaattcacagacataggttcagtatgtatctgtggagctttgtggatagttgtgctgctggggaagttgttaggtagaagtccaagttaaacagtagggagctaacaagacctcctgggaaattggatcctggatttcttttttttaattctttttttgagagagagtctcactctgctgtgcagtggcacgaccttggctcactgcagcctccgcctcccgggtcaagcaattctcctggctcagcctcccaagtaggtgggattacaggtgtgtgccaccacgccctgctaatttttgtatttttagtacagatgtggttttgctatgttggccagactggtctcgaactcctggcctcaggtgatccacctgccttggcctcccaaaatgctgagattatagttgtgagccaccacgcctggcctggatcctggatttctgaaccaaggttgtgatttggactcaccctcaggaaatcaaatataaaatcatttactaagtcccacaccatcagtttttcatcttacggtgggccctagatgttggaatttttgtttttaagtgtaacaactttgaaaaatattatattgaatgtatagaagacaactatgaatataaatttattggtattataaacactaaaaaattttgagcaaataatttacagacttctttttgtaaaatataaattcagtgttttctttatatctgcagtattgtgaaaaataaatttttttctaatgcctggctgaaaaataggtctgtatcctagttgtacaagaataacccttcagaggcacaggattatgttgctataatcctaagtgagctgtaagagttaaatgcattataatgggtctgcttgggtaccagtaaagattatatttaaaactcaaaataggaaacagaaaagtcttgtgtatgaatgagaaacatttgatgaaaggaagttacataagaatagagaaataatatataactcctactcattatgtaataatgtctcatttttctttctccttaaggaatgccatcacatgaatttttattgttgctgttacattggtaaccaaatttcattttcttactgtgtgggtgattttaattgaattttttcttgcttgctcaaggtctatctttatcaacttgaattattgcaaaatgcaacagttctataacatcttcagagacaattaaaatgtttggagatattttcctgatgctgaatggctcaacttttcatgctttatactagtatgtgtgcctctttaaatgttaattctctcccttacagttagctgtccggtgtggtgtggttagcaggtatctttgtttctgttttgaagaagaattgcgactttgcagggagagcacttaaccatgcttgtcaggttaatagtcttatttattcacagttgtagtcagtgggcactagatggaggcctgagggtgacagtatatttttcctgtgtaggacagctcttaggatttgtgagcaccattccatttaccatctagcagccttttctccattacaataaaatttacaattgtattatgaatgaagagcttgttggaattgcttcttaaagagaatgaagtcatttaacatcagaatgtgcaaaatgacaattccgtgatgaaaaaggagaatttagaagtatgacaacctacattttgtcttttttataaggcctccccaaaatttttatttcagggctatttcaaatctgagcttcaaataaaaacaaacaaaatgttaggactatcaattctaataaatttttatttaggtttttctggcacagttagaaatttagttatatataatacatatgtagatacatatatatatgtatcttgagagacgttagattagacatggtaggcactcaatttctgaaaattttcaaactctataatttagttactctttagatttctacttcaacttcctaatgaattattttctttcaaaggctcttcctggaatttttctgtttttggcaggtatgtttgcatatctcaagtgacacaatttggccaggtttctgaaaaagaatactttaaaagaaaaatgtaggttggctcttaagtgttttaatgttatttgagataaactaaaatagagcataatcatatggtatattaataggaatatgtgctgatttcttaagccccattcaaattttacgatagtttttgtttcttttaataaatttgtttggtttataactttatctcaggggggatatattattattttttcctcatttcttgagtgaaattttagcagaagtgacttaattataatcttggagatgcatgttgcttacaactaattgggtcctggacttaataaaatcacttatgtagaaagccatatactgtaggttaaaaaagaaaagggacaactttggtaattttcaagttaaaaatagaatataagtttcatgaggtcaggaaccacatctcttaattttttctttattctgagttcaacctaattattatatgcatgacagatactctttaaacttttttattgatttattggttacaaaataaatatattgaatggtactggcaattctagctttgtttcccacagatctggctttatctaagaatatttctctaatggaaatagcagttcctaaaagtttaattaactctttgacctcagaccaccttatttatatatgtctaaattatttcctttccaggcatgattcatattccttgagctattggccacgtgccagggaccattgccattccacacatgtgtaggttacagagttttttttttttttttttttttgagcaggaactagcatgtaaatcctttcttcaaaatatgtatttatctactggctgatacctgacaaaggagtgataatggttccctactgcttgccgactcaaggacagagttttctgctacctttatttcttcccccaaaatttattttgacagactgctttattgagagagagaatgaatataggatcagtgtttctgtacaaacatttgaatttggtgtgaaggagggataagcgtcagaggaaatggaaaaggggaaatagaaaagaggaagtatggtccatgctgcccaaaccgctgcttcttattaatccttctctgtcccctcagcagtttttctctatctttgctgtgtggattttgtccattctattatgggtgtctacctccagggataacccaggcctcttatggtttctttgtgcacacgctctccttactccagtcgctacctcctgttttctttgagcctgccagattccttcccaccttcatcctcttccagtccttgggatgacctaaattctcttctgtgcttactagaatcctgttcatctttcattccccatttccaggcccctctctttcacaaagctttctgaatctatacagcttcattctcattcacctgagctgctcacacctggcacctcacagtttagcatttccttactctgttgtgtggtcttcatttcctgacctcatcatagacatcccattgttttcttttttgtttggctttattgagatataattgaaaataaaatcgtatatattcacagaatacaatgtgatgatttgatatacatatacattgtgaaataatgaccacaatcaaactaacacatcgatcatagttacctgtgtgtggtggagttagggggtggtggcgaccatacttaaagtctgctctcttagcaaactttgagtaaatgatacagtatttttaactatattgtaaattagatccccagaacatgtgaacttactcatcttgtaactgaaagtttctacctttggaccaacatctccctattccctccaccttccagcgcttgacaatcaccattctaccctctgtttttatgagttcaactttcttagattccacatgtaagtgagatcatgtggtatggcttatttcacttagcatgatatcctacaggttcacccatgttgtgcaaatagtaggattttctcctttttatggctgaatagtatttcattgtgtatgcacacacatacatatacacacatcacatgttctttatccatttatatattgttgaacacttaggttgtttcaatgtcttggctttgtaaatagtgctgcaataaacatgggagggcagatatctctgtgacatgctgtttttatttcctttgcatgtatacccataaatgagattgctggatcttagggcagttctgtttttaagtttttgaggaatctcagtgttgtttttcgtaatcagtttactaaattacattcccactaacagcatgtaagggttcccgtttttccacacccttgccaacacttgttatctttttggtagtatccatcctaataggtgtgagggaatatctcattatgatttttatttgcattccccggatgattactgaagttgagcaccttttcatgtacttgttggccatttgtatgtcttctttaaaaatagttctttgcccattaaatcaagttacttattttttgctgttgtataagttcccgatatattttggatattaatctcttattgggtgtatgatgtgcagttattttctcctattctgtaggttgcattttcatttcattgatcacttcctttgttgtggagaagccttttagtttgatggagtcctactggtttacttttgcttttgttgcctatgctttcggtgtcatacccataaaatcattgccaatacgaacgtctttttctgtgttttattagaggagtcttatggcttcaggtcttacatttaagtctttagttcattttgagctaattttgtgtatggttaagataacagtcaatattatttttgtgtgtatggatatacagttttccaagcaccatttattaaagacatattctttccccattgtttattctgtgcccttgttaaggattaggtgaccgcatgtgcataggtttatttctgggctctctgttctgttctattggtctatgtgatagacatcctgtcttatgctgcttttctgccttattggaggcaaaagtcactggtatactatacagtttgggatcagcatagatgttgattacaggctctgtgatctagagaaagttacttagcatctctgtgccttttctttctctatttaatagggacaatatttcctatctccaaatgttattacttaatcttgagataatttgcttacagcatctgtcaaagtgccaaacatatagcaggtacacaatataattttgttttcctcataaatacatggttaggttcagcatggttattcatgaaaaacttcttttaaaaaattgagcaactgaataaattctaattgaatggctgaattatttgaaaggcaaaaaaggcaggcaataaagttagtctgaagtatcttcatgtaggtattcttggtgtagaagtgtagtaactctaaatctagcaaaacaagctttattcccatatactgtagctgattaccaagttcccagagggaggttggtggtgctttggggtccagtttattagattggattagatggggtagatgcaagaagatataccagcattcccaattccttccaatacaaagattttgtggcttattaaatttttaagtgattatggagtacttaattttagctttttataaacttataaatttttttaaaaactatttccagttggctttcatatgtttttcatagtatagatatagcatattacatatctatattgactacatgaagaaaagcaactagtgtgtaaaaattaatttttttgtttttgttgaatgtcattgtttcagacttctcttgtactgaagtgtagtaaaatgtattttctatttttatttatttatttattttgagactaaatgttgctctgtcccccaggctgtagtgcagtgacttgatcttggctcactgcaacctccgtctgcctcctgggttgaagcaattctgcctctgcatcctaagtagctgggactacaggtgcgcgccaccacgcccagctaatttttgtatttttagtagagatggggtttcaccttattggtcaggctggtctcgaactcctgaccttgtgatccacccgcttcagcccccgaaagtgttgggattacaggcgtgagccaccatgcctggccaatgtgttttctttcaaataaaactttattagaaaaatcatgtattataactaatattttagaaatctataagagtatggctgaagttaaaaatttaaacaagtgttattagtcttcctacataaaatattggtatggaatctgcataccttaaataaaagcttgtagttacaaaactttatattcttagtaatattgtatactctagtttaatttacatggctgtttggctctgttaatgatagaaaacccttcattattaaggacagcacttcacagaaaattgactgaagctaactttaacttgcagatggcgttcattaaagagtttcttttcataagggtcatttttcatttttatttcaaagattaaatggatttatacataattatttcaacatgacatctgttctcattttttcctttcagagctttcttcccaaatattccatgtttgtattttgtaaaccatacaaacaagttttaaaggaaaatatataatcctgagtgattacataatttattgccgttctctatcttatgcttttaattttatttaatgcatgtcttaagtttttcaacagacttttctaaatgccatgataatattaagctctgtgacaacattaattatgtgtacatatattatttcgattgcacagtttttgagtgcaatgatggatccattgagaatgaggattctggaaagctctaaaagagtggcttgtgtatttttccttcttcctttttacccgctttcctctctccctccctttcttctggaaatgggaatttttttaatgaaatttcatgcaaattcaatgaatgaatggtaaaacaaatctgatccaaactattgacagaagtggaggcaggcacagaactccagcctcttcatcatctcctcgtttcctcctgaattccttttcatgtagtttcttggacagatgcatctggaatctgaaagtaatatttaatagagtattcacattcttaatagttgttatatttgtaagtcagcgacacaggttgaagccacaagcaatatttagtcttgaataggttttactttttaaaattctatttgagcttttttcttttttattaattgtggtcatttctacaactctttctagaaaactgtatttctcagatttgaatatatttgttattattagctctcttatttaaagatgaactaagtttcttaaggacaaaaaagaaaataatttttacctacaatttgatactatgtagagagaacattttctttcagaaatgatcaaaattgtgaaatctttgatagatggaagaaagtagttgtctttgcttgtaatgaatactttcaaaataaagtcgctgaataaaaatagtgatcttacgaaatattatagttggatatcatcagagaggtgatattataaatcttctaccccagataatgattttttaatagtctttctgttacaaatgtttagtcactactgaaatacattatatgaaagagagctcaccacaaatcaaaccaatacaaaggagtattacaaggaaaaaggctttgaatccaagtgcacattggagcaagctgctattcttttacagattaactatttgttattgcgcattcagcaaattccttagcttttggtcttctgtctactaaaggaaaatttaaattccagctctgcaagtttgttgagtaataatataaatggattatctcatagacaaatgttttaaaataaaatattgctataggatacttgctatattgaaccaaaaactgccttgtaactttgactcctttgtcctagtgtttattttctatcctacatgtctgttaggattcccaagtcttgctgtccccaggctaaagctattcattgaattcaactgtccattgtctgacctcattttcatattccttaaacattgctcttccctgggatgcactagttaaatcttattgtggtattgggctatccttttttgtagccatcctcagggaagccacacttgtttggcatgaccctgttgtcttggctgcactcaattgtacgtccccaagctgagcagtgagattctgattcaggcattcagtattgggaccaagggagagttaagttagtcttttccaacatgcaaaagctgtagggcttgaagcagagaaagtcaattcacagagaaaatgaaacataatttctgttctttctgctagtgtggggagaggaagagggatctcagttacttcaggactttcatgattcttactctacttcttcctgaagctacaccgtgatcctgccctttgttctagaaataaccacctccgtcagctacctagagttagtttctgatactgcagttactatttttcatcaaaagatgatgtttgttttgttgttgttgttgttttgggtgagaaccattaagatgtgtcctgtgatatcatttttacttgtcaattatgtctccataatttttaaaagacgctgttcattataagaccttcccaattcagaggtatcaaaatgtgaaaaaaatactttaatatagcaatctattttgaaaacatctctgttaaaatctagggctcagaattgaacatgaaaactggctcccctcttcccctgaaatggtggcactaaaataaaagccaacatatttcctgttctgtccacagagcccttatctcttgtctccagaaacctatgaaacatttccatttagatgtccccatcaaacgtatttcacaattcatgctcttctgccttgtcaggctggatctccttactttgttttcatagcagcaccatttaccccatcttctaaactagtgaccaaagagagtaatttgggatttttttcttctttcaaattttggcatttatttttaaattaatattttaaatcatggtataatacacataacaaagtttaccatcttggtcatttttaagtgcacattttaatggtaataagttaattcacattgttgtgcaaccatcatcaatatccatcttcagaactctttccattttacaaaactgaaacactgtacccactaagaaattactccccatttcttcctttaccaagcctctggtagccaccattccactttctgtccctaagaatttgactactttaggtaccttttagaagtaaaataggacagtatgtgtctttttttgtgactagcttattttacttggcataatgtattcaaggtttatgtgtattgtagcatgtgtcagagttttgacatttcttgtgttgacattattctgctacttactcttttttttttcctatctttatgctgtcgctgacaactagaaggcctaaggttttattactttgcacctgcgctactgaaataatgtcctaacaggtctctggagattccctccctgcttactgtcataatctgtaatgcgtgaatagtctttatatacatggctttcttctggttgttgacaataggactatcatgaatggacctccatgggtggttagtgcaatgtagaggtccgagataaccccattcttgctaaaaacattacacattttcatctaatgtccccgacgtagtctatcccttcaatgtaatttccgagacctttacaatataggtagaccctttaaaaaattaccgtgtgcttaaatttatattccaccattgttagccaaggaccttcatttcaattttatagtcatttaattttctcagtgtttatatctgtgtcttcttctttttgcctttaattcccctcagccaaaaatttcagcatacttatgatctatccaaatatgtgttctgtgtatagcttatctttttcattaaaacttcactattgtttcagccctgtatagttcacttagttacacgtgtaattttaaacactgttgttgactgtgttgtactggttagaagccatattaactagatttcagtttcttgaaaatttatacattagcaagcatagtgtaaatatgtattaagtgggcaataaatatttgctgtgttagtggcattttaatagtacatgatggaataaatgatagatgtgttgtaaaagcttttattgcatgattgccagtttctacctcattgttgtttctaaatctcccacttttaatttacctgaaagtgctttaatgtgtgaaaatatttaagaaattattagtgttccttttttctcctgagaatcacacggacaactttttttgatttaatctatattttgtctagcattatcccaacattagaagtagttaatgtatccataggcaattgttagatacatatgtaagaaagtgaaaaaccgacagacagacaaaacccacctaagtcaataatattggcaataggatttagaatgctgttatggcacatgagatgctccacatcctacctacatggaatatggggtatgtgtaaagaatattgtttagccctattttttcgtttgtttcttttgaactactccgttttccttaactctccttatctttttctgaatgaccttaaactcaaggtagtcgttgagtgggagggatgatttttagccatctttttcctccaactcaggtagataggatttaccagcttggccttaatttcctcctttctgttaacattgaaaaccatcatactaactgtaaaaatcaaatactgtaataagagtgagggagtgcatgttttaaagtctgtcgctatattagctcataccacatatgtggcaagaagcagatactgtacaaatcagttcaataatgaggcattgaaacacaagttacatactgtgctaggaataaaatgataaacagagtaacactattctgtccttttggatttttatagtttagtaggaatgtattaagtaatgacaagtacatgaatatgattaaagggatgtaaaatactgaatagcaaagggattttactttgtctatgggaccagtgaaaacctttgagaaagtgttctttaaacaaagacttgaaagttgagcaggaggtagccaggcataaaggaacccagagagttttccaagtggagttttccaaaaagcatgtgtgaagacttgcaagcttgtgcaacccaccattttttttgttgttgctgttctgttttgttttgctttaggattttagcagcctgaagccatggatctttgtttctgtctctagttttaagtggaaaagtgggctgaggaaggggcttcactggcccagcaagaaacagaaatttggaacccatgactgtatttctcctgtggacaccccctgcctaggacaagagagagctgtgctgtagaatgctggggaaatggaaaggcagcattggtggaacagagagcatggagaaatcgtcagtgctgggaaattgtgggagctgagcaacaagtgtgagatgagacaggtgggggccaaatgatgcagggcctagctctacttgtcaaggattttgaaatgaaccttaaaggaagctatttaaaggcttagtcaagggcctattatggtgtgatttgtgttttaaagtagccattcacctgcattatggagaatgaaatgaaaggaagccaggagtaaatgtgggaaaaccagcagccaggacagtggaggagagcatctttgaccagtgtgatggtacgggagagtgaaaatagatggactttagagacgtttagtaatagttttaaactcatgtgctgtaaattcgatttgattttaagaggtgacaggaaggcaggaggcaacaatagctttcaggtttataccttgagtagttctgtgaaaggtgatgatagataacagaatgtgattcctgagatgagaaaaactggccaaagaacagattctggagagacggcaaagaggaattctgtgatattatacattattgtatgttaatatatagtgtaatatttatgtatacgtatatttgattatatgcctataggatactgattttggaatcatccctccacaaatggccaataaggccacggaattagacaaaatatattgggagcttgtagaaaaagaagcactcttgagaatacaagtacttaacaagagagtagaagtgaatttagggcagacaaccatagatttcaaatcatatagcaggaaaaagtcttgtacatcatccaatctgatataatcaaaatgaagatgaatgaaatgaaattctgtcagactgtataaatttctctaagtcatgcatagaaagtctcctaagtctatgtttcttgtgtaggttttgaaaaatacaattcagcttcctattgatattttgtctgaattgaattatatattgcgaaggtgtcaaaaatgttttcctatgtttaaatttaacaccctttggtggcagcaaattttcacatctctcttgagtattcaaatttgttaaaatatgaaacacagtgcttggccaaaaacagataatatttgctgaatgaatcaaacgggtttctgagacgatcaattctttaaagatagagactcagttatttgtctttttcttctgagccaagtacaaatacttacataacaattatattgaattattgttatttttttcttgtagctattttttctcatggtgtaaactgagggcaataattggcatttttcagagcaaaagtttgatgtttaaaaatctaataaatataaaccactattagacctaaaagtatgtcaaacataatacaactctgattataaagtactcattacttttttgatcataaagattaaactttacaggattgctgataaacttaatagcacattttttttttgctttccaaaaaagcttttatttaaagactttcttttttaaccacagaatgtcaagatagttatgttctatttattgctgatttctccctttctatttttttcctttctttttgtatcatgcccatagcagctgtttccctaacccttaccccaacccacaggctttcccacgctccttttttggctctcatttggcatcgatcctgagtttgacagataaaacatgtgtctgaattgtagttacagccaaactacaatctatcagcttttccctcagggtaattatgcttattttatcccaaaacaaggtaattgttttgtgataaagtattcagttcactcggaataagccgttggcctccttttatctacttatttatttatttatttatttatttatattttttattttttttgagacggagtctcactcagcttcccagaccggagtgcagtggcatcgatttcagcttactgcaaccaccagctcactgcaaccaccgtctcctgggttcaagcgattctcccatctcagcctcccaagtagctgggcttataggcacccgccatcatgcccagctaatttttgtattttagtagagacggggtttcaccatgttggccaggctggtcttgaactcctgacctcaggtgatctgcccgcctcggcctcccagagtgctaggattacaggcgtgagccaccatgcccggctggcctccttttatttaattcctcatccaatgataacatgctgacagatgactcaggttctttggagtcagtgtgaatgaagctcatgggatattagaattggagacagaaacagagaggcagtacaggcttcagtgttagacagaaatgggattcagtccaaacttggacacatactaggttgtgactctggatgtgatattcaatttctatgtgtttccatttcctcatgtgtaaaatgagataactacaagccttttgaaactttgatcctgaagacgtcgttttggtagatctaaaatgaatacatggtggatcccatcactgttttatttagaaatacaaaatcaaggttattaattctaagatatgcatccatagctctgcagtatccaaagcacagcattaactttagttgcatgaaaatttcccaagttggtatatggatgtatatgaaattggagtggtcatggaaagcatatgtgactttaaaaaatgaaaattctcactcgaggttatcaacacccttggacttaaagatctgattgtgaattgtctaaattatgtgaaacagacaaactaccgttaggttgttttcctatgcggaatatttgacaactaaacttaaattcacaaatttaagacatgaatggatataacccacctttgtatgtgaatgcatgtgtgtgtatgtgtgtgtgtcactaaatggtcacaatttaaaacaagaccagaattaagcattcaaaaaacatttattaagcagccactatgtgccaggaatagtagaataaataaaatcttctaaagtttgcagttactttaaagtactccaaatttaggcatacttcacacgtgctatataaaacataaaacaacttaattcttcattagtgtgtatttcagttgcatctttaggctttttctgaatgccttcattacttcttaaagccctcaagaaattatgaaaactcagaaggcaacctatctgatttcttaaatttaaatttcctggttaatttatttagattatttgaaaattcttctttgcccaggtacctcacacatacatggactatactacttggtcacttttaatttagaaggaacttcctttaggaacagatactttgtatagctgtaaattatttaaattcacatgaaatcactctttatattcaaagtacataaggtgagatgtagtttctttttcttataaatttatcctattaagggaataaattggctattttatttaaaacagaaatagaaattttatgaatgatggttgggaactttaaccaaaatgtacataatgtgcataaatgatgggaaactttgtttctgcaactagaattcatgctataatgtggacattgttagtctataagttaatacgtgtaatttaaccttatccctgtacttgatagatcattagttagcagagttatttatgtgacattatgtggcatgccttaatttttagaaccagtttactttttcaaaaaatacattgcagtacacaaaagtcctgtagaaaaaggtcatttgaagtcttatattagaatgatataatttccttttttgttttactttgagttttaaaaattgatttatttggaaacagattagcaagtccccaattatatctttagatactggtatattaaagaatattttacaaaatcacagtatcaaccatagcctcgagaggtaaaacttatcctatttttaatttccagtggtagcactttgtaaataaaaattatggtgtatgtgccaaaagcctggacttttgtctggcaaaggttgtttaaaacttgaagagacatcaagaaatatgtgagttcatccacccagatctagccagaactgcttttgaatggttctgtggctcatttaggcaattaaagccttgtgattgccctattaaaagtctgaaagtatgcatataacccaccagtgttttacagaggaataataggtaagatttataaaacatctgaaatgaaaaaaatgtaggataataaaagcaggtatttgttgagtacttactgagtgttcgaggcagcgtacttagataatctctgagttttgttatacgtattaaatgagttaatataaagcacatatgtgcctggcacataaatgttatgtatttacagtaacaacaataacagttgtcattgatttaattatacattattatcctaaaaataacagaaaatcaatagatgggagagccgggattggaattgcaggctgtctgtctctgaagtccattctccatatcactgagctattctagttttcctaggtagagaatctaggatggccaaaaaatgtccccagagcctccctgtaagctgtcctccacaacagacttctggaatagaaagaagttggcttatgacctcttgtcactgcctagtccttgggtgtgataaagttatttaaactgtttgaactcctccttctgtaagcaggggatatcagtaatatcaatcctaaatgtgtcgggaggattaaatgagataatgcatgcatattgctgctgaacacaaagtctgtcacataataggtactcaataaaggaaggctgtccttgttgctttgaggaatgcagatgactgattccattggttctgagtgctcagtttgtggcctgactgaattatgtgcaccagatttggtggtaggtttttgtgaattgacctcaccccggttgcatcttagcttttctccaccttttaggggatatactttcctcagccgtttcatttaaattgtatttaatgtggttatatttttaaaaggtggtttttaaaggctttcttttttaaccacagaatgtcaagatagttatgttctgtttattgccgatttctctctttctgtttttttcctttctttttgtatcatgcccgtggcaactgtttccctaacccttgattagcttactttctgaaataagagcgtaaaataataaaaataatggttactatattgtgttagttttcccacaacactttttttaatgcttttacattttacataannnnnnnnnnnnnnnnnnnnacagtatgttataacccattttatacattaaaagtctgtagaaattacttctatgcttcttaatattccgtatatgactgtgtcatattttatgtaagtaattctctcttgttaggcttgttgattatctcctggttttgtcagtataaataatactgaagtgcatattttagtaaattcttggttgcacttctgattactgttttcagatatatgtctgtatatggggttatagattaaagaaactaagccctctatgctttaaaataatggttttcaacctcataattaaaattggatgaaatttcttttaaaaatcttagagcagtgatttttaaagtgccctgtgacatctcctttggggttgctattgagaggggagagttacacactgaaggtggcttttcttaaatgccgtttcttttttattttattttttttgcttataccaggtgaaacttattttcttttgaggcaagatcttgctctgtcattgagggtggagtgcagtggtacgatcatagctccctgcaggcttgaactcctaggttcaagtgattcacctgccttagcctccctagtagctgggactacaggtgtgcaccaccatgtcccactgtttttgttttttgtttttttcaattttcttttagagacagggtctctaaaagacgctgtgttttttagttccaaggatgcttttcaaaatatcgagtttcacaaaaaataaagtcaagatatgttgcttcatgtggctaatgtttttgttccattttataataaaatgtaaatattaaattctcatataactcattagagaaccacaaataaatgcatttacttaataaataatttattttaaattatatgacaaccctatgattaaatttaatattgtattttttttttttttttttgagacaaagtctcactctgtcacccaggctggagtgcagtggctgtgatctcggctcactgcaacatctgcctccgaggttcaagtgattcttctgcctcagcctcttgagtagctgggattacagatgtgtgccaccatgcctggctaattcttttatgtttagtagatatggggtttcaccatgttggccaggctagtctcgaactcctgacctcaagtgatccacccaccttggtgaggacacagagccaaaccgtatcgaatatcattaaaaagaaactgtggcatgggatagtttaggaattttttaaaaatcaggtgaagaatattttgttgacttgtcatcataatttttatttacaaagatatggaaaaatatttagatcttggtgcaagtatagaaagaacactattctacctatttccaaagggcttggttatcacatggagccagggcttcggagaagagaggatgtctgtattggagagagactatttggcagtattcttggcaacttggtagggactcgcagaaaactgcagtatgactcttacctataaatccgatctccacgctctaaactcagtcaagtctcgagctcatgattgcttacctccgagttttatgttatttttaacacaagaatggtctgagttcatgcggaggttgactgatgtagggtagaggctaccctggaataagctagcatccgagaggaatgaaactccattggtaatgacaagtagcaggactcttggccaagagttaagttggggcaggaagtttgaactgactgctgaattgggggacattcagggcaattgtacacgtattgcaagggacagggaggctccaggtgacagcttggttacatgattttttttcaagagcaatgtacaggaagcacaggccttactttttattgttgtatggagcagagtcccagaaggaccggctgtggagtgctgaataaaatccctgtgaatgcacaccgggttctctgaaaatacaagcttctagtcatttctgggttaaggtgtagtccatttcgctttgctatcagattacacataagttattgagcaataaaaggaagaatgtcttgttctttattcatatgttctaaatctggtaggccatcgaactgtactttaataagaataggggaaggacaggtatacgagtgttggacttgttccatattgtcccatttggcagaacaggaccaaaaagtagtctttttctttttttctgatcattagaggtatttaagagcagaaacaaagtttggtggggataaaatagagaacactgaaatggtaaaaccacaataatattgacaaataggatagttatattagacaaaaccatgttccttgagtctggaaattgttagtgtcaagttacactatgtattaaggcaccgtaacatattgtggcactgacttttaggcacatatatttgtatatctttctaatttttttcaaaagtggatttttctgccatttatatttgccatcgtataaataaaatttttatgttttgatgttcaacagccattttatactaataggagctctaactgtgacaatcaaataaattaatgtttttatacatgtctttatcggacttaaatctgtgttcacaccagataacaactcaagactgtgactatgctattggctatgaggagtgttgctttaattgcagcgaagttaatctgtagaatttaacaattatgttgccatctatcttaagggtttataactctggtatagaataagcaaatagcataaaacacttgtacctgtgtgtactcctcagagttttattggtaataaaaaaaaaaaaaaaaaccacccatgctcacttttgtgcttgggaacagaatctgtttctaacctttgctattaacaggaagtgggagaggtgaaatgagccctggttttgtggccgggccagagcactctgtgttcctgagagtggtattcaggtttcatgtctgtctagcttcttgctcctttgaatagctggcctttgaagtgctaaaaacatagattggtaatgagcaatgtaaagtaaagagtgggaaaatatttggaaaattcaagctctgagaatagcctgtctgggatgatttggctcaggctgtgttgtaactgtgtttttctttcccaggtaaattgtgaagttttatgaatataatagtataaatttcctctataagaataattgaaaaatctcaacttcacttgcgtttttggtagaacgattgctatatttagtttaaaattttagggcggcaggccgggcgcaatggctcacgcctgtaatcctagcactttgggaggccgaggtgggcggatcactaggtcaggagatcgagaccatcctggctaacatggtgaaactccatctctactaaaaatacaaaaaattagccgggcatggtggcgggcacctgtagtcccagctactcgggaggctgaggggagaatggcgtgaacccgggaagtggagcttgcagtgagccaagatcgcaccactgcactccagcctgggcaacagagcgagactctgtctcaaaaaaaaaaaaatttagggtggcactaactgtcgagtcttttaaaaagataatctatgccttgaagtgccatttttatttttgtaattacaaatgggtatcagaagaatggaatctaatatgaagttgaggtcatatattaaatctaacacctttgaataaaagtagaccttttgttccattgcatgttattattgaggggcccccattataatacaacagtggcctgttttagaaaatattctctatcagaaaaacaccataatttaaaaagacatatttccaccaaagtcacattctaaaatgtatacagaaggacatggaataaccgcatatagacttagtgtatcatgtccccattcttccaagaaaataggcaaattttgttaaacagccccaaaggtaaatatgaatatttttatatttttagaaaggtttgaattttaaaagacaatcttagttctagtatgtttatctcttgccttggaggcagttcttaaaactataaaacttgagttgtgactgtcagaatccaacacttatatgtttatttggaggacataattttaaaatactgacatctttatctaatttgttatattatgttacagtaatagtttaatattgtagtgcatgatattagacttgaaatgctagaaatcactggaatgtatagccaatgaagcctgggttgatttttgatatttttggattatatagtaccaaattataatcccatattctatattcagatctctgaaaaaagtggcctttcattgatcaaaatatatttatataaaacattttaatgaagaatacctatttataaaatatccagaggaaatatatgcagatgtaaaattgagcccaataaatccttgtgttttcataggtatgaaagttacaataaataatggcaattagatattgtgtgtgtcagaaaatcaatttttctcccaaatcaatccctctctttctttctgtttctgtatctctttcacagacacaatgtaaacacctatgcatatgtgctcatatctgttttagttgacttctttcttgagactttaaattctgaaatgttttacactgcatgtacagctaagattaaagtcttctttttaacagtacactttttataatgccttgaacttgtttctctgtggcagaggaaaacagcctcatgcacctggacaaacaaaggtgttccttcaaaaacagactttcagaatcattaattctggtttagaaataattatgaaggttaagtggactctcatgcgtaagattttagagctggtgagtggctaatctgtgctttacttccccttgttttcatccttcttataccaccggtattaccgtgcctcctcttaacagttttgttccctctgtagcaagtgagccagagacagtgcttcagcttcctatagcctcctggtggtatgcagggacagctggctgagatcatatgcacttctacccaaacatatcccaaggtaaggctacaggtagtaaagctgtgaccagaaggtagatttaaaaaaaaattatttaggtcctggaaatatagaaagagcagatagtgccctatagtaataaccaagtgagcaataactagggtgtgagtggagttattgtgtttagtctaagaatgaagaaatagcagtgttcggtgaagtggaatttggtgaggcatatacaaaccagaggtagaaagtagtggatttttgcagtttcatgcataaccgtaagtgcagtattaaaaaaatacatattgcgaaagtaaaacttttaaaggatacttctcagcttgaaattcttaatacattgtagcaatcatattagttcttgctgtaaaataaggggctataaaataagttagtcaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagtagaacaaccatatcaagacagtggatcatgaagcaatgactataggattccctcctaaatttcgttcattgtaacacccacactgtgttctgtctctgtgcacagcacaacaaactcacttcaaagccaaatgaggacttggcatactcaggaaattctagtaatgagatgctcttagttttactgttacagtatgtagcacttcatcttaggcaaatatgacagtctgtggaatcctgtgtcattcatttgaaagaactgacaaaagaacatgtttttagatcaacttgcatttgcaggaacacacatgggttgccaaaaatatccatttagagtgtttaaaagaggcacacgcctggattggcctcggtgaccaataatgtctggtggtaatgcgtgttttttggagtagtctttaattactaaacaaggtggtgacatacataaagccagtgggttttttttccaccggcagatgggtgctaaagaaactgagcgattttatttttttcatcatataatatttctgatggtcttgcctccttcaagtctcaacatgtgtctctttaaagagaatatttcacctttcaaaatgaagtctcctaatgactcacttaaatgtttattgttttcttgccgtaaggaactttgtgacttgtaaatatgaatttatgtatgcatttttgtatgaataaatacatttataaaattgatatttaaaaagagctagcacttaagttaggccagacgtttttctaagcactttacagatgctaattttctaatcctttcaacagccctgaaaagtgactttcatatttaggattgaatataaactcattctaagattgtctataacctatttctgtgttgcttagcatagttctatttaagagaactaagacaaacatatagaaatatgatgatgacaatgatgatattatattactttcccaagtgtctggcactatgcgtatttcaccaagcatttgtagagaagcggcagaatatgatgattatgagcctcaattctggaatgagactaacctggttttaaatcctggctgtgcttcttacaggttgtgtgatttgtggtaagttacttaaattgtctgtgcttcagtttcttcatttgttaaatgtgtatgacacctatttcatagaattgttatacagattacgttaattactaaaaaattatttcgagctcttagaatagggactggcacatattcaatacaaaataagtaataaaatacagaggtatgtatttgaatattcaagacttcttggaaggaaaatacttaatgctgttgaggaaaattttaagcaattagaatggcaactagaagagattttgtaacaaactatagtggattatctcacatatttatccctcattcaggcaactacacatctgagttctctgcttgttactagagctcatggttgctggctccgaatgagaactgaatatgaaaattttcagtttgtgaaaaacatctggagcttttagttgactacaagcttaatatgagccaactgtatgttgcaactgcttaaaagagaaaaaaagaataaaaaaccctgaagaattccttaggcattataaatagaaataagagtgtccacatcatgggaagtaacatagttgacgtacttcacactggccgcatcacggctggaataccatgttccgtccaagacaccataattttaggaaagacttggacaaactggagtgccagaagtctggaaatatgagaaatggaggaagtgggactgtatagtgtagagaagactaataggaactaaaacacttgtctccaactatttataaggttgtcatttagaaaaatggacacgcttatatattgccctagaaaacaaagagtagaatcaatataatgaaagtaccatgtatatttttactcagtattaagggtgaaaactaatgggtaccagtgctgagtcttgcagcaatcatataagaattcctgtatatggccgaagcttacattcagttacattcactaaaataagatttttgcattcatatcctcattgggcttgggcagtaaaggaattaaatcccccaaaagttcattaaaattttagggctgttctatgattgcatggatggttaaaattagacctgatggcactattggttattctaagaaaggagctaaaagtctatataattggtttactttttattcagtctagttttgaaatcttaagaatggatcaaggaacattggatgaagaagggacacagggtaatgttattttcccaaatttcagaaattcttccaatttaggttcagcaggtaattaagaatgatttcatgcatgtcagcaaaaatagtttgatacaggactcattgaatattgtattgtgttgggaactgatcagagaaaaccatggtgtttgtccgtgaactctcgttgctttttatctaagaggggttgaaatgttgcgtgcttttgaattttatcatggacaatacttgagatttgtaccagtacactaagggttatttttaaggattgagtaaaatggaagtgtattaatgggaaatagaatagaagatagctatagtatgaccttggaaactgactttacgttttacaggcatgtttttctttccatatttcattcttgtatcttgaaataagctgtacttatggttaggtatatgctagatcttagaattcctttaaattcatcttgtcaaaatatcagccattctgtatgaatattaccaagtttaagacattggtttatgttcaatttcagcagtttgtataactgatttgaaaaagcaataaataggcttcataattttatattttttataggaaacaggtaatttaatacatttaatacattaatacatttataatgtatgtattttttcatgaggtagactatgtaaaaagtaaagaagatgatctaaatccagaattaaaaggcacagtcacatttttttttcttttgcagcattggatagtatcagtttgttataatctagaatatataatatattctgtttttacatttcttaactaaatcctctttttaaaatataaataaatatctttaaaataatattttaggccgggcatggtggctcattcctgtaatcccagcactttgggaggctgagacgggcggatcacgaggtcaggaggtcaggagtaatcccacatcgttcaagtcagtaatgaatttatttgaatcaaaagtggatacatttaaggaattgtttctatacatccaattaggtaattctggttggctaaattgagagctggtcataatcccaaaagacacaattctgaatgtcataattctgaatgttaaaatcccagaagagtaaaatctctaaagtctaaaatccagaaaatcacaatccccaaaacatcaaaatcctgaaaatgtaattctgaaaaaaattaaaatattattattagtagtagtagtatttttgagacggagtctcgctctgtcgcccaggctggagtgcagaggtgcgatctccactcactgcaagctccacctcccgggttcaggctatcctcctgcctcagcctcccaagcagctgcgactacaggcgcccgccgccacgcccggctaattttttttgtatttttagtagagacggggtttcaccgtgtttgccaggatggtctcaatctcctgacctcgtgatccgcccgtctcagcctcccaaagtgctgggattacaggaatgagccaccatgcccggcctaaaatattattttaaagatatttatttatattttaaaaagaggatttagttaagaaatgtaaaaacagaatataggccactttacacaacaaaatatgcaataacaacatacatgcttttgcacatataaacactcaagtatgctaatgacagtcatactggtataatagttatgacaagatgaactgtccttataaagaagtaggtcaaaaaaggacaatgtataaatgcgtaccactatgattgatagttgtgtgcaacagctttctaactttggtcatctgaaataatataatgagcaacctaagtcttttgacaagatccatcaaaaactgtgataggttaccaacatatatgtagtcacccaaagagctgagatctcaagaaattttatatttcacaaatgcaaatgtacaaaagaacatctcttcatttactgagaaaatttcaatgtttttacatacgtacacaacacttaacacaaagtaaacatagttcacttctgtgaagtcgaatttgcaaaaaatgcataaaacagaactctcaaagtctctatacagtttatacctccagtaatggaaacgatgtgaagatgaaatacataacatagtgaattgctttacggggtttctaggtattcctcaatcctgtaaagttgacatctacaattaagcccatacgttctagtgataaatagaggtcagaaaaatagcatacgtgggtttggcttctgttttccttctttttttcttcagttattcttttgactgtgttttcttattattaacccttgcctcaaattgttccctgggagagtgctgcaggctacagccctttttcaaatggtgaaaaatttgagagaatagtggtatgaagaacattttgaatgcaaggctgtttagttgtgaatattgcattgatcacatctgtgtttctgaagctctgtgacttgctctcctaagcctagagcaatcttcactgaactaactctgtggggtaaagaaatggttctaagtaataataataggctcactttaacttagaaggtagatattgttgagtgactttagttagcatctgctgcattcaaaacatgctgggaggtgagggattatgaaagagaaagttgaaatacatagatttggacaatagaaaaagtatgtttaattttttctagttattgttgatgttttattttttaccttcatcatttcagtttcttattttgtttcagatacagaaacatcaaatccatgttccatacatcttagacactgatttttttttttatgtcattttgacatccctccagcacccaaatgccaacatctgctacattttgccacacggttgtaggcttgaactctgaaatgcccctaaatgtttttaaaatttctttgtgtatgttttcaaaataaccttcctttgagttctcagttttatgtgaactgtagttaaactcttttttttccatgacttgtagcatatggtatttaactgtttgccagtatcgctttctgaaatgaacctatttgtacaaaggcattttaagagaacagtgcacttaatcagagaacctccttcaaggtgactctactgcttaaacatggtttaaaaaaattaaaatatttatggctcagcattgttgtttcattgtctatcaaagttaataaaaataactggcctttgagaaagagtacacctttaaaatttttgaaggccaaatgatttttttttatttttcatccagaagtatctatccctaaaggaagagaaactttcttcagaaaggtatttgttttaatcaaggaagtttctgctgagattaataacttggtatcatcccttagttcctgataaacatcataccttaaatgagtcttctgttttttaactagtttttcttttgtctaaaacaaaattgcctcttttgttttagagatgaattactcaatttttaattgttttgggggcagggtgcattattttcctattgaagaacaaaatgtaaaacactgccctgaaaggaatatttgcaaaaccatgaaagtgagcaaagttgagatgggctactctatagaaattttgcattttattctaaaatactgtattttgccatgatttgttccctggtgtgtatagaagcattggctgcagcctgaattcctgagcccttcagttctccacttttagtgtatataaacacaatttcactgagcttggaagaatcatgttgtagtgaaggtaatattattggcctctttcttttgttgctttgctgctttgtggagagggataagtttattgtaaaagcttctttaaatccatgttcttatacagggctatagatatcttacccgtcagttccaggcaagtcaccctttctgggctgcagttagccacaatagttaaatattctggttttttggaagatttttaaaaaatctctattctatccacctagttctgagagagtatttccctcagtttgtctcatttgtgggaagaaatattatctgcccgtctttattactaccccaatatcaagtttacatatttatgtgtttgccattctataattacgtctgaaacaggttgattatctattttcaaaataaaagatacagaatgaaatgaggctgtagggagaatgaatgaaccaaaaagaaaaaaaaggttttgcatattttaatttctgaaaagtttctccagtaggtttatcagatgatttttgttgttgttcttcacagaaatgttgttcggccatgtatgttcatgagggaaaaaagttctcatcctttgagagtatgaggattgtatacacgatgtatataatgttggagaaaaaggtttttattagtttcatgacattagtttccttagctgcctttctgagaatggtccttatgtttaagatgggggcatttaagttattgtcaggattaaattcaatcgaaagaattaagtgttaggaaactgtgccttgcctgtcaaatagtgactagtcaggaaaacacacacacacacacacacacacacacgcacacacacgcacgcacaaatgcatgcacacattcctcactgctattttgacgtatatgtacctatagtatgtctaaatttttcatggtattagattatacttcaattatttgaaattaatttaaagaacagaaactaagaggaatcatagaatcaaagataactatgcgccttatctcaattgtgtataaaccttttgaaagaaaataggttcatttaatagtttaataacacattttgcagttgttgtaaggttcgtaagtttttgtttgctgagtattaaggcaaaatttttaaacaaatgaaattaagtggcctggtgacctggcttcaagtattaatctgtaagcacttttaaaatgcatgcttagcagcatggtttcttttttttacaaatcttttgcaaagagcagtgataatgtgccaatgacaatgaaatatttgaacaagaaaagttgtttttatttatggagaaacaagtaaaggccctaaggtggttaaatgattgcttaaagtcacacagaagtggcatggctctgatttcccagtttaccagatacttagatactcttttcaatgatggaaaagcaaataataaataatttactttctagatattgttgaattcttactatgtttctgggcttctatgagatgctggaagatttcttaaaagtgaagagggtgaaatggggaggtgttagtcaaagggtatacagttttggttatgcaagatgagtaagttctaaagatctgtgtagtatattgcctacagttaacagtacatactctgttgtagacttaaaaagagggtagattttatgttgtgttcttatcacaaaaaaaggtgggaggaaacttctggaggtgatggataggtttatggcacagattgtggtgatggtttcacaagtatatatatgcttatctccaaactcatcaagttgtatatatttaatatgtgtagctttttgcatgtcgatcataccttaataaaataggtcaaaaaaagaggaagagcttcaattatttttctcttctttcctttttccataccttcataaaaattcagagtgcaaatttcttagtttatttcacctactttctgagcaatattttttaaaacctgtgttacatttcaaaagcaatattcaatttattatggcattgactagaataacttgttcttgaaacttaggtaaatggttatgaagtaatcaaaatgtatctttcagtatgctttttttttgtgctggagtagaaaacccaactaaaaatgatatacattttaataaccaaagtatattatctcacagatggaagtctagaaggtcttaagggtgactccatcaaggagttctggctccattttcccaggaattctcttgattttgccctcctctaaatgaaacaatgtaattgaagcacttctgaacctcatattcaactataacaatgaatagatgaagagtgaggaagaattttcccagcagcctccaaaaatcctccttttattaacctgactaatctttttttgaactattcccttcgaagggcagtgggatcactgtataaccaaactttggtgggacacagcagacctgtgacactggctcacatgggagaggagtaaaacaccccaggaagggagaaagattatggacagctcaccctgccccttagaaaaactggagactatgtgttcctgaaatgaaacaagacaagtgttcattgcactctgagaatacattatgatgtagaaaaaaatttgagatctataggatatgaaagtggcacacaggcttggaaattacagcaattagtggtaatgtattatcttgggtactgcttggggtctctatatgtaagatgactttaaatatatgaaaattttgacaaacattgatactactctctcaaggaagctgtgtatttcccatttattttgtctgcaatctggtttttaataaattcaagactcaagttaacttttaataaatactgtacatattttactatcagaattttaagaacagcatacgttttttaaaaaaatacacaagatgtaattttagtaaggttaggaagagcatgtactgctggaagtatagttctgtaactacatagacaaaatatatgtcttctctgtcacaattttgccttcagattcattgtttgtagaatgtttcttaaggcttcacagatattgtaatttcttatagatggattgtggagagagatcatgtgtagatagaattcctacgtggtcccagtgttttaagtatagtagtcttctgccactctaatattgaataagaagtgctagtggaaaaattgggtgatcgattacttatttccactctgagatcaggtctcatttaccttgaatttgatttgttcttcctcagactcagtgtttctgatgcaggtggtgttaggctcccacattgttaaaataatgtgcaacattggtattcttttaaaataccattaacatgctttatctttgttcatttgtcaaatcaaggctttactattgaaggtgactttttttttttcctgcgtttcagctgagtttctcttacaatagtcttgactgctgcctgtttttgctcatgactactgattgcctgtaccctaaatcctctctggaccaggaagggaacatacatttgcaatgttggaaacttggagttcgttttcattgaaattctataggggctttgaatttgtgtggggtgttctgtgtatacaaagtatagaaaaaacctctattgctatctatcttcatttaaggggagagccagggaggctgtttagaattaaatgtttttagagagtgtttgctagcttttagtaactcctagacctggtaaggatcaggaccaggcaggtgtgaggactatacctgttaacaaaagcagccctgatccctgtgctgagagggagtatagtgtagtggcagggacggggaaagcagatacatataaaatcatatgacatgtaagaaggggaaactacatggtgctgagaagaaactatgtttatttcatgaaatgctgactgagctaagatctagggagaaatcagaaattaaattcccacaatatcatgaagaatagacttgaaaacagtatgagccttggctttcccttatttgagtcaatatgctgattgtatagagtgggatttattccattgggatcatattttttcagatactaaagagtaacttttagtttgggaagagcaaaatgtctccaattatcccaaggattaaaaactttaaagcaacttttcattcatattaatgtgaaaaagaatccacttagaaagaaatgagggttccacattgaaagacactttagcatttattacattgtgtattgttgaagtaagacttcaggtattcatttgattttaaaatatgtatggagcacctactacatagtaagcattttcctgagtgctggagcacagcagccaatgaagcagaaatgtcctggggggccttgaacttggaggtacttcccatttctcactctgtcatagggaatccccactgcattccttgttactgtagagtcaactgtgagattcttggtcgtggaacattttcattccattactaacatcagttatctctgactagcatttgtattcaggtcgattaaaaatatccctctgctgttgaatgaaatcttagaatcttaattcttctacgtcattcaatagaatttaggcttgtcttccagatttaaaaaaaaatcatctaaggtgcagtatgtactgaaatagtgaacctggaacaaccccatattccattgatattctttttttttcctggttatacaactgctggaacaatagtgtaacaatgtcaaagaaaatttgtctgggaggtaggaagattggtgataggaaaagtactattattatggacaagctctagatttgggagtcataagatttgagtatggttcctggatctaattcctggtagtaaggaggccatgcataagtcgcttaccttgaccaatctattttctacttttctaaaatggtaattctatttgctctgcttaactcacagctcttgtaaggatcacatgagaaatgctcagttgtttttatactgtcatacaggcacaaagctaggggtgattaaattttagaccgcaagtgtggactaaccgttattagtacaatatagtgtcagagctgggcaaacaatttaaataagggaaactggactttgttctccccatcccacccctgcttttttgttttgttttgttttgttttttgtgtttcttgtgttgcattatacgggcaagattgagatttttggtgtgggaggggtttttctggtgtccctcaaattcaattacgtaggtaaaggtggaattgatccttgttactcaaagtaagacttgtcaacaaactcagcattacctgggagctgctagaaatgcagggtctcaggttccactccagatggctggatcaaaatctgcattttaacaaaatccccacgtttattgtatgcaaattttcctaaacagagaagttgacagatttctaaaactaccctgatcattccaaaagactctttaggaagttacagcttcaatgacagcagctgcgagatgttttagcaccacctgggagaacgggggattgggtgggggagaggggctatactaaaaaacaaaacaaaacaaaaaaaactatgctgctttctgttcccaaggaaacattttaggggtgaaaggttcatattccattatcagtcccctgagcccaccagtgttcaaaaatgtttttttcccaagacttttatggcacttaagtcagactgctcctattggaataacagaccaaaaatgactgacagttatagtgtctgggattagggagaaaaatatttagtgagaggaactgggagtttatcaggagacatgaatgatttcatctccaggattctggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctacagttttaataattatgacttttcttctttttcctcttttctttttgcctcctgcctggagtcctgagtaaaatttaagattgtgtgtgtgtgtgtgtgtgcccttgacgctatctgattcctttgagtattgactacacatctggactgtgctactaaacaaagttgagagtgttggatgatgtgaaataaatcaactttgagactagagatgagtggatggctcatgacaaaaatttcaggctttatttttccaattttgctataaattagttaaaagtttgttatggccagcatttgggaacctgtgttgcatcagactcagccttcattcaattatttaacatatattgatcatatccctactatatgctattagtattatgggttaggccattcttgcatacctaaggttgtgtaaattataaagaaaagaggcatttacccatacctgaggctgggtaaattataaagaaaagaggcttaattggctcacggttctgcagactgggcaagcatggtgctggcctctgctcagcttctggggaggcctccaggagtttttactcatggcagaagggaagcaggagcaggtgtgtcacatggcgagaaagggagcaaagtgaacaccgggagggtgccacacactcgtaaacaaccagatttggggagaacaaacttactaatatgagaacagcaccaagccattcatgagaaacctgtcccccatgatctcatcacctctaatcaggcctacctccaacattggggatgacaattcaacgtgagatttagaggggtaagatatccaaactttatcaaggaccgtaatggaaatagacttgtactcatacagcttacattttatcctagtagacatgcctttgattgcatagcttgaaaggttgaaatgaactaaattgagggttgtttatattaaataaagctattttcccccaattttagctaaacctctttttatgtaaagaaaaaggattttttttttccagtaagatttaccagtcaaagcaggaaatcattttgttacaattgtcttacaaagcagccctgtgcaaggctgttgctaatgttaagacttttcttgggggtctccgatagctgattctctctcgagaagtcttcctattcttggatgtagagtgttgctaaaaagaattagttccattttctccagagtgctctaagttatagctatttatcttttaaggaagctcctaagtatccacaggtgttcagccccctaaaatttcaatttatcttcagcacagccagcttttcagtgtttactataaggctttaaccacatggtaattcctcccttaaagaagtctgctgtatataatgttaaggcagggttgtcagggctgttatgctgtgtcccaagccaaatacatttctcagcattccaaggttatgcgaatacacagaaataattattttcagatgttgacattgcacttagtgatttagtaatatgagaaaatatggttcaaaagttattcatctaaaaagcaatgcaaaatatagtagagacaaatatggtatgcattcaggcacatactgtgaagtagaaatgttggagtgatttagctttctgtcataacatctttatcacacaggatatggacttgctatgatgtgagttagcatgtttcctctgacacaactagagtccagagatgtgccttgcttctagtccaataatcactttcaatcactgagccagacccatgattcgtggattctcttgtcacttaagatgttgtctttttttttttttgagatggagtcttgctttgtctcccaggctgaagtgcagtggcatgatattggctcactgcaacctccacttcccaggttcaagcgattctcctgcctccacctcccaggttaaagcgattctcctgtctcagcctcctgagtagctgggactataggcacgtaccaccacgcctggctaattttttttgtgtttttagtgaagacggggtttcaccatgttggtcagggtggtctcaaactcctgatctcaggtgatctgcctgcctcaccctttcagagtgctgggattacaggtgtgagtcactgtgcctgaccaatatgttccattcttaagtcagttttgaatgttaaaaaatgaaatctttacagtttcaaaatataatttttctgtaatgatccagaaaataacaataggacttttaaaaagggcttttcttagctttgcaagaaaagagataagagcagaaaggttcactttttgaagagaacaagactcactcagttggaaagttactctaaatttactttttcctaacattgatttatgacattcagtatgaattttgtctgtttatatccacatatcatgtagtcaacatagaaaagggaaaaacctgaatgaagttttattatactcattgattctttatatgcatgaaaggggaaattatcattatttcttaatagtctttaaatttctacggtagcatttgaggaaaatgaaatgaactccatttgatatatgacctattgcacttaaaaatattcagatcactggttattgctgactgcttataaggcaaaatattttgattttactgtattgttcatgctgcgagcaaaatgggtgtctgctaagtttttattttaaaatgcatatttctgtctttaccttgtagccttgcaatgcgtaattcaaaatgtttgcaaagtacaagtttattatattgtttgtctgcttcttattataactttaaaaagaaaatgggacaccctcctctcaccccaccctagagacagattttccatgacagaatagttttaaacatcaggatattgcataagtcagtctggaaaaaataggaacagacagctagcactatctagtagagctttgcttttgtgacaacattttttgattaaataactctacataaatgataatttccctacatagtttgataccaatatctaagttgatatcaactttcaaaatccataattgtttctgtgtacattctttctgattgtttttatttgggtactgtataaaaaatgatgagaatttaaaagtcattgtatgatataaatccaaagaaatctaattaagctctgagtctaatgagtgtgagagaaacctgttcaagggatgtttcaaagagttaacattgtggtggggtatgaaaaagtgatggtgtgtaggatattgccttgctccaggttttacaaggaatagttaggatttaatttttggcccccaaaagacttaaattttaacgtaattataaggaaaaagaaattggtggcatggctgtgtgatcctatgggttgcttgggactgagtatagtgaaaagtttgtgaagtagacgttaatattcaaagcccatttcagaaaagttgaaatcagagcagtaagcaaaattattctccaagtcccttttaattttatttgctcacttaagccaaaagaactgggataggctgtatctttttcacgttacaatgatcaaactacaggggccaagtgcaattctattcatatttcttttcaagggcaaatctatttctcaataagtcacatcacttacataacacttcttgagtacttgtttactacagcctggacaaagggtatcaaggaacagtaggtttacttggtggtggagtctgaggaaaaataaaactatttgttaacagccagttgtttacaaggatccttatctagtttgtgaaatctttatccctgtgggatgaagagtgtgatctaactcattgtggaagcttagctttcttccctttctgctcctggagctagaggttttccatcagagatggatatattcttttgggattccttatcaatatgccatgccattttagaatgacttcacctatctcacctttgattatttatgagtaaaaggagggagaaaactacccgttttgtgaaattgtttctgacacatgaataaaacattatgtatcatactaataaattataatgaaattgtatgccaggattggatctaattccttgaattattcaacagtgaagctcagtaagttcaaggcactaccacaaagtactgttgggagtataatggatacataagaagtaatactggttaaaggaaaatagaacataattgagaaaaataaattctgcaaatatataattaagtaccatgaagcaattagaaactgtgttatagtccagacttgaaagagattatttcctgaggcaaagggagcattcatggagtagagtagtcattgagtaggatccttcatggagcagatagtcattgagtgggttctgaagggtgagtggaatttgaacagggagagacctgagaaagacgtagtcgaaggcaacatcattagtagcagaagagtgaaaaaaatatagtattgaagaagaatagtgcaattatgtaatgggtcataaaatggattagattgacaagttaattctcactaagagccaggtactttgctaaaataagcattttacataaattatttagccctcacagtaaacctaagaagtagaaatgtatggataaagaatttaggacatgatacaactaatatgtggcagcagatgaacttgaaaccagggactggggtcttgaccactaatctctgttccctgatgttggtatttggtactacagggaaggatggatatttcattctgtaagctgtggtcactcacaggatgtttttgagcagagtgagcaatgtgttcctcccaattactctgtctcatctcacccatccctctcttcaaccctgcctttaaactaccgagataaaccatttggaattacagatctgatcatatagtgcatgtgcttatgatcctccggggcccacagcatgcatttcttgtttcttcccatggtgtacaaggccttgccaatctctatagcttcatttgtaactactttcctttctctgaaatctccttgctgtattcttctgcttttccttaggttagtgcctcctcctggatgacccttttgcatttctggatccatctattctgctctgcttttctcatttcttgtgaaatattgaactgcttattaaccttcttcttcataaaaatttgaaaatctgtttccagatttgtagttctacaccaaaatggaattcagtcattgacactacctattccatattaaaatggcttttaaaattatgtaatgtattttttaccccaaatttccagtgtgcgacccatattcatgacctgttttgtctattagttaggataggctaagctatcttgcagtaacaacaaccacaaatattgtaatggcttacaacaaaaaagatttccctcatgtttgtgtagattgaagggaagactgcttatcatagttacctctgaaggaagctccacttgacatgttctttcacaatcacataggagagggagagcacatggtagtcacacgctggttctcagcacttctggctggtagtgatgcataccacttgttcatgcatttcactgacctcgcatggcctcaccaaatgtcaaggagacagggaagcaccatcctaccacgtggctgaaagtgggagacgcacggaaatacttagttcacaccactgcaatgggttaaagatctgaaattgtaagacaattcttttgaaatttatgttcactagtagtttgtaatagtgtcgagtcaaatgtagcagtttggaagtgaaaactaaaacaatcctaaagaggtgagattgtatcttttaaaatcattatctcagttgaaaactgaatattgaagcatatgcttaaacttaacacaataaatgtaagcatttcatggccatggcacaaaaatgtgttaaaactatatcgttcatccactgacagtgttgaagaacaaagcagtgtcacagaaaataggttgcattattcttagaaatatatcatgctttgagggatccttttttttaatggaggtcatgatcatctttcataaataatttatcagttaatggtagtgaacagagtttgaatgagtcaaaattctacaatgaaatgctcctgtataggtgtaagtatataaatgtatatataaatatacatatacaaatgtaaatatataaatgtatatatttaatgtgtatttgcccctagtttaatttgtcagcagtaactgctggtttttatttctttttgcaagaaattatatagaaattgatttgagggagatttaaaataaatgtttagtgagaggaaatcttactctgtcctatctatggatattgataaactgtaccactgtattcctaactcctaacttggatataggagcttgactatctgcatagatacgtaaggggatatggctgacaggaggaattacaaatgtacttatttaacaattaatgctgacataagctatttgggtaatacctcatttttttttagaatgaatgatgactgtcagtgtgactgaggatacagacatgaaattaggaaatcgaaaataaatatctgtttccttcaaaaaatttgactagtcatttttttgactagctttttaaaaattgcataagactaactcttttcgtttgctgtgtgtacattaaatatgtctgtataggtccctttgctttcttttgccccacagtaattatgttgaaaattataaacagaggcattagcataaattaaggattaagtatggaaatcataaaaaaccctacttccatgaaaatgaaatttctttttgaaaagagaaataggtattattctacttattttcgtttagcaaattttcttatggaacatcattactctgcctctcagaagatttgccaaagtgtttaaaactccctctgaatgtttgtacttcaataacctattgaaagcacaactgattttgtttgtgctaggtttatctccatttaaaggcagactccttcggtgagctcccctgtggcaatatgagagaaggaaaagaaggagggaggaccttgcaggactggtttatatagcaggaagttaagagacaagagagctctacaattattgagcacaggaaaattgatttcctattcatagtagtgtggcacatgtagaggagtctttaaagatgatacagcatgccattcctttcccctccgttgtgtaatcaaccagccaatatttatcaagtacctgttagtttcacttacagagtacctgtagctgagttttcttttcttttctgctttctttatccctgctctctagctcctgacctgtccatcacgaatatcagttttccatgtgccttagacctgtcttccatctaataagacttcacactgctcacttttcctttctgacactgaatacacataaacaacagagagcaatgtctcttaaacccataaacccattcaaaaaccaaaaccaaaccaaataaaatgaattggttgtattaatttgtatcatccatttacattttgagaagcatagtcaatcagataaacttactgttttaattctaaattcactgactttctgtcagtctctatgttccctgtatgtagcagctgggttaagaatataattgtcttgacaacaaattattgacatttacgagctcaaaagttacctcagaagcttttgaaatcaaagaaataaaagtgttaattctctctgatctgaacaagccaggactcagtgtcagccctttataggtcaggctgtggaaggaatgcataggatgaaataccagtgcatgcctggtgcactaaaactaaatgggatttcagcagatgaagggaaagggtgaggaatcaagccttaaattgtctgcctcaggcatggtaagaagacttggacagtaatagaaacaggaagtgtttgctgtgaagcttgagtatattcaaagtaaatcagtttgtgttccattaaggaatcctggctctaggttggagcctacgcgggatcagtaaattttgcactaggaaatacctaatgtcaagccttagaaaacacctcatactgtggccagctgtcatcaaatccatcgccactgctagtaaaataactccaaagcaagtgaaactggcagtaattgcacaagtaaacgggttgcaaaagagcaaaatgggtacgtttcagaacatcatttctgttaggctccatgttatactgcttacagtagaaacaaatggaagtcgagaggtgaagcctggcattaagtttactagtgatccaggaataactgttagcagctgggcctgggtgctttttccctgctttgtcctggaaagatttcacatcttaagggaaatgaactacacaccttgagaaaatttttttttctatcatattgtataaatctgtgtaaatctcattttccccctttttggagttaagtagcataattaactgtaaggcttttccaaatactttcttaaccctgaaaaactttccctcgggacttacagtatagccaaatggatatcgattattgctaaatgtaaatacatatgcacatatgaggtgaagctgtattaaaatatgggtggcagtgtctttaactcagatttgggatgctttatacagtcatgggaaatatcaggggatcaacttgaaattctttaaaagttaacagaattttggaacgatcaaggaacatgggaatatggcctcaccttttctttctcactgatgacataaatgccgccctcactgtgttgtttattgtttcttccagataatctttgcatactcagtacttggaatatagagccattgccctgtactcattttttccttcctggaggtataaatagactgatgacgccctatgctctctgcagtctgtgcatcattcataccgtacatctcctttctaggtcacaaagcttttaaaaaaaatcagcagtggtagcagcatgtgagaagatgagcatatgactgactccttcctttcacctcagagccgtgcctttgatagcatccagacagcagtgcatggaaacatgacatttgggtggttcaagaatatcagagggaaaaatagccattcttaccaaataacttaaaaatagcatagtctgagcatttttcccttcgccctttctcccccaacgtgcctgaaatgaagcccttcccatccaaagcaaaactaggaatttgtgttttgtgagaatttgaagagcctgcctctcttactacaactgctttcttccttccaaatgtataagcttaagtcgtgagaaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatctcacgttcaaggaaggtcgggaacaaggttggtgagtagtggggacagagttcttgttaccactggagtttgtgtcctggatgccaggtatacatcatcttattctcttcttgatttgtcagtactttttagggaccattagttctctgcctactatgtgccagactctaccctaagcatttagaattccagttaacaataggtaaatcttctattcatttaaaatttcattctaacagctagtaatgtatttggaggaataaatgccgtgaagaaaagcagaccgagtgttatctataggtagttatgggagatgtatgttatcttatattggttgatcagggagacacaaactgataaaggggcgattgcttatttctctgaaagaagcaaggaaatgagaaccacctggatggctgagggaactgcagtccaaggagaaaaaacagcaagcgtaaatctcacaggtgagggtgcatcagtggagcaagggcaagagtgttatgataagaggtcctgaaggcagcagtgagaaatgccctggaagcctgtgccagacatattgaggagtgtggattttattctgataaagacattgcagaggagtggcatcatttcacttgctcttcagaagagaaactggaacacagatgggcaaaggaggcagcatgagacaagcctctctcttgcaagccatccggatgagagataacagtggcttggaggtgacagtgaaggtggtaggaggatattcttaaagtagagccagttgaatttgctaattgtgatattgtaaaatatgtatttggtcttcatccctgttttctgtcatacagctcctaaaacccttgataagaatatcctttgtgtgctaataagacgactagtggctggaggcccctttgtaacttctggatgggggctggtcaccagaatggtcaggggattgggactttcagccccatctctcaacctctgcagggctgaaggttgtgttgattactaatggccagtgatacagtcagtcatacctgtagaattgaagcctctatgtaaaacctaaaggacagggttcagaggacttctggatagctgaacatgtggaggttcctagaaggtggtacaaccacccagggaggacatgggagctctgcaccccttctcctatacttcaccctatgcagctctccaactggctgttcattcatatgctttgtaatttttttataataaatgggtaaataaatatgaaatgtttctctgaattctgtgagctgctctagaaaattaatcaaacacaaagaggtgggttataggatctctgatttataactggttggtcgaaatacaggtcacaacctgggatttggaattggcatctgaagaggggggcagtcttgagggactgaggggtgatgctatgtccaggtggatagtgttaggattgaattgaattagacgatgctcagctggtgtctgttgaagaatctggtgtcagaagtgttgagtgatgtgtgagagtaggagaaacaatggtttttcctacattctcttacactaatggatttgtattcggagagattggaaagatggatctgtcatttcctgagatgggaagtcacagcgaggagcccattaaccatatattaaaactccattagtaatattaagactgtccattctagaagaggtggtgggtcacgcccgtaatcctagctagcactttgggaggccgaggcgggtggatcacctgaggtcaggatttcgagaccagcctggccaacttggtgaaaccccgtctctactaaaactaccaaaaattagccgggcgtagtgctgggcacctgtaattccagctactcaggaggctgagacaggagaatcgattgaacccgggaggcggcggttgctgtgagccgaggtcgcgtcaatgcacaacagcctgggcaacaagagcgaaactctgtctccagggggaaatattagtgaagaggacaatattgtaacctacaaaaattctgtggtaggtatgttacttttgttaacagacttttctgaataaagtactccaaagtaacttggagttaagacattttaatattatgccttggttttcaaaacatgaatggtttccttctcttttcatgaatttggatatgaatgcaggcacttacctacgtaatttctaatattgatgatactggtgtttcttaaattcactaaaaaattttatttgtaaagggtaacctgcgttacattatttaaagtttttattttaaggtttttttttttttttgagatggagtcttgctttattgccctggctggtgtcaaacttttgggttcaagcagtccccacgccctagcctcctgagtagttggaattaccacattacattttgaaagaagagagtttacaaatgtctgtttccatgcattttaaaagaggtcttgttacaaaagattcagttaatctctttaaatggaatttattttggtttcctacttcctccattaaagtacattaatccttcttaacatatgtatttatcacctgctggattgctaagtatgtaaaagctactttgtaaaagcaatgccgtagctaaaaaaatgtattgcatagcagccaatgtgatttagccatttcaacattgcattttattaacaggacactccagacctaaatggtgaaaagatttcccactcaaattgtcccctagcaagagaagattggaatatagaggaatctccttttctcctcgtgattctgccttttgatgaagtaataatctgtgttattccagttcttttaaatgttaattcattttaacagttgcttcagaaaataaaattttatgaggcaaaatacagcaaaatatttcaacaccacatttttgtttttccaaccagagtttgtttcatttacagacattgtcatttattttttatttttattcattttttagaacatcttaaatttttaatcctttatttacaggttgcctagacgacttttgattaagaaaactgtagaaagttggtaactgccaaagtggtaggcggtggcacgtgtcagtttccacagagtccttccatgtggggtatctgaatgcactgcacggggtctctgctcacacttactggagccaattgtggcagattttagtctacaagtcgcttttccccctatttctctgtaaacttcagcattcttacagaaatatttacagtccttagagtattattcagctaggtcagcctgaagtggatgctcaggctgggggtcattcaccagtgctgtgagggactggattacttggtcagttttggttgctggcttccagttttcagcactaatttactggcagagagacctgccccttttagtggacatttgggtgacagatctttaagtgtgctcttcggtggtttgaatgggtgctctgctggaaagttgatttcgattctgaaggcccccttatatggagggttgtcaggaacaataagcccttgccaagtcaataaattagctccatctacctggaagttacggaagtttttcattccacaattgcatatttcttcaagctccttcatcagccttctgctggtgccgtcttggatttgatgctgctcctttcccagaatgcatcgcagcccaacattgccatttattatgctttattttgttgagcttgatgctttgcattagtttgtttacttattcaataattatatattgagtgcttactagagttgtctagtttctcaaaattgtgaggtttatgctaaacactggggacacagcagtgaatgagacctagtccctgtcatccaggggccaataggtcacagatgtgaattagccctttcccttgacttttgggattccaatttcaaagaggttgtaaaagagagagtgccatattcttgaaccttttagccaactaggtaaaaataaattttcacatatttctattgagcccactggacaccaatatactttaataattgtgtttaaaatagaaaactccttcagcttgaagctgtcttttatttgagaaaagtgaaaaagagattcgtgggatattataaaagatgaacaagatgcctaaaatggacaatgctcctttacatgttactttaacatttgagagaatgctatcaaaatgcagaactggctaaaagtgttagaaggagtagttcaagttgtcttcaaccaagagtcatctagaatttggctgcaccctggtatatcaaatacgctgtatgggaatgtgcttatattttgatgagtaatgtgtttttataacaaatgaagatgcatgtcagaatgttgagctggtcaggtctcactagggatttgaagaatagcataacagcaagtgggcaccaaagaaaaattgagtttacttggatacacgagaactctgccttctgacttggtctgagaacttgttcaaggcaagaaacagtttctaacttcagctgaatcacagtgtgaaggtgaacaagtaaaaaagctcagttacctgcagaaagttgcttgcagtttcagttttacaaagctcactgtttaaatctagtagttaccttttaatcccttcagatatgtcagcaaaaattctagtatttggaaatatgccttgatcacttgcaaaaggctctggaagacagaagtcatagtaaagtgtcaggtattttaagaatctggttcaaacttccaaacaaagaatgtttcagacctcagtgtattaacagttttcctaactattcagttattcggtggtcttttattttttatttttatttttttcgaggtggagtcttgctctgtctaccaggctggagtgcagtgctgccatctcagctcactgcaacctccgcctcctgggtacaagcaattctcctgcctcagcctcccaagtagctgggattatagggtgtgtgccaccacacccagctaatgtttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccaccttggctactcaatacctgggattacaggcattgagccactgtgcctggcccaaacttgataatgtagaagtcatttgctgaggtaccagtatacaggtggcaaaaacaatggaaagagagaacgatgatttgtcaagagtatctaagaactaagtaaaatagaaagttcaattttcacttaaaggagccagagaggaaaagcctgtaaaatgttagatactttttgtcattgttttgaatataagtagggatcatgttcgggaaatcatgttgttgacacattgataatcccattagatttttccagttgctccgagtctcccttcctggctctgtttctcttacatctcagattcgatctatctgaaaattttattccacctgacttcaaaatagctagagtctcaccatttaactatctacacagttaccatcatctgttgccggaattatctgttgcctgcttccactcttgcctccttacagtttactcatcacgcagtggcagaactaatcctttgaaaggtgaatcagaccatgccatttctctgcaatcttgcaattgccccaactctcattcagaagaaaatttgacattcttcacccaggcaatagacatcagctatagacagcaaacacatggaagggaagctcagccgtcatctgtctctgtgatatctttgacctcgtgttgtaacactttccccatttactcactctagtcacatcagctcctggctcttgcttgaacccgttaagcatatatctttaccttggattttttgtgcttactgtttcctctgcctggaatgtacttttttccagtgtacacatagattattttttcacttccttgcctgtgctccagttttcctcatgaatacgcttaccctcaccactctatctttacctaactgtatttttctgcagttaccagctgacgtgttattgtttgtattaccagctgacatgttattgtcttattggctgccttctttaactagaacgtaagctcagtaagaggagggctttgtttgttgtttgtttatttattaccttttaagttcaggggtacatgtgcaggtttgttatgtaagtaaactcaggtcatggaggtttgttgtacagattatttaggcactcaggtattgagcctggtacccattatttatttttcccgatcctctccttcctcccaccctccagcctccaatagaccctaatgtgtgtcattcccctctatgtgtccatgtgttctcatcatttagttcccactcataagtgagaacatgtggtatttgattttatgttcctgtgttagtttgctaaggataatggccagctccagccattttcttgcacaggacatgatctcattttttttatgactgcatagtattccatggtgtacatgtacctcattttctttatccagtctaccattgatgggcatttaggttgattccatgtctttgctattgtgaatagtgctgcaatgaccatacatgtgcatttgtctttatgacagaacagtttatgttcctttgggtatatacccagtaatgagatttctgggttgaatggtagttctgtttttagctctttgtggaattgccacactgctttctacagtggctgaactcccaccaacagtgtataagcgtttctttttctccacagcctcaccagcatctgttactttttgactttttaataatggtcattctgattagtgtgagatggtatctcattgtggttttgatttgcatttctctaatgctcagtcatgttgagctttttttcatacgcttgtggccacgtgtacgtcttcttttgaaagtgtttgttcatgttctttgcccactttttaatggagttgtttgttcttttcttgtgagtttaggttccttacagatgctggatattagacctttgtcagatgcatagtttgcaaaaatgttctcccattctgtagattgtctgtttactctgttgataatttcttttgctgtgcagagctctttagtttaattagatttcattggctttatcttgctcattgctaaagaatagtgcttgtagcaggattctggcatgtagtaggcaggcaccagatgcttgccaaataaattaagatgaaagaatgtgagagcaagccctcttgtttgttatggaattcagtatttactaggaaagggtaggctgcctttcagtaaatccctgtcatgtctctatgtttattctaaaattggtaagctttctaaccataaacaaacagataaacatcatattaattgttcctctcctatttctctccttttcttttgtagcatgatgtttttgagtattcaaaaacattaaaaagattgggaaaggtctaagaggtggagagtagaataatccattcagataactcctcttgggtctacgtgaacagattttaggtactgttactgtgtgatggatctgaagctttcctgcatcaaagcgttcatccctggaacattcctatcaatgtaacatacttaatgataaattggcatttgaccacaatagatggtatttttccttaattaaagaaatacatgagaaaaaatgttaaatgttatgaaatgattaaaaatgaactgtccattttaatatttatatccaggacgtcgcgacaacctgtagcttccctcatgaagggatcatctctttcgcagcactccttcgatgagcaggagagtgtatattttagaacctttagagagaattggaagcatttactacgttttcctttaaataagtttgctgagtgacaggaacaagtcagatagcttaagtttgctaaaatacataagcaggtagaattttaaaatgctgaattttgtaatatgttccctgggggttagtttgcttgtgtaatatatcataccaccaaggagatactatacaacaaatctggggagaatttaataaaacaagtattagtgtttcacattcaaaccataaagttgacttcttaggaaattgtatgccccaaatattgatggaaacatgtatctctctgtattgcagcatgaaccaaaccctatgtaaactaaatcgatagctccaaagcaaaaccaacttataataacagaccagagttccagtaattaaaaacgtgacctactctgtacaatactctagctatattaatgtggtaataaagaattattaccaaaaattcgctggaaatgcaattatgtatatgtgtgtccatgggtagagttgccagacattgcatgggggtgcaactagtgatttggttatttcagttcttagaagtttaataatcctttatagctcccttttatctttacagaatagcacttgatgactggtaaaaagaattaacgctatgggcttgcccacaggaatcaagcaaagggcgtatgcttttggatgagtttgccagctggggaccatactgagaataacggttctctctcggactaagcattgagatgctttgtcaagtatccttagcttctgctttctcttcccttggttgagttataccaaagcctccttccgggaaatccctttagtccttttttatacagtcaaatcaaacacttctttatcagaagtgcatctatgtccaacaaaaaacaaaaaccacataaaaacctgacaattcacgtagcaagaaaatttcaagcaaaatctaagcaaggacattggcaaaggaattcctttctaatatgaaatacactacagaaaaagtattctatttcctaattctgagcagggaaatttttctatttattgttattattattattctattatatattattctattctaaattttctatttttttcatttagttttgctcttaatattaacattgctatactgagaccttaaatttatatgggtagcttagatttttctagggctcccaacagtattatacttgtagtatttcacttatggatgaaacaaggcgtatatgaaataaaatttatgcatatacatgcatgtaacacataaaaatatttgcatatatgcacaacttaattcctgtgttttatttttcgttgtacaaaatattttaactgtaattctatatacacacacattatacatataaattattatataatgttatcttagtgattgacccagaatagaatacagattttcttaagtttcaatgcaactagatagaaaaggatataatgtctgtattcaaagtaagggttaatctacttttggtaggttaaaagtagaacattttcttatctgagttattatatctgttaaaaaataacttgtaacataattaaatgtgtcatagttggtttattgcaatgctgtaaaaatttttttaaaaagaactgaactatgccctgattaaattaattaacgtgtcacatagattgccatttagaaaggttatttccctaaaattgctgcattttgagcctatcttctcagtaagttttcacaatgttatttatacagttagatattatgattacttttgtgattcgtttagatactaactttactaattgacagatatgatcatttaccttttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcattgtgccattgtggcatagcagtcttctaggagccaatactactaatatctgtgaaactctcaggctggataccatagtcacctacggtggctgtcagtagccccctgctgctgttacctcagcagaaaaaaatagcctatacttcttccaccttcaactctctaatcaatgcctcccactggcaggacctgacaagaagccagctggctaaggataaagaaaaatgtagtttagagtcttcctgcctcctgtgaatcagaaagatggggatggagttgatggccaataaagagtttgcacacatttgttcattaattcattttagtaattttcttctttcatactgcttgttttaataacctgcaagtaaataatccacaataatgtcaattcattggctgaaagcgtacaatgtaatttattaaaggcaaaatattgttaggaaatgaataattggagaaataggatggtatcaagaaagatatatgtgcttttctgaagcatctcatacatagtttataagaagaatgcaatatgaaaaattaaaatcagataaatctttaagcttttggaataatatgaaagttttatatggttatggcatggtagaattcacataactgattagttagaacaaagacaagactactttttcattatggaaagtaaacatagtagtcttctcaagattattagcaaattttccttaaaatgcttgcatctgaaaagatggcttcagcctgattattttaaagcctgtgtagttcatcagtttaagtagggaagtggaacttggcgatctcagaggagttctgtagcctccatgcccctgctccccccttttcatggctcactactgccattcacataagcaaacactagcttccctcagtcattcagatcatggatgaatgccattctgtgttagcttaaccaccatcattcttgataaaatataactttttacctgagtaatgcatacctagtataataggctacagtatttcttgaaatgtagagtccgtatcagtggtggtataaaagattgttttacatgcaacgagatatgctggtatataatattaagtgttttgctaaattatttgcctttcatttctactctaatgttactgattaagataaggggagcagatctcaccttggagctaggatgctttcatgtccctccaaccctcactgattatctttgtaacagagagcaggcctcaggctaggagtgtttgtcagaaaaaaaaaaaaaaaaaaaaagaggatcttgtgagaattgaaagagatagcattgtctttccttgactttagttttatggccactttgtacttatataaagtattactgagtttccatttaagtagtgacataaagttttaaaaaataaatccaattggaaacaaaattttatttatagaagactaagtgtacaatattatgggtggctggtccataacatggtagaatcaccaaggtaattgctacatgaataattgaaattttggaagcagtaatatatatagcacatttgcttctatctttttcttctttaattttacataaagatataaaacagaactataggcttatctagaaaaattagataaacataatcattcatctacttctttctctaggtaatgtatattaagctttgggcccaacccagtaactaaatgggatgatggtgatgacgattattattgattattgttttcttaaaagccgtgattcctattaaaatactcttgtagcaaattgtaatgaatttttcccagttggtttaccaagtgcgtaagaatcagatatcagtaaaaatgtcaaagtatacatttataatagcctatcttttccccagaatggcttattattatctctctgcagtgtatcagaatataaatagtattagaaggttttaaaaatatcaattagaatgggaatgaaaggaatactgaaggaaggaaaagagatgaagtgacgaagcacttcttttggccactttcctgctgcatgtctcactttgggtgctacttagatgtagatagagttggcaccaccaaacagggttattactaatcttggatctcacatataacttttaattttaggttgaaaatatgagaaaagtgttcttctcattgacaagtaattagccccagaatttccaaatcaattttgaatatcaggaagattaaaaattgaactactagaggccaggcgcggtggcttatgcctgtaatcccagcactttgggaggctaagatgggcagatcacttgaggtcaggagttcgagaccagcctggccaacatggcaaaactgtgcctctactaaaaatatgaaaatcagctgggcctggtggcttgcacctctagtcccagctactcagaaggctgaggcaggagaatcgcttgaacctgggaggcagagatttcagtgagctgagattgtgccactgaactccagcctggtcaacgagcaagacttcatctaaaacaacaacaacaaaaatcgaatttttttttggttgtttgtgaagattagggtcagtaatagaccccttttaataattgtatttttctcctcagagtggccgtatagataattctgatttgtttgctctattttaaattttagtttgattttttggattttaaaaaatgttattttcaatgtctgaagtttttttattcttcatttactctaaacatttacttcaagctttcatgcaatttggtattcatttgttaaaaacgtcttgtaaaatatcaacatactttaagaaagtaaaagctatactttttttttttatgagtcagcatctcactctgtcatctaggctggggtgcagtgcaggatcatggctcactgtagccttgaccttccaggctcaagggatcctcctacttcggcctcctgagtataccaccatgccaggctaatttttaatttttttgtagagatagggtctccctgtgttgcctaggctggtctcaaactcctggcctcaaacaatcctcttgtcttggcccccgcaaagtgctgggattacaggcatgaaccactgcacctggcaaatctatactcttgattatgcccatgataaattatctcagttataggacatcatctgtgtcaatctaaagagaggaataagaagagtagctattgccaccaatgagactttttgagaataaacatgaaaataacttacagatatttttaagttccaggtatcaaaattgttatagtatgaaaagcaatagagtagttgtcagaaaactttcaactcatcagtgacagagctggagataaatatgtgctgtctgtacatctccacttctttataaaatgaaaataattatcttttcctttgctacctcactgtgttttttgcaatattaagtatatagataagtaatttgtatgtatttttaaaactcaacataattatgttatacttgttatttattgctcaaatcttaatgctatatacctaatatctaagcatgttgtgatttattcctagatgaagaatcatctaagcctatggtaaatatatcaaaaggtattattttgcttatatcatagcaaacaatctctagagctacaaggatgtatagctgcaaatagaaaatatattttctgaaagattagtgaatctgctcttgttgttttcatatttctttcagtagtctctcaatatatttttaaatattacattttctacttacaaaagtagtatgtacctgctgaggaaaatgcagaaaaacattaagaaggggacaaaacatacttaatcccacttcccaggctggggaactgtttatattttggcatagttcctttgttttgtgtctgtgtgtttgtgtgtatatgtattgtatatgcgtgtgtaattcttgttttagacttttctattttacaaaacgaagaccatatggtataaagaatgtggacaccctttatagatggattttccacttaatttatttctttatctgaaaagcagaacctttaatattcattaccacttagtttaggttgttaatgataatgtttactaatgatactgttaggctcacagttcattttatgttgtaatcattattctgcacttgccactagatggctctgttctcagagtgactatttttccaaaagaaaaagtgccctgtatcattgaaatgatgggaaatgttattgcccttattaacattatatggaatgcacacaaatataattgcataataattcaacagagtatgcctgtgataatttaaatggtatttcaatagatccacaaatttaatatatccccttcaaaatgagggttatatttacttagaaagcaatatattcacttaacaaggttcactgtcacttagtaaatcaatattggaattattttttcagctctcgctttttatatcaataactttgatattgagtaagttgttttttcccattgcttggctaattgttatcataattatcttttctgtacttcagtatgatgactgtccttctgtaggcccaagaaatatactctatataagtaagattttcttctggatggctattacggtaagatgttttaccgtgagctgaatcatgattactctcaaagccaatctggtttcaggtgggtcctaagcccatgctaatttctatggccaggattgtacactatgcaaattttcattttccttgaagagtgagtgcaggactataaattgctgacgtgggattgaataaaatgagacacatggatacagacattagtttctcatgtgcaaagaagttgtggtctttgtttatacagggctttctagacatacccagctatttaccatccaatcatattttatagagagaaaaacagatattttaggataaacattctcaccacatgatgaactgataacatggcacactctatttatacccctagcaaatctcagtattatgaattaagaagcagttacatatgagaatatgaaattctaaaaatgaaattagaagtttagccgttgtgcataactcctgtgttttaaggttcatcataccccatttttattttcaatttttaaaaaatatttagttacatatagttcattaaattccaggtctaagttcatcaaatcttcctttctgaggataaaagtcgatgaagttggaggttgcttaacaatttcttctctttaatagcatgtcatagttttcatttttgcagaatatgtattccaagaatagagtagcccttatattggttcatattacgttgttggattacacacgctcattcacagctctgatggtaaaattttctaccaactccccaagctaagtacttacgtgtgttagaatgttaattctctaggtaatttttaaaaatttatttattttattttatttatttgtttatttttttgagacagtctcactctgtcacccaggctggagtgctgtggcacgatcttggctcactgcaacctttgcctgccaggttcaagcaattctcctgcctcagcctcccgagtagcgggactacaggtgcgcgccactgtgcctggctaatttcttgtgtgtttagtagagatggggtttcaccatgctggccaggctgatctggaactcctgaccccgtaatctgcccgcctcagcctcccaaagtactgggattacaggcaggagccaccgtgcccagccagtacttttattttaaaaatttaaaatggtagcatgtcctaaataaaataggaaatataaaagttgaaagtcctggagatggatgaaatagggaaagaaggtaggacaaacagttcctacttcttagaacttgagagactatatctaaaagaatattccagaacagggaagtgttataaataataccaacttgtgccaaaaaatattactcatcttagatctcccttttggggattttggatcaataagaaaccacgtttcaatggaagtggtgcagagcccgttgcctagtgtgaagagccaatgaactaagtcagcaggttaaaacctgaccccctggcccatttatttttctgtctttgcactcttgaaaagcatgttccctagagatctatccaaatagtcactggagtcctgaggccccaccctttgtccagtacactgaaccgtgttatgcaacatggaaattgttcccattccaatgcctgacagccagactcttggaagacaagcaaagaaacaggatgcttctacggagcacaaacacttagcactgacagctacaatctgtgaatgaaactattttttatatgagcaaataattttttaaaaatccaaatattatgaagcatataaacaaaggttctaataattaagagttcttgctgaatgcaaagcaacaattctcctgtgtttcaaggaggagaggaagaagtgaatgagatacacagatgccattcagtagaccatctaacagggtgcgctgagttgtatttaagtgattataatgtgatataatgagtggtcatgagtaatacttcgaatgtgaatgctttttaaaattttcagtgtacttttaaagaaattatttaaaagttaaattatgactagtgtattatttttaagtgtctcatataaaaggcaattttgtctctgtgtgtttctggctctgtttttcagtagttgctgttctagagaaatctaatgtgaatataaaaatcacttaatctattaataagtatgactatataattgtggctttgtgtgtgatagacgaagtttgaattttaggataagtgttttcttttctttcttcttagccatcaccgcctgtcccagttactaaaggtacctctcttttcctctcatcaattttttgtttgaaagataaatgagatcttcagtgtgtgcttaagtcattttatagttatgagtgcaaaaaataaattgccatttgaactccagagttgaattcaaatttttcagaaataagcacatattttatttgttttttgagacttctttgtttttctcattgttgggtgggtagccttttttatatatgccttccaaagcttctttcctgattgttgaattacttatatgttagtttaataggtacattaattttttctatctaattgggagtgaaagaagactgctgttaaacatgagttcttagttattggttgttttcatcttttaaaattttctgatttgaggagaggcagatagacttggttaaaatgatggattataaatatgtgaaatgtctgaatgagatcctttaacaaagaaaataaaaggaatgatgatgctttttttttgtttgtatatctaggaatctttatttctgaaatgatttatattaataaagatagtgtaggaatgactttctatattcctgcctagtattctttctgttaatttatactctagatgttgtcacaggaaatgacttataaaaatgtatttattatgcttgcttatataaaggaggatttttaaagtctttattttattcttgtatgtgatacactattaaaaacattgaaatatacatctgccgttatcttttactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaatacaaaaagtagctgggcatggtggcacgcgcctataatcccagctactcaggaggttgaggcagaagaatcacttgaacccgggaggcggaggttgcagtgagctgagattgggccactgcactccagcctggcgacagagcgagactccttctccaaaaaaaaaaaaaaaaaaaaaaaaaaaaaaaaaaagagttgcttaatggatgagaacgtttcttgaaacacttataaaattaatagcacattttctttttgtagccagctttgtgattttgtcccatatgtttaaacaaattaaatagcattgtttaggttttaaaatagcaacattgttctattaggattgattttgatacataaattcattatgacatttatttttccatttgcaattgatttctgagtcttccctttcataccctgagctgtctcagaatcatgctttctttctttttaataacattttgcatgttatacattttacatttgtatgtgttgcttcttatcattagtcttttgtcttaaaattagaatggccaatgattatggtctgtacttgcctgtgatcttgagcaagttatttaacctctctgaatctcattctgtaatctgtgaaattggcccaataatgagggatctataagactgattgtaaacattaaattaaatgataaggatacatgtctggcatggcattagaaatgtagtaaattcttgctaatcatggttatataaacatgccagagatgattcaaattacactgacagcaagggctgcctggtctttcaggttacactgtgcttccccttctatacacagcttccctgtagctcccctctatacgcagctccaagcatgccagacctaagataattatttcactgtggttattgtgacttttaacctaacttctgttgagagaaattaaaaacaagtccttaagaattgtttgttcactggatgttagtagtgggttggcaagcactgtaattgggttttgtaggacttctctacacaaagggtggaagagccactaagcatcctctcaaagtttcaaatatattttctggcaggagttattttgttaaataattctagaggagagtttactaagtagcttattttgcaaactgtgaggctgccactcagtcactaagtgtatcattaatgtggtctaattatctgagccctcacaattccacactgcactggaggagaagtccaaagccttgaagctcactgcctcttctctcatttcagaacccagtgatagtatgcttgagaattactaaacatcaggtataaggagtcagagatgctgaacagaaatcacatgattaccattattattttatatgatttttgcagattttgagacatatttgttcatatttaacccttaaatacctctgagccattctttaacacagaatgactgatatttttcaaattttcctagccaccgtaataatgaatacccttctagttacttgggtgaaacatccaagatccatttttgcctgccttctgaacttcattccttacttttattatgttgtaatatcctgccagtttcatgtctgtcaactcctccctatgctcgcagtcgtagtccatctagtcattctccactcagatggttgtcatggtcccaaagggtcttctctttctagcctcccactctctaatgagtctttgaaattgccttcagagttactttcctaaaatatgcacatctgcagtgtacttatttggcatagaaactggctactttgaatttaatacattaactcaaatcctatgttgtcgataataattatttaggacctgtttcagtttaaaaacaccggaatctcccttctaataaacatgggtgcctttatatgtttttaaaagacattgcatactgtctagagtaacataataaatttttaggtacaacatatatttttgatgacatttgaaaggaaatattatgtgggtggaatagggaaatagtaagttatctaggaaatgaaaacagtaaattatttaacacagcctaacagtgctataactgtaaataacactttagttctgaagttaaaggtcagtgttcagaatgaaggcagacaaaatagatattcccatggcagaactgttctttatggactttcaggaaactctaaatgacattctctgccaataatgactctgggaaattgcatctccttgttttctgaatttattaatacttctatctccaagtcttcctggaaatcatattttaatcttttttttttctgtttttttttcctatccctgccacatgtgttagcaaaactcggattgttttctcttacataacactaatcattcagtatcctccattattttagttgttagggtcatttttgtttttagtataccagaactttgtcttaagaaagaaataattgtgttgatggacttgatggcacaaaacaggagttttttaagtgggaatggaaaatagtttttattttgaatgttgttctgacttgaggtggaatactatattaagagggactctgaggctctgagttcagtgggaaagagggaagtgagaattcatcatgtctgagtgggacatctagttgtaaagggggttgtgtcccagggtttcaagtatgaacactgtaatgagaggtttgaacctagaaccacctgattacaaagcttacatcctttaatagctagtctggattacccctcataaaaatttgcaaatggtcaggaaagtgtgttataatttacaacacttttccacttgaagtattttaggcaggactagggaacaatgtaaggatgtaaaagtggaggtggtagagatggggtttatctcttttcttcttaaataataatcttggaattatgaatctgtatgcacgaatcttgaataagcatcaaaatctttctaaaactttcacagtgcaatgctgtgggttgcattgtgtccttttccccccaacccgaattgatatgttgaagttctaatcccttatgtgatggtatttggtgaaggggcctttggcaggcagttaggtgtagatgaggtcgagagagtgggccctcgtaatgggattagtgtgtttataagaagagacaccagagagcttgaactctctttccatgtcctcacatgtgaggacacagtaagaaggtgtctgtctgtaatccaaggagcaagccgtcattagacaccatccatgctgccacctagatcttggatttcaagtctccagaactgcgaaacaataaatttctgtgttttaagccacccagtctacaatattttgttattacagcttgagctgacatgcccattcccaggttttaccctggagattgattcaacagttctggagaccagcctagcatttgaactcttcagaatctccatacgattttgtaacgtactcttagggtagagcgcaaccaaatttttaatttgtctacaagtggttttcagccttttctgcacattaaaatctttggagcttttaactatgattgattgagaggccccatccgtgatcaattaaatccggggtaaggtcaggtactggtgttttttaaagagctccccaggtgagtctaacatgtagccaagcaaaaggaagaaccactggcctgaatttatcccttttcctctgttcttctgctccataaatcctagtttctagaaatacggagtccaatcatgctctctcttcccctctgggttccccttacatctcagagtgccattgctattattttctgaacagcaaatccatagtttcaaaaaccatcttttttctgttgcctcaagttttccagtactttaaatctcagaatgaggactgtaaaagtaagaaagtaaattgattttctaggatgtttggattctgggcaaattggtgttatttatttaaaactccacatttcaaagatgtaatgggttttagattttataccaaaacaatatttgatatatgatgcctttctaaaggttatctttctgatttttttcccaaaatatatttattgaatacttttttgtaatccctcccagctactgtgttggcactcaggatgtaaatgaaatggtaacatttagaatattttttaaccagcgtggcattgacgcgattggtcagaaagaacattgattgtaagccaccctatggtcatcctggtgcattttggctctgaatttaataccaaaagaggcagctacatccccaccctcttaaggcttatggttccttgtaaagtcttgtatttgaatgtatgttgacatgacctagatcatttttggatactaccctagagtatctgatacagtggatcagagttggggctcagtaatctgcattttcaacatgtttcctaggacactggataggaaaagacaaccaggaagggattactcagttgttccataaagcaattcccattgtcttcagtaaactctagccaactacttgcatattccttttatttctttcagggtgttttctgtggaaaatctctacggtctgatagttggcatcctggcagttaattttatggagagttagcttttgtacattcctacaacatcggctcctcctttccctcccactgcaaaccccagtcagtaggagattctagaaacttgaagagagataccactttgtttttcttcctaaaggtgcaactatttagttggatgtaaaatcctacactcttcagttgttaaatctgtctctgaatctagtcatccctcaggggttttattaatctaaatgaccaccacattatcacagctgcaactcatcttaagaactatttctcagaaaaaaacagtaagtagctagtgactctgtacacagagaaaaaaataaagaacagtttaaatcatatcagggtttcttctgaaatttttttcagtgttggaatgtgtaacttttaatctcattttggggaattttaaaatttggtttggattaaagagcaaaatgttggaaaagtaaacagcttattatctaaaggcattaaatatctaaaggcattaaatgtctaaagatattaaagaatgcatactttcagattcacctttttaaatacattgaaatttttattcaccatcatggtaaatcttttaaatctgtttgaattaacatattgtaaatgatactcaatatatacatattgtatgtgattttatatgcagtaagttataagacccatggctttttgaacaattgataatgaacatttaaaatggtaagatagatcttagaaatggtatctgatttcctcttacttctagtgagttgtgtcattgaatgttttagataaaatctttgaattatgaatattatgcacatgaaagagtatatataatattggtacagtttaaagaatagcaaacattggtgcatattagcctcaaatttaacactgaaagagacatgtatctccctaccctcttaaaacttacagtcccttgtcgagtcatatttgaatgtatgttgacaagacctacgtcattcttgaataccagccccagagaatctaattcagtagattagagttggagctcaggaatctgtattttcaacatgtttcctggtagactggattggaagagacaactaggaagggattactcggttgtcctataaagtaattcagtgtgtcttcaacaaacactagccaactcgatgcattttcccgttactgctttcagagtgttctactattcagcttaagaaataaaacattatcagtgactacagtttcctgagtgctctaccctgatcccatacttctctcttccttatacagttaacctgtagcatgagttttaagaaaatcattccatagcatggatctcttaaaaatagaattatatatatatatgtttatttttgtctatttttgaacgcgttagaatcatactgtgtttcttctttgactcatttttttcattcaggtttgtttttgagattcaaccgtgttgatatgtataattatagttcattcattttcccactatatattaatgcattatacgaaggtcctataacattgatccattctagtattgatgggtttttggattgttttcaatacttttttgaatattatcaacaatatgaataaaattatatgtggcttttagtgcacatgtacaagtatttctctaaggcatatacctgggagttaaattgttaggttaaatatggtatgtgcttgttcagctttcctaaatagaatcaaagtacactccaaagtgattgtagcaatatacactctccccggcagggtgggtgaattctagttgtcctatataccgacaaatatgatgggtgtaaaatgaaatttactgtggttttaatttttatgtctatgatgaataatgatgttgaagctctttttatatatttaggagtcattcttgaaatgcctttgtttttgttcactttattattgttggtttgtcttcgtattatttcataagattcctttacatattttcgatatgtgtcttttgtcgtctagatatattgtgagtgttttctcgtaggatttttctcaaattttcactctctttaaagtgatttttaggacaaaaattatctttcaattttaatgtatgtggattagttttctctggcatctataacaaattaccgcaaactcagtggcttaaaacaacacacatttattctctttcagttctggaaggtcataagcacgaagtcagtttcactgggccaagatcaaggtttcagcagaggcttgctttctcaggagactccaggggaaaattcttttcctttccttttccaccttctagagcttcattccttgcattccttggctcctggcctcttcctccatcttcaaaggcagcagtttagcatcttgtttccatcttcacattgcctcgactgctgctgtccttaaagtttcctctgcttctttcttctgtggacactggggattatatttaggctccattcagataatcgggggaatctccctatctcaaaatccttaatttagtctcatccgcaaattcccttttgccctataaaataactttgacaggttcagggattagaatgtggctatctttgggggccattattcatcctaacatagaagataaatttatctttttttttattttggtggagatggtagtgagacagtgctgtgactgttgaatcttcagaggccagattagcccaattttgtaagtagtctctttaggtcactgttgatcaaaaatgagtgaccaaatacttctgccacttaaagatgggggaatatttctttttccttaacatctatcacttataccaaatgtaggagaggaaaaaatgtgtgtgagtgtgtgtgtgtgtgtgtgtgtgtgtgtgtgtgtgtgtgtgtatgttccttcttttaaaattcctgagctcctctctttcctcccatgttaaaatcggtagcatgtccaagcctctgggcctactgccttcggttagctcacacttgctttttcatgtgaagtttgttctatggcataatcttagtaaagcgttttaaaaacaaaaagatacggaggctttttacaaccccttcgcctaattatatgattcattaaaagaatcttgggggtgggcatggtggtgactcatgcctgtcatcccagcactttgggaggacgaggccagcagatcacttgaggtcaggggtttgagaccagcctggccaacgtggtgaaaccccatctctaccaaaaaatacaaaaattagccagacatgttggcacatgcctgtggtcccagctactcgagaggctgaagtaggaggattgattgaacctcggaggcagaggttgcagtgagccgagatgatgccagtgcacttcagcctgggtgacacaccatacacacacacacacacatacacaatcttggtatgtaatgaacagagaaaatgctttcagttttgttttgtgcatctggaaagaaaatgggattcaaatgggctgaagaaacaggccgtacccctaagaaagaaagaaactgagaggcagatattcttggaacttttggtgcagaatgccagaagctagataagcaccccaagtagaaaccagaggaaagtgactgggggcgagaagccataagcacaagaattgtttaaatgcttcagtttgcattttagttcatgctacaagttatgtagttcatgctacaagtttatgcctggagcttaaaatcaggcatttttctctatctaaatttctttgctttaaccattgcattttaaataatttactctcctttcttttgagatataaaagaaagattttgttcttgcttttattcttattttgaggattgtggcaacatgtagaaaaacaggagtagagcattgctattattgacaaaatactaatgttacgaagttattgacctataatgtccttagactgggaaaaatcaatgccttggtaatatctatgccaagtggcaaaaaggagacatcagatatttatgttgttctacataatatttgattttatgatatttgagttttgcgggatatatttgatggatgttatgatcttaataagtagagattgtcaactcttctgtgaatggcatataaaaaatgataagagaatgtcaacggacatttaaagaaaccgaataactgagtaaaataagtaattcaatacttctgccttaaagatgggaacttaaaatttcatatagttagtgtgtcttgattattgcctattccatcttgtggcatcatacaccctgtaaatctacagcaggagaatacagttggcattggagaggaactggtttcatatgattatctaaattatccaagaagaatggactatgaatcccttgaacatatgcttgagtccacagggattcaaaccaacgcctggggtttagatggaaaggccttgcccaaagagcaaaaagatatgacaacaaaattataacccttggcaaattccatcaaattgatttgaatccgtgggctgaaaatgtcagtgcttattaaagtatacattgaaaattattaagaatatgattgctgaatgtcccatattcttttgtgtcattaacaataaagtggcagctgagcatttgtcttgtctaacaggattactgttggctatgaattaaaaaacagaacgtggaggaattgccttgttaactactaatactatttcgtggtttagtatagatgggttaatcctcattctatctacttttatatactcactgctaagccatattttgaggctgtttctctaacagatgcacagggagcactttcttattgctagagtacaaaaaaggaaagacatgtttgtgatgttttcaagaacttcagtgtccgttgcatatataaccttttgaaacaaagaaatcctatgcatttgactaagattgcctgtgaaatctggcgctgctaaaagaaaaatatgagataatattttaccataagtacttctttttcctattaaaaaatatcacagcaaaaacaaacactatgtgccagcaaatttatgcccctaattatcctgagaattatcatgcagtttgcaaggaagaaggggctctagctttccagttgctgatcggcaataatgaacccctgctctgttgttaaatactttttttttggtagagtcataaagaacagcacttctagcaaagatgcaaaatgttaaggccgtaagtcaaaggaataattcgatatctggcttgataaacggatttttaaaaataaccttgatttctgctaaaatcttttcccttgaacataaaagggagtgaaggatttgtatatttcaaggtaattaaaacattactgatttaaaggaatactatcatgtataagacgaagaaaactagaaagatttctttttctctgtcatccagtatgttagccttgagagtgagacccttaaagcagcaacagagtgagactttttgaaaacgccatagcaacctggcctcgtagcccatgcctttctttagaacaacaaagaatggtgcttgaaaagtcttctcatgattcttctgcttcaacagcttgcctttctccttgtcaccagagtaagccattccttccagatcgcatcttctgccagaagccacaagtttggcttcttgaaatctcagaagtactcattcctcaagtaattaattaaaacaaataaataaaatgtgtaaggctttaagcttctgcaggaggctcatattcttccaaaatagtctgtcaacaattacagtatttataataataattgtgagagaaggataattagctttaggaattcttcttcatctagatttttataaagtgttcttaggaatagggatggtttattcctattgacagcttgtcccatgtaggggagtcatgtttgaaggcaacataccagattggaaggagcaatgattcaaaacaggatactgaggaaataaacatactgatatagtatatagttgtaatagctgcagttgtaatcaggcatacataacctaggcagccatttacattttatacaccctcattagagcgagcttctggaaacacattagtcatattatataattaataagtactggatccagagccaataggctgagcaatacacacctgccttcagtgagcccctgatgacacttattctttttgtttttcttgtattttcagtacctacctagcacactgcttgacattcaataaagactcaataaatattggatgtattaaacaagattaaaaactgcctgtaaacgtaatggtgtaaatgtttactgtaaatgtaaacttttccaggaaataatgcttttcgtccacctgttttgaaatataattaaaatgacattttccttttcataatcaggacaagtgttaatattacaaaatccttattaagtcaggacaatgtcaatattttatgggctgtatttcaacattattaattctaatgtaaaatagtcactctttgactataaatctcaaatcatttccaggtcaaaattttggcacatttttttgcctagatttttggatagttgaaatgtctaccagccttctgaattttctcatgcatttttctcactgtcctgattaaagagcagaaaataattacactaattttaaaatatatactttgtgacatttttcaacatttattaaaacccacattttattatggccaggcttcttatctctacttttgcttagaaaaatgacagttagtttggaattcatttttgatttttcaggtagtgttgctgtatttctcaagaataatggttgagttatggtatcgaatacttctaaatattcatccttgttgaaaaggttttagtcattcccttaaaaggttaatagacattgaaaaacactgaataattcatttttatgtacataagctgtatcaaatgtagtgtagtctacaaggtaacatcagggctaaagtttcattccagtggggactgatggactgctctctttttgtgggtataacgtgattgtactagtaagcccaggggactttacaccactcctccttgatcagtcctgaagttcatgtattacctttttacctaaatttctttcagtgttttcttctctgctatcccttgagtatatctcttgagcttatcatgtgtcttggttgttgagggccagaactgaagaactgtccctatcccttcttgtgagttaaaagggaattaaggaaaaggaatctcactgcagaagaatgttttggttgttcatcctatatttaatcttgctcctttgagtttatggtcaaacatgagcacatttataaaatgctttcctggggcagcgtggaagaaactgtgtttggaaagtgatattacactgaggacacttgggcaagaggcttctgcagcttcagtcgccattgctttgaagatcatcactcattgctcgaaatcttctatgaactcctgtaagttcagatgttaatagctgaacattgttcaacaaagtcttaaattgattttaaatggactggtatagcaaagcaattggaaggtatacaaaagagcaaaattgagaagctgggtgatctaagcctgaagtcctcaaatatttaaaagacttagtttgtcaagatttaaccatctttttctgggttcttttcatcactgttgacaaaagcaagcactggagaaaaatttttcttttgcctatggggccagcagtgaagatgagctcatctgtccatcaagctcttgctgctgctacctggcctcatttaatagctgtgaggccaaatccttactgtctttgaagtcagaacatgcaaagtttgagtatttgatgtatctttgagatgtgtcagtggccaaccaatgagagggatttggcagttagtgtcaatgctacaaaagacagttaattgtacgaaaaccacaggataaaactccaagtcaaaacaatagaacatcatccaggttatatattttttagctatgtagcaggggccctctgcattcagggcttttaaacttatttccattaacatctttatcatttacatagtaaagctttcagaatataaaaattcttctgattatggacaagctactgtgtgtccaaagcattgtataatttaacatgatcaactactttttctaaaaatgttatttctcaaagaaataaaatatagcatttgcaaaacacacacacagaggatcttattattgaagaaatgcctaggttatttgcaagtctattaggaataattttccttaacttattgactgttttcatctcatggaaagaagtttccctcctgtctttgctttggattatgtaactttgatttttcttaaagtaatgatttgcctagaagtgaattcattcagcttaaaaaccatagtagggcagtgtgaaaggaaaatttatgaataactttttccactatcttttcacaaagataagttctagtgggagaagctctcaaagtaaccaaacaaaactagcattgacagtgaaggcagaacgccattcaggttctgaaatgaaaccataggagaaattgtcttcattgacttgaccttaactaacttgctagcgttaaccagtgctctggagtctttctgttaaaaataccaactgatgttcatcaattgtggtggttacctggccagtttatgccacttttccttagtgttgtaattgcagaatttaattaaaaattatataaaccactgaaatataagccaaaaatattgttgttgtttctatgaaaacttgattgaatgctttctttgaaagacttgatgaaggcaaagtagatacagcatatatgttaactgaggtgtagatgaaataattagggactgtgggtaaaactgtaatcaaataactgtgcagcattacagatgtttaaattacctttcttctaaaggtgacatgaaatagagagtaggagacctaaaccttgcaggattttagcccttcatagaaagattggtgaatgaatgtctgaataatgaatgtttcaagttgaaactgaatatttattatatgctcatttaattattaaacatgattatttgctttatgtggctctttcaactgtatttactgacgttgttgttgttgttgttattaactagtcctagtcatttggataagaagactcttgccctattagatcaatccctaatcataactggggtactataggacctactctttgttagctacatatagagtaacacaatgaaacagccagcaaaaataagtaaaggaagcattttaatatttatgtatttttaagaacattgacatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctcccgtgttcacgccgctttcctgcctcagcctcccgagtagctgggactacaggcgcccgccaccacgcccagctaattttttgtattttttgtagagacgggatttcaccgtgttagccaggatggtctcgatctcctgacctcgtgatccacctgcctcggcctcccaaagtgctaggattacaggcgtgagccaccacgctcagcgagaaatagatatttttaacaaggtccccaagtaattttctctaacaagtacagaaagcacaagattatttctccctgttgttttgactcgtgtgattacataattgatcatttaactaagaaatgaaaagtattttagtgactaaaagtattcattgcacacatgtatttttttttctgtaaaaaaaaaaaacctgatgtagaagaatgtttctaagccatataggaacacaaatatttttgttccagaataacttaccagaaggccatggcatagagaaattccctcatttctataagtgtgcttttctcttgaatgagctttacttcagtgttttacttgggcacatgtagggaaagaaaaaaatcatgttcaagttgaggaataagaagagtttcagatgaagagaagcagattctggcacacaaagttgaacagtgcaaaacattgaagcccagctatacataatcaagctggctaagctataatacacattaaaataaaagtttttttctcaatggacaaaattggaactaagtatgtctgactgttttagagataagcacttctcaacttctaacataaaaagagaagctggtgtttatgtgaaagaatctatgtaaaagccatatggaactgtctctaataaatatccatttaatcaaatgtcactatgtttttgaatgttttgtagtttgatgcagagaatgtacttttatttcttcagcagctgctctttttaaatggatgcagctgtactacagatttaatttgcaacaattgcttaatttttagttggttgcttctagtctttcaaaagcaatgtttcatgtttctgtggaaagatttttttcctagaaagtgcaaagtacgatatgacgtaggaattaggcaaataaaagtttctgcttgatttttttaaaacataaaagttgtatttcctctctttatagcactgcttttcctagacatccttttttcagacaacattactaaggagatttgatgcctacatatcagtcttcatctcaaaacttctaaaagaggccttacgcggtagctcactcctgtaatcccagcactttgggaggccgaggtgggcggatcgcgaggtcaggatatcgggaccatcctggccaaaatgttgaagccccgtctctactaaaaatacaaaaattagctgggcgtggtggtgggcgcctgtagttccagctaccggggaggctgagccaggagaattgtttgaaccccggaggcggaggttgcagtgagccgagatcgcaccactgcactccagcctgttgacatagcgacactccatctcaacaaaaacaaaaaacaaacaaacttctaaaagattgtaagctgtaacaaattctggcaaatgacttgcaaatgagaagaaaaaaatcacgctcattcatgtaaaatggtatctgctttgagaataacccagtatcaagtatgtgttacttgaattagaactttgactttttaatatagagagatacttttatctttgacgtattttattaaaatgtaaagcacatgatgttcctttcctatttccttatattactctgtttttactgtaatgtttagaaatctactttctagtttaattgttatggagaaatcatcttcctgtatagattaaaattcaatcttttttgaactcaaagaaaaatttggagggaaagataaatattaatgatggattatctaatatttgttccaatctcaacatgttttacttctcatagccttttatcttccagataaaattatgagcgcagatgtatagacatttaaaatgtgattttaaaaatgtataatgcttttaactttcctcatgtaagacttgtctatagggctctggatgtgtgagcaggctgcctggaacctcctagcctgctggttcctttactcctcccatatccaactgactcatagcttagtgaacagttttttgtttttgttttttctttaaattttgccttctttctggagtattttcaaaaatctccttgtgtatatattggaatatttttagctgttacctaagtacttaatttctttatatagtaggtcatgcagacagaattctgcaatacatacaaatttgtatctcccctcctcaaactagtccctctgagttaaacaaagtagttactataatttccttgggatttttatctcttaaaagtatgctatgcttagtggtatgtatataattcagtaatagtctgttttaatttttatataaggtttttctttaatattttaactgttgcttattaaataaaacccatttgtaataaaaacagagttaagtataatcagtgttcccccaaatcaacgtatctctcttgtacaatttctcatcatattgggtaagggaaaatgtgatttttggcgtatctgtgatttctgaaggaaaggggtttctctgtagaacacaatgtgcttattctttttcactttaacactggtatctattaatggctaatgagctccattaggtttaatcaacatttcagcaatttttgacttgaattttgtttaaactttctgctttgtcttttaccttttgttctttattacgttagctcatttaatttttatacgtaggataaaacatacactttgaaatggcctcagaatttgaaagtatggctgtaaagggtgaaatcactgatgttaagggaacataactaataatggtcattgacgtacggatgactagaaaggccagttgtaattcgtgtttaaaaaattactatatcatcttcaaagatttatttatttatttttgttccttttcttggtgtggtttgtgtgttgatgggtggtgaatttggaggaaagaaatgagtcttgagaaaataccttggtcattcattcttaatatgtttagagaatagcaaactttcagcatattttattgagatcaaaagtagcatgtgaaattagacaatgaaatgtcaatttttgtattagtttcctggggctgttgtcacaaagtaccaaaaactgtgctgcttaaacaataggaatgcattgtcccacagttctggaggctgcaagtcgaagatcaaggtgtcagcaagttggttctttctgagggctgcgagggaaaatctattctgtgcctctctcctagcttttggggactcaagcattccttggcttgtaatggcattcttcccatgcctctttttatatgtctgtctctgaatccaaatttcttttttataaagacacagacatattggattggaacctagcctaatgactccaacttgatcatcagcaatgaccctattttcaaataaggtcatgtttattcacactgaggattagaactgcaaatatgtttttttttaggggggacacaattcaacccataagaattctgaaactttgttttgtccttttttgattagtgttaatacattttcagagtactttatattctcagggcttagaataagacaaagtaagattattcattcgagtatactgggttatttagtaagaaaatggactgagatttcataatgaactctctgctgatattgacatgaaaactagcacattttaaggattcacctatctacatttacatgaaatcaatgttcttataaccttctgacatttacttacctttttgtatttacttatatacttaattttgcttttaagtattattactatctttaatgcatttgtgctcttttttaatatggcaggctatggagtacaaagatttgtgtttttctggattagcaaaaaataaaacaaaactgtaaatccaatcattcagatgagttctttggaacaactgaggagtctgtggcctgaccaacaagactaaggaccttacttcactactatttggatgccacggcttgaggttttgttaatattttagtgtttctcctaataaaatccaagggatagttgttcttttagagcacatttataaattcttattttagcctatcgctgatagacctttaaaaatatattgccttgacatttatattgatagagcatatattagtctgttttcacactgctataaagaactgcctgagactgggtaatttataaaggaaagagctgtaattggctcacagttctacatggctggggaggcctcgggaaacttacaatcatggtggaaggtgaaggggaagcaatgcaccttcttcgcaaggtggcaggaaggagaatgaacacaggaggaactgcctaacactttaaaaccatcagatctcttgagaactcactatcatgagaatagcatggggaagccatccccatgattcaattacatccacttggtgtctcccttgacacatcggaatcatggggattacaattcaagatgagattttgagtggggacacagccaaaccatatcagagggatacattcattaagattaacaattcttacttcccagtgtatatgttcctcatgtttttaaaaaggaaaatatgatagatgtggtgatttagaaactggctgcttctatgtggttcacctaatccaagatttttgcttatttgtttgtttttttgagacagagtcttgctctgtcacctgtgctggagtgcagtggtgcaatctcaatccactgcaacccccgccttccaggttcaagcaattctcatgcgtcagcctcccaggtagctgggattacaggcatgtgccaccacatctggctagtttttgtatttttagtagagatggggtttcaccctgttggccaggctggtctccagcttctggcctcaagtgacctgcctgccttggcctcccaaagtgttgggattacaggcatgagtcaccacgcttggcttaatcacagatattaaaatcacatgtttgtttgagagttagagatacgtgtagagactttcaaagcattacttgaatttttttcatagttttttaaaactttgtttctaattattgaaataatcaatgcttactgaacaaatcttaaaaaataaagagaagtatgtgaagagaagtacttaaaatccaagcataatataatattaaatttgactggcgtagtgtctatctgtgagtgtgtgttcacatgcctatgtgtagaactaaagaataatttaaataaattatgacttatacaaatgtgaatgaatgtatgcccaaaattccatttaactgattgattaatgagggaaccagtaagatgttacaactgattcaaatgagaagttaaagtatcacatacatttaaagtcagaaaagaagtgctaaatgaatttacaaaaaggtgcataaggctggacacggtggctcatgcctgtaatcccagcaatttgggaggctgagataggcagatcacttgaggtcaagagtttgagaccagcctggtcaacatggtgaaaccctgtctctactaaaaaaaaaaaaaaaaaaaaaaaaaaattaattccagctacttgggaggctgaggtgggggaattgcttgaacccaggaggcagaagttgtagcgagccaagattgcgccactgcactccagcctgggcaacagagagagactcaggcttaagaaaaaataaaaaataaaataaaaaaagtggtcagtttctacaaggcaatattcaattgcattccaatggatacaacatccatttctatttttgttatttttctgttagtaaatgagattgctgtcagtttctattattttcagagttgtaaaatggctcaaagacaataaaagccagagaaatgcatgagctagtcagggaacctactaatttgtcatgttttttctttttgcccattttgaagtttttcacacagtttttaatacagctcatattgatatatattctcatcagttggaattatgtttttatgtttcttcacatagagcaaatataattaaaaataaaagcataatgcatattccttcctattgacattgatactatctatagcgttacccaggagcattatgaaatgcacaacacttaaaaccaaataaaacaaaaataccctttccttgagctctttactcttggggggcaagaggggcactatattatcctttttaccttcttcctcccagtcaacctctctctttttcacgtactctaccaacatccccacccaatctccccttatgcctccaaaattagtcctatcctgattgtggagtttggggttttctttgattcaatggatgataccagtcacaccatttgaaaaaagcatatgacagtgttgttcagtgttggtgaacaggaattcttgatatttatttttaaggattccatttaattgctaattacagatctttgttaaattaagccgaccttcactcacatttaaaaaatttaactttgttttggttttcatgagacaaatatctctctttaagtgaacaagcttttaaaagaattagcttcttcagtatggaaagcaagatgcaattcgcagctggtgcaatggcttacaccagtatgtaatcccagcactatgggaggccgagggggaagaatcccttgaacccaggagttcaagcccgggctgagtgacacagtgagacatctttacaacaacaacaacaaaaacaaaataacaataacaacaaataattacctcagcctctcgagtatactgtaggtacaaagccaccacgtgtacctgtagtcccagctactcgagaggctgaatagagggattgcttgagcctgggaggttgaggctgccgtgagctgtaattgcaccactatactgcagtctgggcaagagtgagtccctgtctccaaaaaaaaaaaaaaaagagaaaaagaagcagttcccctaatgattctggatcattatgccagaagtatccaggttcaaagcgatattttatattttagtaagtagttttcactaataattcttcagcaatcaacgaataattcttctggaatacatcaattgtttgagaatcataaaagagatttccaaataccgtactccaaaatcagtaacacactctgaatctgaattgggctatgtaaatgtcttcagtttacagttaagtatagatttttacttgcagttattttctcttagtcatttctttccttcattaaggacttcgtattttattttcatttgcgtgcatggacaagagaatggatgcattcattttgttgtttctagagatgaatacagaaaatgcctagtgaagactgagtctggctgtgatttacaaagttggagcgttatagccagtaagcctgtcaggcagcccctgacagcagaagcaagtcttgaggtgggcatgagaaatgacagccttctttatgccagagtcttattaccattttgatttaaaaaacattgttttgggtctcagtaaactattgtagccatgaaaatgagataaaataactatttggtttgtcctatgtatattctatatatgaaaggaagaaaaatcagtacatggctatcagtctctacagaggaggggaaataatttgtgcttagatatattaatgcctaactgatgttttatatatgtgatcataagatatgtcatttacttaaaatttatagttaatccccttttttgcctcacctacagacaaaatggctttattccagcaaaattaagtcagaaaataatgttcactgatttagatgttgatgacagatgggtcttaggtcaggataacagctatggctgggagacattgattgttaacatttatgccccaataatgaatgacctgaatttttcccacatgtttgctcaggaaacacagggctgtggaggtcttgacgtcatagaggcagaaggatttggggccagagtatattcactgctggcagtcattcattagtaaatccttggtaagagagttggatttgagtgacatctggaggctttctatacctagagatgggggagttctgggtttgtatttttttctggtaagctagattcatcttttaggaaataccatatatataattgatgggtttaacatttcacattgagaggaggtgaaagattgaaagaattgaagaagaaagattgagtttgtatgattttttcccctgaatgaatttggttaatttagtgttaggtgctaatataaaacattgcttgagccatgtagtgtcaggaaaacatatctgttattagttcttggttgccatttaaaaatggagattgaaatttcctttacctagcaggaaaattacaacagtgatccttgaatatttggaaaggacacatacattccaaagtgtctagtgatgaggcaaaattgttcatattgaattcctttttcttgctcaaggccatttctggaggaaacttgtaatattggagaagttacatgagcacattgtgtttgctgcatggaaaggagaatataaggcttctcagcacagtggctaagcagatcaagagttgaggttaggttagcaatcatgaggctgaggtgcaacttagactccagtcccctataaaatataccttatagagtttagagatttgatgcaattcaaagcaaatttactatattgaacatcagcaatgtcccaaagaagaccataaaattctgtggtggttaaaatctgttgtttaaacattagaagtataatattaaacatttctttctgttggttctcgtcccattagaagagctagatcctaatagctctttggtaccttatcaaaacaggagaaacaataatttaatgatcctttaatccaggggtggtggctcatacctgtgatttcagttatttgggaggcccaggatcacttgaggccggggagtttgagaccagtctgggcaacatagtgagaccccgtctgtaccaaataaaaattagccagatatgacggtatgtgcctgtagtcctagctactcaggaggctgaggcaggaggattacttgagcccaggagtttgaggcccactgtaatctagcctgggaaacagagtgagcctgactcaaaaaaatcctttaatacttttctattcaagaatttttcttttcagtccaagaagatcaatatgttaccaacaaagcaatttcccatcaaaatggcatctttgccgattcagtgccacaaaaccaatacccaaaccgaaagtgaacatctagcagtgcaggctttattgatggcatgggattgagaagctcaagagagctgggaagtcacagaaacaggcatctctaatgaaagggttgggtattaaaaataaggggacgaacattcgtgttttcttctgggaacgggcagagaactcctcaaaaccagagtgctgccttccctcccccaccttttgtttcaatgggttgttgtcatggtgattgtaaactgtcatggtgctgtgaggtgtatcatttagcatgaaaattagattataatgaagttagagtttcttcagaggtcaagaaagctgccatctttggatcccgctagtcttggccagtttggtcactagggggacttttgacctcaggtgtcccatttttaaagataaacagagttaaggaaggatagaaattcacctatgtcatgtaggcatcatactgggtaacaaacctgcaacacattgtctagacctctgtgttagagaatgattattcatactttatggaaagaccttgtagttaagattgtcaagtaatatttaactacaaagtggattgtctgccttagctaggttactctaccggtataatcgaatctctttacagtagtagttagtagtagtaagtagtgtccaatgttactgcgtttttgtttgagaaataataaaattcaaatgttgtagaactataaaatatacagatttaaattccctgttgtaatcttacttcccagagaaaattcctgacgataatttagtacagagagtttttttttgaggcagagtctcgccgtgttgcccaggctggagtgtagtggtgcgatctcagctcactgcaacctccatctcccacgttgaagctattcttatgcctcagccttctgagtagctgggattacacgtgtgcatcaccacgtccagccaattcttgtgtttttagtagagatggggtttcaccacgttgtccaagctggtctcaaactccttacctcaagtgatcctcctcccacctcgccctcacaaagtgctgggattacaagtgtgagccactgcagcagtcctagtagtctttcaatactaaaatgacacatagaccagcatagtgggggaggcaggaagtattgcagggtgagtagaagcacagcacagcctctggagccacagtgtctgggttcgaatcctgtctgctattgtatgagtcacagtctgggcaggaaatagatgactcaggggtcattgaagactttgaggaagtacctagttatagaagtattaagaaaagcaacaaggaatgatgaggcaacctgggtgcccaaaaagtgaaagtggttatcactaggaccaaaggcacgaggagagggaggtgtaactgagacccagtgagagcagtacctgtgggaaaggggctactgaacaggagctgtggctatgggtagagaaatgcagccactattggattacgctgctgcactgagcaggtgggggcagggcagcgaggggtgattataaatactcacctcaacctcctttcttttattccacactcactgatggttactgtcatgggctgaatcctaacaagatccatggactccagaatccaggtgttgtaatttgtaaaatcagcctctttagggcagaggaaaaggaaggagatgagtaagggtggggtggtggtggcgggaataaagacttacaagcaaaaagcaaaaacacttactagctgtgtttgctagcaaggcactgtgtttcctagtaactcctgtgctttattttccttattgatttaaagaggagaataatagaaccaataatatagggttattatgagagttaaataagttaatatgtatgaaatgtgtaggtgagtaccacctgtatagaaattagtcagcaaatattgtcaatagtatcattaacactttatagattaattcatttatgaattatgaattaattttacatgcaccttttagctgtttctgatttttacttagcagtgtatcttgatcacctccttctctgtctgtatatgtacatatacatatatggacagtcagccctctgtatctgtgtgttctgcctttgtggattcaaccaattgtgaatagaaaatattagaaaaaataacagtacaacaataaaataatataaataaaaatagaacttacatagcatttacattatattatgtattttaagtaatccagagatgatttaaagcatatgaaaggatgtgtataggttatgtgcacatactatgctatttatctatgagggtcctagagcaaattcccctgagataccaagggttgactatatgtacatatacagacacacaaacacacacagatgtgcctcacttctctctctctccacacattcacactcacacccattcacaaactacttttcttttttttttgaggtggagttttgctcttgttgccaaggctgcagtacaatggcgcaacctaagctcaccgcagcctccgactcccaggttcaagcaattctactgcctcagcctaccaagtagctgggactacaggcatgcgccaccaagcccagctaattttgtatttttagtagagacagggtttctccatgttggtcaggctggtctcgaactcctgacctcaggtgatccgcctgcctcgacctcccaaagtgttgggattacaggcgtgagccagcacgcctggccgcaaactacttttcaatggcttcagagtattccaatgtatggatataccagaatacacttaaacctttctgtttacaaggggattcagactattttcagtattttaccattatgcacaatgctgtagtaacatttgaacttctaacctctaattttggattcaagtgaagcaagtgagttttgtgtattttgagtcatctagattaagttgtcttcaggccgctctctgatgagaaggaatgtaaatgagtgacattagtacaaatattcaagtggctgaagccttttatttttcttggtcctaacccaattcaattttatagagaaaaagtttatagagtttttacatgacctttaactttattgaagaagagcttttaaaatattttcttgataccaccatatgccctgcacttaggtttcatattgtttatgaaaatattgatagctgtgtaatcaaattcagggccaaatattttcagtgtttgattttattgtaatgtggtcagagaaacataattataggtgagtgacttgaaactcatgctgtgtgtaggtacatttcttaacagaataatgtatctcgtgagtgttatgtatgtgtgtctctgtgtgtgtttgtgtgtctctgtgttgtgtgtgtgtatagttttgtcctcaaacttatttctccttacatgataaattatgactttcctttcctatggaataaatgttaccagttcaagttgaccaagtgtgaaaacaagtgacatttatttcctgctttcctacttctgggcagaattggagtggaaagtaatacatgtcgttctgcactgaaatatttaggactattttgccctgtagtagacaatttaggcttaataaaaaggtttccatccagtgtttgctaaaggtaattgaagagaattggagaaaataatattttaaacaattccgcaaaaaaaaaaaaaatacataaatagaagccctatgttttgatggcattgatggcagtctgttctaaattcagtacaactgtgtttcatcagataagttacttagcacaaatgtgattcatgtaaagaaaccgattctgaatcattatttatttatttaaacatagtgtctgtctaaaatcattcaatttgagaattcttccatatggacagtggacaagagaatgttccatgaatttttatatactctcctttgccctaagtctgcctgtttgaaatgtgttcaatcaatgcctgcttggagttctgctatcctcttctttcctctcctgttttcttgaccattcttcttgtggtcaccaatacaagttctgttcatctagttgtctgggctctggcttgaacctttattgctggcacttagcataacagctaaatacttaaaatgctttcattataccagattttggatttctttaatttgtgaccacaagctcagtgttttgaaaggtagaatcatacaaagaaacaactataatctaattaacctaagataagtagttaatgttttatgtgtcttcatcattttatatattttacatagaacaatatacttaattttgaatattccttttaaacttgtctgtttcacaggcatttttttctgtattaagttttcaaaaacatttttaatggtcatgtgccaatttttttctatggctattacataacattctctcttgttagacatttttgttgttttcgacttttccctactacaattaataatgacatgaaaagttttgtataaaacacttcaagttgcagaacatctctttacagaatattcctagaagtggaattattaggccaaatggtaggaatacttttaagctttctgtatatgttgccagattgctttttaagaaggttgtaccaatttacactcccactagcaatgtaggagagtgcctggtaactttttaattggatttctttgataagaaactaaatggacaacatttaactgttcatcaaaaagagagaggagtttgttgaatttctgttattgcactaaaggaattctacatgttaaaataaatcatttaatttttattctcattgtcatcagactataataatactgaatttgattcacatttccccctctttcgtactcttaatgtcagtacaaataagcaaaggttacagaatactgtgagaaatggtgagaaatgggagctgattctgtgctacttactcaagaaatcatgtgctgttctgtgcacactatctgtctcatcagtaaggaggaaagagatagatgagtgcctgataccaattaagtattccatatgtttgatgtgtggatgcataaatgaagtgatgaagtgataagctcaaaaacctgctattattgaaaggccagagccatcctttgccattgtggtataagtggacaagcccccttacacagatgaaaacatggttggctagttaccattatgctccttagaacttgttcaagaggacttcaggtcactgtagtagaaccacctccacaaacaaaccaacacaattctcagagatctgacgtgacagctctgattcctgatgttctcatggacctgggtactccacatcccaccccccaccgccaccccgcaacaccccgaattctctctctgctacctcatgggccaaattcttttgggatccatactaagaatttattttggctcttatcaatgagctgtccacgttccgttgttggaattcatccaaaattaagtgcctgacttcagggtttaagaagtatacttttttagattttgctttgctttgctatgttggatagaaaagatattggtactgaactttagcttctatctttcacgaatatgggctttgtgctcaaagagaaaagtcttcaaccatggctgcaggattttttaaaatataggacaaataaatatatactatatgaaagtgacagagaaagttgaacagattccagaagagtgtaatttatcttactaatgatgctcttagcagggagatgaactcaggaaacataagagaagttccatgaggacgccttgtacttgaattccacttgctgtagtatctcaaagtttcagcgttatcttgggtgtttatgttacgtgttgaagtgggcgcttattctataatggaagctatattattagatccttcttctcaaaaagccagtcaaatcgctttaatgaaaactgtaagtagttgtgctctaaagaggatgcaattatttaggaaacattctcataagatttaaaccaaaagcaacttaatgtgattctgatacaactgattaagtactttatagttgtcaatcccagaaacataacttatctcaattgaaaaatgtatataacagatagtaatttttataatttattacaattgttatatgaagtcatatttaaattataataaattatatataaactgattatttgaaatgtaatgagttcttcataatctcttaactgaatggagggctgtattctaagagtctcctctattttaatgttaacaagataaagtcttgggcaggtgtttctgctataacgtgattttaaagtttttaaaaaacataggttctacaaattgtgccctaaaaaaaaaaacaggatcatgagaaaacataataattctaaccaaaataatagtggcattagaaagatatgttagtacaaataaataaataaataactgatatagtcaatataaacctaatcatagaaaaagaaaagatgaaggtggattattcaaaagagatggaaagaagagttcagagggtggcaaatgcaaaatgcatcaaaatcaggaaaacaaacattgggtatttccaattagagactcattgatcaaatagaacaaagaagaatactgtgcaggtaaggtttatggattactctatatattactctttgccctgttctgttcaattgtgttagtatactttatgttctgctgctgtgatgactttgtgattaaacattaaccagctctcagggagtggggaggaaatcatgtaagtcaatatatcttttgctatcccactgtttaccaattgcgtatgagctaattaactatgcagaaatgtgttatagcagaaaagatttagtagtgttatacggtaggctaaaaggagtactggttagaaaaattatcaaactatatcctatcatttttccatttatccatatcaagcattttccactataatctctgttatgtaaactggtaactatacctatgttgttaaaggaaaatttaccctaatgttaaataatataaaatcccaagtctcatagattggtgggcattgtggaacttgcagattaaaatataccgcccacccccccaactgaaggaaatgtaggaactctgtatagtcagccttctgtatccctggattctacatccatggattcaaccaacctcagatggaaaatatattcaagaaaaaaagtgagtgagtgtgtctgaactgaacatgtgcagactttaaatcattattccctagacagcagactataccaactatttacatagcatttacattgaattaggtattataagttatctagagatgatttaaagtgaacgggagaatgtgcataggttatatgcaaatactataccattttatatcagggacttgagcatccctggattttggtgtctacagggtcctggaaccaatctgccatggatatcaagagatgactgtattctgtaactcttttctgtatctcagattatttcaacataagtttttttaaaaaggcgtttacttcttcaagctttgtcttacaggtagaacctatctcttactggtagaacctataaaattgaacattttttcacagataaagagtataatgatggaaatgtttcttttcctgtttttctttttctctttccttgctttctttccttccttcttcctctgcccctctgcctcagtatggatgcaaaaaggaacagcagtaaaggcaagaatgtaaagtcattgatgcctcaaattgtcatgaaagagaaggaccaatgatcatctgtatgttatactttttggtagaaaattggcatatgcatgtgtttttgcacttttggggccatggaaagtaaggattaaaaaattatatcctgtggagtctgagatgggtcctgttgtgtgctctgacatcagcaaccctgtgaccttggacaatttacttagtctaacggttctacagtttcacatttatatggtagattgaagaccatactcctgtagaattgttgggaagattataagaggaaatacttgtaaaatgcttaacgttgtgcctaaggtgcaatagtgtctcattggctactgtggacttgtttgaaattattaatctttagtcatctttgtatatcatttccatggacccttacaaaatggttagagatatgcagtgaatagagagactttcataaggatgccgattacaatttgactgtggattgtgcccgaggttgttccttgtatctgttttagaatttataataacaaaaatgaaattaacaaattgatttttatgatataacatatatttaagggtcaactgttagtattcatataattagactaatgatgcaaaaacaaacattttaaacaaacctttcttattaaccttgttcaagttaataagatccagtaataatgtcatccaagtagtgtacattttttctttctctccaccccgattctgctacctttacatatattcaattttcttgttattttattgaagtacaatttgtatgcactaatgcacaagtcttaaatgtacggttcaattagtttggccaatgtatataacctgcatatattttctcagctcatattactagttcctttattataattaacagcatgcaacacattctgagtggtaacgaaggtcaaatgtatgtggggcattttagctgtacgcttgttaatcctcacaaccccacctgtttcctactattattctaattttactgataagagctgagtttaacaagattaaatgacttgctgagggcaccagcaaagcctaccttaaaacacaagcttgggcccttaaccagcatactacactgtatctccttcactgccgaagaagcaagagtctctgccannnnnnnnnnnnnnnnnnnnnnnnnnnnnnnnnnnnnnnnnnnnnnnnnnnnnnnnnnnnnnnnnnnnnnnnnnnnnnncgtattagatatgataaagtagaatacatcaagtagcaaaatattctaattcgaatttagtgcattttatcttacttggaatattattgtctattatttttaactgatggcaatacattttgatgctcaaatagcattttgtgtacattgttaaaaagaaaaagatgattatctttatactctgaagagaatacttacctatattactgaaaaacagttcataaatctaaacttagttctctaatcattttttatttagacttcaaatattttcttccatgtgatatcctttaaaatgttttcttttctttcttcaggattttttttctatgtttgttatttgggtcattcttcagccaagttgctaagcagaaatctgtaaagtagtagtttaatcaaatatgttcctcaagttgttttaaaaatatgtatatttgtatcttgctgcaggacttctctaattttttaaaaaattgatcgatgtgtaagaggctttcattctttctttctttttttttttttttttgagacaaggtcttgctctgttgcccaggctggagtacagtggcgccatctcagctcactgcagcctcgacctcctgggttcaagcaatcctcctgactcagtccctgaagtagctggaactacaagtgtgcgctactatgcccagctaatttttgtatttttagtaaagatggggtgtcatcatgttgcccaggctggccctgaactcctgagctcaagcaatctgcccacctcggtctcccaaagtgctagaattataggcatgagccccggcagctggccaaggcttttattctttccctgtagagaatttataagtattacagctaaacaagaaaataacgtactaatgtggattcatggttcaggcatacaagttttttctcttaatactaggttctctcaattctgtgaacaaggagttgtactacttttctctttgggcttatgaaacatctagaataattaaatcagaaaagggaaaatatttgttaagtcaaaggaagtattttcttcatctttgtaaacataagtctctacagcaccgtaatccatataacctcagcgtcaagtcagattttttttattgcctgaaaactgctaagtgaacacattatatgtaaaattaaagtagtggaagtatacatgattgagcatttaaactggttatatgcaatattactactctaaatagaaataaaattattctgacaaccttgtttgtgccaagtttttggttatttaaaaggagtaaaactttctatttacttcaatagacgtgatgtgaaattattcgtagagcgaggtagttaaattttgtttgcttgtttgcttaccaaatcataccaaaagagttactttttgttcatttaatgagtacttataaaaaatgaagctattttttagtgattgtaaatatttaagtgatcattccagactattttgcaaaattcaagttagtttgatgctgtagtaatacaatcaaaaaaggattctagattttgagaacaaagataatagaaatgattgcatcatgcttttgatgtatcaatttagcacattaagctgtcattattccagtcttatgctaaataacaccccacttcatgcagtgcatcctgatatgatattaaatatatacagactcattctgatttttataaactgtatttgttaagctttccaatttgtatgaatgaactttgaagcactggggaatacggataattgttcactaatttacaaatgatacttcacagagtaatattaatccaaaagataataatcacatatattttgtgaggctatagaggaggctaataccttagatgtattttgtatgaattactgtatcagttaggtacttcctattaaatcacgtgactgactccattcccagatggtagattttcagttttatagattagcaggtctaggaaagagtaaggttcagctgaatgctactgatcacttccaacttctttttattatctaaaatgtatcacttaaggtatgagtctcacaatcatacagaaaagtatatttagtcaaaaggatggctagtatggttagactttaaaggaaccattggaatgaatccccgctacctagaaaactcttctactaggatatatgcctatgacttaatctgtcatcttatttgctcataattcaaatgttccttgccagaaatacctttcctgaagtagttcccccaaaaaatgtttgtctgtagtctgtcttccttactagagtgtgatcaggtcagggactttccctacttggttcacctagagcaggtctagcaaatagaatgcatgtgtatttgtctatggaatacatgactgaaaaagtgagtgactatagaggtaaaaagaagttttaacatcatccaatctaacctttccagtttatatcaaggaaactaagactatgtataaaggaaactaatggttaactgaattcctcaattatttccatggattgaggaaataaataccagaatcacagttcagtgcttagggacacttcgggacattcactcctgccaatagaagatggttaagaagtggtgtttgggagctggacagacataactttggccagagtttgaatcctagctataccacttactagctatgtccctttgtgaaagatatttaatctttctaagtcattttcttcgactataaatggagatgatgcatatctcgttggattattgtgaagcctaaatgagatcatgtatcacagagcctggcacaaggaaaactgttatagctgtcattgtcattatcatcatgaccgtttagtccttatataaattatataggcatttaatccatgattttctatagtaccacggtagtattttttcccaaacttaatgtatttagaacttagttcaccacagatgatatatgaagtttatgaggttgatatgctagtttagaatactagataatactaatatgaaatttggtttctatactagtttataataccagttactattaaatactcatcaatctagtgtttctgatgcctggactttaacaggtattccatagaaagactacacttttatctgtaatagatttttgatataagaaggatgcaaattcagctacagaggttgaaactctgtggaaaaaaataattcaagataaaatgcttttttctcctcctcatcgatttttctatccacaatagaaaaattccatcagtcagaaaccattcaggagaagatatgggtaatgtcctagacatataaattatatagatgcatattgatcattcccctattatatagagtgatctaatttgaatttctattttttgagactagagtcagacgtaataatattattttaaaaaagttgtccagatgcatgttattatgtcataactaccttatttcaatacatttctgtgtttgatagttttgcttattttaggttctaattttaaaatatacatcatttttcatattctttagaatttataaaccaccctagaatttataaaccacctttaatgtgtcatcattaaattgtagctttcaaatgtaacagaatctgtaatttactgttacaattagaagatatgaatcaattccttagcttaaaattttttgttgaaaaagaaaataccatgacaactgactgtcttcagaatcatctagggctgattgattcataatctaaatttagggattgttcatatcagaatctaaggaggacttcacgttgcattcattttgttaattcagcaaaagtagtactagttagatctgggaaagtggatgttaaactttatgaatgccagactggattatagttttctcatttgtacagttagcttaatgatttctaaaaccttttttcctttattttccttttccttctcctgttactctgttggtattctgcatgcagataaacatgtgtatctacatgtaacatgtacacagaagccaattcatatatgtgaaaaagctattcactcctgaccacagagagcatgtcttagttttctttaatcctgaatgctggagtctgatacattttagactttcagtgaatatttcttgaataaattttaaaatatctctacatctattaaagagaccatattcttctaagatgactgtattagttatctattgctgctattacaaattactgtaaactttaatggcattaaaaaccacaaatttattaattttataattctatataactatacagaactgtaggtcagaagtctgacatggaccatacggagctaaaatcaaggtgctggcaaggtctcattcctttctcaagtatctgagagggatctgtttccttgccttttccagcttctagaggctgcccaagttccttggcttgcgaccctctttctccagtttcaaagctggcaaaggtgagttgattccttctcacatcacatcactataatttctaccatcttcacgtctctcactattaactctggccctcctgcctcttcttataagtaccttgtgataacattgggcccacccagaaaatcaggatcattgctctaactcaacatccttaatcgcatctgcaaagtaacttttgccatgtacgataacttattcacaaattctagggtttagaacatggacatctttgggggctgtttttctgccaggcactctgagtgtatgccagtagctgaaagcaccagaggtcttttccttgtaattatacagggaagttgcttttttgcttagcaaatacaagtgcttaggccaaacctgtctgaggttttagctcaaagagaagtgctccattcttttaagtttagatttcattccaaatgtgtaaccagcaattactttctatagtcctatatttatggcctattacttgagatcctggtacagtaaattcataatgcattaggtcattagacaatgacagggttctgtgtggtacatggccaattttttggaacttgacctaggagtctccttttctcctactgttaactttgcaatctcttatgaatcattgtttttgtcactgtacctcatttgctcatctatagattgcaaatgatcactcaatctaattcaactgctagactagtaagatcacaatgaaaaatgttctataaagtgtagagctctctttccatatgtggtacatttttaggtcctctcaagggggctcttttgtactgaagtgttttatttactttaatgtaagcatgtgccatggtgaatctttgcacattactgaaaagaactcagtgtttaataaaatcatacctagcactgcctcaaatgttaagctttctggtaaattagacaaagcagatttatcatgccatttcttttttgaatggcagtgttagtccaagttcctgttgatggtctcactattctttccatagttctgttacataaatgtgaaactttaatacctaaataattctaaatatatttttaatgaggaagtcttcaggacagtggttttccaagttattttgtagcagaaggctttttgcaagaaaatatttttgtatatggcagcatggagctgccatatacaaaacaaatatatgtggagctactctggttgtataaggtgataaggcgccaagtccattggttagtgcccccaaaacacatattccagtgtctgctaacttcactggtttctagggaccatagtgggtttcagtggatagggctatttatttggaaaatatttaataagtattgaaatatgccaaataatatatattagggtcaaggagctatgggaactctaaaggaaggtgtgtgtgtgtgtgtgtgtgtgtatgtgtgtgtagcaggttaaacaaatgagttctccaaaaatttattttgtaaatgttaatgctaagtcagtgtttattctctgagctaacctcacctataaaactgtaacccatgtgaaaattaacacttcagattgtttccttggaagttatactatacatttaaaaaacaggtgttttatatgttgtttctataataatatgcactatacacacagtatttcattccagtataacagtctgtataattttgaaatttttttctgcatctgtcccccacaaacagagaatagaggctgtggtgttgggcatttaatgtatgaatgagtacatgaaacatttttattaatcatcttatgaaaggattattttgcaagaattttttgtcataacatgtagattagtttgtaataagaatcttataattgtattttttctcaaacttgatatattttgtagtcatttataattttatagacgaatttataatttggctcatacatatcttcagaaatgatatttgatacgttaacctggttaattgtctaagatgtgcatcttgtgtaactatgaatatacataaaatggataagagaagtaacatgaaacttctaaggaaagtatttggtaagagagagaattctatttgtttttgaaaaattatggcatcaagttaattcattatttttatgtaatgttttagagaaattgatcacttaatgtttcatatatgtacaaaatttagctcacatttgtcatcaaaataaagtattttgtgagaaacaggtcatttttcaagaagactacttatttagtaaataaaaccataaaatattttaaagattttggttggaattttaaaagactgtgtatatttttattctttataaaaggttattaaatttagttttaaacttaattcacataaagggtatttattatgatccggggggtaattgtgcacagttccgcattcactttttggatttatttttttcccctcatcccagaagccagaatgtaagctacatttctgtttgtattggacctttgagagactatgctacatagctaatggaaaaacctgcatacgagtccaagttctgcctcttctaaaattcattaccataaaggaagttggttagccacagggagtttcttaggctttctcagtttgatttcttagtccctagaaagttcaagtctgtaaaaactagaagtttttataaggaagttatgagaagtaaatgacaaggtatttgaaagtacatgacattgtgtatggcatatgttaattgaccagtgaatgctttacatcccttgatctcttaactagaaattaagtggcagactgataactcctaagttcatatcgacagcttcccctcttctgaattccacactcatatatccaattgcaataattggcttcttgacttagatacctaacagacgcctcatactccaaatgtgccaaatggaacttccaattattgcctccaaatctgctccatcctttctaacagctgatggcaactccaaccttccgcttactctgtcagaaatcctgaaggcatctctgactcccctttctctgttacacctcacatccaatctaccattagttcaacttgctaaataatccagaatctggtaacttctcaccatctctgctgctacaactctagccaggctggcatcatgcctagctctgattactacagaaacctcgtagctgttctctcggcttccacctctccttcctcactgtgtattcacaacataaattagcccgagtgatcctttcagaacctgagtcagttaatgtcactcctctgctcaaaaccctccaatggctcccgtgttagaccttacagttgcctacatggcctgtgcaattaggctcttttgtctttgtcattacctcatctctcattacctttctcctcacttactccaatgcagctatacttatccttaccattctttgtgtatgccaggcacattctcattgcactggctgttttctttgcctggaccactttgtccccagttatccccatagctcacttcctctctgcctgtgtcttcaagtttttgattaaatgcaacttctatgtacctgatccctcccgcaggactcccatttcaaatggaaaccccaccccccataataccagccctctttatgatactctaaagcactcatcttctaacacatgctaaaatttactcatatataatttttttcacttgaatttgagctctacaatgttacctggtttgttttttttttttagttttgtcctctgatatttcccaatcatctagaacagtgtctggtacataatagttgctcaatgaatatttgtggaatgatttgagtaaacagcaatttgatcagaaaaaaatgcattcttagagttctttcatttcaagcagtattgcttatttaaaaggaatccatttagacgtcataccctttaaagtcggcagtttgaaatttggcaaacaacttgaaagcagcctagatgaagcggttagaatatggtggtagctttgcaattgtactacctgggatcgattcctatttttgccacataaaaagctcattgtgatgatcaattttctgattctttttgtgagctcaaatacttgaaataattaaccaagtagttgataccaaaaaaaaaaaatctgggtttctgggtttttgattgttttcttcagtacttttttttttaagcattaaaaatccatacatatgattattagttttattcttggagatgccattcttacaggttaaggaattatatctttaaatgagcaaaatttcattataatttgttgatgcatgtatttttcgtatatagccagcatttttccctcaccaacatgtgtattctgttaccgtatctcaaactgcccttcttatgctggatttgtgacattgtgcgtcatcaagagctgttctcagaaacgcagattcaattacgtctaacaaacaggccaaatatctaatctgccaccattacagctatattaatctgcttctatccagtagggccttggcttggattacagtaggaaacaccacatctgtgtccacagctgctgccttttaaacaggacccatagcatgatattctggacaagggccttttaaggtgtctagttttaggtgttgggcaaagcctttcctttagtgttctgggcttctagagcaccacccatttttccccttacagaatgttcactttctgtcttctgggtacccctacattagtttctgttgccctaattaagacctcttttccagaagcaatctattatttttgtccagtgagatctatttaccctagaagtgtttgttcttataccttaatttttaaagtttttgttcagtaaaaaacagatatgaataagttggtaggaaaactattttaaaagggtatttttggccctataaaaatcccagcaggtatctctgcctacttttttgttttataatgtctagctctgaaattattgtagcctctgttttctgtttgttaccagatgatattttaatgttttccttccggatgttaaatgtcttttcttctctttagtgccacttagaaaacttggaaataaacaaaaaatgaagctcatatatttttttaccactgtctagaaaccattactataatgctggtcttaattcatacttactagaattgggagatgtatttgacttactcataaatttgataggtggaaaaagtagcttatttattacgaagctgaaaatgtaatgttttttagccatttgtattttttctcatgaattgtcttctcatttacattttaaatattaatgatatttatatgataaaacatttcaaatgtgcttgacatacattaatatagttttcaaatggaaatttttaatcattttatggtagacattatttcatttaaaaaattctaaaatgggctttatttagatagcaacacattttatcagtattttcttctaaattttttcatttagcggatttttaacatagttctttaatacttttggaattcagttatacaaatggtagttgcatataataagcaaactgtgagtttttttctaaattgctatacaaatttgtcagccagtttaattgaataatgtatattcttttctgttggtatgtaatatattagatcaactaaaataatccactagaattagcaaactaggtagaaattgactatatttaattagagctagaagccagatagtacagtagagaaatggatggcagttcaaaattctggaatatgaagaaaaatagaaaaagagagaaatagcggaaagtagttttagagataaaaatctatatttgaaaaaagagagggacttgagtgtgtatgctgtggacaaattgagggctgagatggagaagttgaagacacaggatggattaggcaaaggattgatgaaactatatattggaaagggcaagaaaagggagtgtaactcccagatggatctgtcaacatggggtagagatgaatgctgtttccattgtagaaatagaagatacagagagttatggtgcaggtagatttgtaggtaggagggcctgaagttgaggaagattccataatatgtcctctgtttcttctataaattaagaagggaagcattctctgagagtgaagaggaaggaaggtcatacatgttatttatatgtcttctccttcattcatttgctcaaaaaaacacttattgaatgtttccatgtgccatgttctgtgttaagactagaagaagcaaccaaaaatgaagtgcacagtggagtctatcaaacaacttcagtcacgagtcagccaggcagccacatgatgaaaaggactctgtcacttctccactgcaacaactaagtcaccactgagtcaaaaataggatctgcttgactaggtgttgccagtttggggaaaacattttcagtttggttgatggcatcaaaatttaaaaaaaggcttcatgttgatacaagtgggtagatatgaaaccaggtgttaaaatatacacatatatttccttgctccgcatactgcagtgttcattgctacactccagcagcaaggatcatacccagcactgagatcgtgatttctaatacctttgcaaattgaaggaaccagagatctgtgaaaaagtggcttaatctagggctggttcaggaatatacgagaaaagcttggagtatcttttagtgcccataaattaggaagtgctcaaatacacacacacacacacacacacacacatacacacacacgatggtgatatgtcagttggacacaggagccaactgaaagagttcccaatggctaaacaacctaagaaacaaaatgaataatgtattagattataacccaaagtataaaataaatattcatgatcctgtactaatagaaatgattaaatagatgggctaaatagctgtctcttatgtaataaaattccaaatagcttatgtggatattgtcctccttaaggatgtatagtgtaactcgccattccttaagtgtgggctactcacagtggttccttccaaagagagacttgggcaaagtcttctcaggagagaaatgggcaaagagaaagagagactgcattggagaaaccttacagacactgcctcagccagatgatcaaggtgaccatcacaataagtggtgttgatagtatagacccataatatgatgtaattagaataccagtttgcctatgtggttgtctcctcaaaaatccataactccatcttatgaaaaaagttcagacaaacccatttgagggatattatagaatatacacgactagcattaaaaatgtaaaagtcatcaaaaacaaagtcagaaaaaattgtcagtcaggaggaacctgaggagacataaagacccaaatgtattataacatcctagataggaccctggaacaaataaaagacaatagataaaaactatatctgagtaaaatattggttgtgtgtaataatacgtcgctattggtccattagttataacaattgtactatgctaatataaaatgttaataacagaaaagtgaagggggctagtggagggggcacagtataagagactatgctatcttcaaaagtcttctgtaaaaagccatcctaaaataggaattttgtttaaaaaacaaaaaatccgctctgcaaattatacactctttaattattttgaagctgctcttataccaagagatgaagacaaatccaataagtactattttgatttgtcaaatgcccctttgtagaggccacggaagctgatggagtaatatctactgttgctttcatatctttcagcagaggaatcaggtaaaatagtcaacattttacaatgttattgcttggggtttaggaaatttcacctcccagaaaggttctatgtgcttatttttaattacacaatggaatatctggcagaacataagacattttaagctgtaagtagaatgattttccaggaatttctgagcatcttagagcctacatttaccattatcagaggcacctgagtactgcttcgtaaattgcaacttcgttacgttagatagtgtcctatttccatgagagtgatgacagattcagaagtgccaggctccaaggaagttgttcactgggagaaaaagactcaatgtaaagcatattatttattattattgtggtaacacctatcattatataaatataaccattcaataatgccgtattattcataatagaagtcacaagattcttatccattcttcgtactctgggcttcctatgagtaaatgtattttgttctttttgcagaattaagtaaacagaattatttctgctttgccaaaggatgttgtcaaaggcctgctcctcttctgcctatatatttttcttttaacataatgtatgcccttgagcagtgattctcagtctttcgtgttttacattttgtcacatgctatactgaaaaatttgggtcccactgtcatagaatcaaaccatgtttatagtcattcgatgcatatatgtttttatatttctaatataaatttatacgattttagcagtaaactatgttaatacagtacgttagaaatatttgtgggtgttgagtaaaaccagagaaaataggggatttggtaaaatattgtctatttcataatatctgctgactgacattgcaacatctctaaagagaatttgtttttgaaaggcagaaaataaactatttcatgagtaatagcagcttagcattgtctaacagctacaaaatccatcaatgacatatactttctctggagaaaggtgttagcccttgggatggttgtaagacaggttttgtctcattttccttaatctacaaactgttggatgtagttttcccagttgtattaatttctcatggaattcgtggaaatatacactaaaattactttagcattttcaagattttcagatttttttatgaccttttcatcagtgtcctatgttaggagattgtgttgatatgttatattaaactgtaaggaccacacaagcagttttgacacatctgatagagattccactgaagttttactgagatgattgaaacaatttagacagatttcagtcaatttatcagtcagtaggactttaaatgatgccattaaatgagattaaaatatttctgaatttaatactgccaacttaaagtactgttaactttttttggcttgtttcaattggaagaaaagaagaggtagtgaatataacacacatctggaactaagaaaactaatttgtaagtcccacctcctccgctaaccatctgtagtctgttacacttgcagtggcttccaaccttggctgcacattaaaataacatgggaataggtaaaaatcccagtgcccaggtttcaccctaaaataattaaatccacatctctggggtgagacacaggcattttatttttgtttgaaattttcaaagaagatatcaaaatttgcaaggcataatcaaataaggcaattaacatactttagcctatacctaatattttgcttgtttttagtttcaaatcatcctaggatattattgattactcaactgattgacatggtttgggaaataaggtattttgaaaggaaaaatgtcttctttttataaactgtacaggaaccttctattaaattctgtaaatgtcattgatctcaaatccatgcatcacatgtgtaaattatattatttgtgttgtgtttgaagtaaagcatgattgataacatttgatgtgaaaatatatgcaatggcagtaacgttatcatttctaaaagaacagaacccttgaagacaaagggtagaagtaatgtcagtcctgtttctacaatatttgagctatgtgaccttgagaaagtcatttaaactttctgattcttaattcccaggtctataattgttatactttagctttgcagttatagatttgttcagtgttaacatcacttgtatgaattataaacttattgttagttaaacatgctagaaaaagttgagagacagtgaagcataatagaaagcacatggtttttggaattgaatttggcttcccacattagttgtatcttactagctgtgtgactttggcatgtgacctaacccaagtttatgtaaaatggtttcaataacatgttcctgtcttagcccattttgtgctgctgtaacagaatacctgacactgggtaacttataaagaacagaaatttatttcaagaacagttctaaaagctagaaagttcaagattatgatatcagtatctgacaaggaccttcttgctgcatcatcacatggcagaagggcaaagaaagggcaagagggggccgaactcatcctttcataatggtatcaatcccagccatgagggtagagccctcagggcccgttcaactcttcaaattactacatcttaatactgttacaatggcatttaaatttcaacgtaagtttgaaggggacagatactcaaaccatagcactttattagaagttgttttaagaatttaatgagacaatatatgttaagggcctactgcctggcatatagtagatactgaagaaatggttgttgatagtgatgataatgtaatataccactaacatgttaaatgtgtttctgaatgcatgacctcagaatatatgtcaaatatatacactggttcctttttacaaaagcaagtgttaatgaatgagtgtaaaactccttagcttaaaaagtccactttacacatctataggtagtgatttgagaagttcctagaggacagttgatatggtgtgttagataaccacagattggaaatgctagccctctggacactcaaactttaactctggaaactgggttacactggaaagaatctacaataaactgaccttccacgggacacgtggagtattctaactaatgcagaaatccgaagcagactagagtatccctgatctccttagtggtgtagaatctcacactgtattatttatttatttatttatttatttatttatttatttatttatttattttgagacggagtctcgctctgtcgcccaggctggagtgcagtggcgggatctcggctcactgcaagctccgcctcccgggttcacgccattctcctgcctcagcctcccaggtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttttttttcagaacatgttggcttagtattctctgggcaggaggccatgccaaggaaagtttttgacctttcaaaacctcccaaaggtaatgggagaagtgataattattacggaaaatgtgaaagacaagcatacttttttttcatagattcttactcagactcattcaaaaagggatggattttgagtattcattttggtgaagtctctgaccttattagatagtgatacctcccaggtcttgctttatgtggggtcaattactgagccgttgatgaatttcatttatttcttgtttaatagagtggcacttaaaataagtggacatgtaaaagaaaaatagatttgcttgatttgtatctttcaaaatggtagtgaaacaatcctgtaatttacacgaccagttctacttcacatatattttaaatgtactatgatcaacatagtcattacctggcatgtagaatacctatacatttacacatgtaaaaaatgaagcctcaatgtctttggtttgtgctggatcatttctttcagggtatggcattctcaagttattttctaatgaggtttctttaaatttttcaagttgctttcactgcgattaatttaatagtgaatatgtttataaaagtctgattctagagacaggctctgaaccattatgctatggcctctttgactacaaaaatcaaacgtttttattttctaatttgttaagttaaatatttttctatgtagtgaagcttaactaattagagagaccagcaggaattgtaatgtcaccaatgtaatttacattgagataagttttattcaaaagaatgagctaaaatattttattctgtgaggctaaaaactataactaggatgaggaactcttttctcccaatacaaattatagaatttcaaagcaggaagagcatcttgttttacccctctttgtacagatgggaaaaagagccccaggagagcacaagatttgctcgtgtctcacaggcatttactgaatggcaaagttgccagtaaagccctgtagtttgactctgtcgacagcagaaatgtgttcttctatttcatactttccaatgcggttctagaaaatgataagtaattttgaaagttggtttattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataagcttctttataaaatttctgctgtgtttcctacagctccctcctatgacaaactgagtatttgtgatttaattctactggatgatttacttctactggatatccttaagattatatttatttacaaataagtaaaaatcactgaagtgggatcccctgggtttgttgttataaaacttattaattatcttaaatatcaggttttcctctcttcaggctcagtcagtaggtcagggaaatgtcatgtggggccattttctcttatccctgccactttgacaatggttgtcaaattagaatgtgcacaccaatctctcgctaacttgacaaatgcacattcctaggtcccaaccttaggattatgacttaataagcctgggatcctgaatgtagcccacagaaatccacttagtaacacccgtttacaaagagactcctaatctgcgtggtccaaggcacattttgagaaacactgactgtgctatgttcttttctggagacagacagggactcatgtctccctccttggcaacagctattctttcatgggtaattcctatgtactatttgaatatcaaaatatttatatctccctaagaatggggagacacaacgtatttgccccataagggtaaattgcaaacaaattgctccagtgcttcagaaaggactggttattcattcctgggactgctttataaagagagatcttctcaatattcaaatgtattacaggcatagaaaattttttgcatgaatatataaagactaagaatcagttctgttttttacagcctgagaggacatattttgaaagctttctaatccttgctatgacaatgactgaacttttagagggctcagagttagagcttcaaagatatttaataatggagaaaaaaaaaagattcatttgggagaagatctccaagtataaccaaatttatccctttacctgtggctaataaaataactgaattcaaaaagaaagcaaaagcaatatatattttgaatagaagactgctttttaaaattatgtaaactattctgtcattaaaaaaaagccttcctagtgttggattggagtatttccatatttggaaaccaagattaatagatgtttcagatccgaagtgtttgttcttccatctttttttcccccttttgcatgtaaaagagaatggtgaccaatttttttggtaaaagagttaataaatcacttaataatggatttaaatgaacagaggcataatcagatttttttaaaaaagacttttatttaattctccagacgcaacacttagatagaactttctgtactgatggatttttttatagctattgttgttgaatctggtagccacagtcacatgtggttattgcatccatgaagtgtaacctagtgtaactgaggaattgaattttttaaaatttgatttcatttcatttaattgaaattgctacatgtggcagatagtcattgtattgatctgtgttgctaaagaagattgtgtaaaatggttttcataactttggggtagcagttggcatttttatgagactaggaagtatatgattatgtagtgttgtagtttatgtgactaaatgtggctccttatggaggagttctttaactttgccatacttataaagatagttattatttattctctctacttatattttgaaagtccctctcttaaagcaagtagatatcatggagtgagtctggaaactcctgttacagaacaccaggagtggccaaattatgactggtgccccctggagttgtgcacacagagtctgtggctacccctataagctgagtcacatctcaaggcaatgtcatattcacttttatgtctacaatgcttggtatggaattgattactgacaaatctttgttaagtaaggaatatatatctcaattttgatatccgcaataataaaggatagtgaataaaaaatattttactatgtgctcatagaacacattgtatgaatttgccctttgatgtatatattcattaagttctacatttatgaagtacgctttgtggaaagtattaatttaagtatttaatacgaatataattcagacacagtatgtctactgctgattaatgaagaagggaatgtaaaaatatgtgctgcatcataaagtaactgcactaatgaacatatgtgcaagatgtagttcccaatagcaaaggaagagaaagggatttttgtttggttgattgattttctcagtcctgtggcagaacaaaaaaggcacatcagagaaggaaggctgccatcagggaaatgacttttgaggcgggttttggaagatgagctggagctagcagaggggtggtgaggaaagtaaggcctgtgctgctccaggtactttgctaagggacatcatctcacatcggttttctccatactcctccaacgtagatgtccttaatcctcatttcaatgatgatgcagctgattcggatttaaagaagtttgcctaaggtgacatcgctattcagtgagggtactaagctttgaacctaggtatgtttaacgctaaagcctgtgaattgcaccatagtcattggtatcagtaatgaaaaatccaacgtgtttggtgaaattcaagtagtgtagtatcgccaagcacatgatacaaagagaagcaactgaagtgctggaatggaggcatgtgataataaaaaaccatctatgccatgacaaatacactggacttttttctgtaagtaatgtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcaacagcatatttagctaattatttgacttgaatttccattcaaattggctttattttttcctgaatacgcagttgcttagaagtggttgagttccatcctggtgcgtgctggctatcaaccaacataggagtaaaaattcaccatgagtagtcagccaaaagacacatgcagatgcttaggaaaataaattataaatatttcttatgtctgccagtagcaatgagaagattttgctatattgtgttttttgatagttggcttgttttactgtatgcttatgaaaacataaagtagcaggacaacagatcacattgccaaatgatttctaggatttggcccaaggtttgatgatccctctgccgcttcttggctttgtatgctcagaagcacccaccatcagctgtcagccctgtggcaaaaggaggaatggggtcagagtcaggcaaacagaagccagagccaagtgttgttctgagaaatactagcatctgtttagtgcagtgagttctctgctttgtacttggcaacccacttgggactcatgctgcaaagggggctgatgatttaaaactgagggaggagatccagaggggagaccttggctcatgaaacatcctcttcacctctgtgatgggccgttcttcatgtcctacagtttgaactaaagaatggcctcggcttctcctgtggatgtaaacatattttgttgcaagtgccattcgttttatttgttgtataccttttccttcaaatatattcctggctaaactcctggctgtctctcctggagtgtttttttttttttgtattcttggggttgtaagaatcaggttcatgtggaggtgtctagaaacaggctggctggacaggaaggaaataggtggatatagttttaaatttatacacatcttttggagccaggaacttctacacaatctagcttctatgagataaaatttgtggtacgaaagaggagtggtaacatgaataataagagattttttttaagtctagaaaaccttagatgttgggagtgtaatcaagcattttagccagtcattttgaaaggtaagtgagtttaaatgaattgaatactcagttgtgaattagtgatactgaacatgtacactgtcttatcagtgtgtttcatagtgattggtaatgcccagatttccaatttgatacacagtccattttaaaaagatatatgtgtgtattttatacgatgctttgtagttttgaagttttgagataaattatttagaatcaaatgctcatggaaatgtctgtaatattaaaataggtttatttcaagattattaattcatttgttcaacgagtgttattgagcgtctgttgtgccgaaccctcattaacctcaatagggaaggtactaggttcaagaggctgaagaagagaccccgagccaacaaaggagacatggagtttcattaggagcttacatacagtggagagagtcagtggcagtgggctggacaggagaaccaacttacctacagaaatgatccagtggtggcaggctgggcaggaaaaccgcaaccacttgcaaacagcatgcagtttatgtagcattttcacttaacactctctcctttatgacctccacctggcaaccctcattaaccccaaactcagggcctcattcctctgtatggcccatgttccatgggatgggatggggtttcagatgttcctcacagacaaagaacaaatcttcgggctgtccactagattccctagcttgggacacactttcaggtgtgtctactgtacagggtcattctaagggtttgcttaagtttaccctacagcatcattcacgtctgctctctcatgtgcttgcgatacagtgaccatcaacacaagggccctggtctccaggaacttacactctgtagagcagtgtttttcaaagtgtggttcccagatcattagtatcagtgtgctgggaattgctagaaatgcaaattctcaagtccccggcctagacctattgaatctgaaactctgagagtggggttcagcaatttgtcttttaacaggtgattgtgaaagtttgagaactactgcaaaagacagataaattaactgatgattattaagtatgccagaaaaggctgagttttacaaagaaaataaaacagggaaagaagatggacagtgtaaaagtgtgtagcttttggggtgttgtctttgtctttgagcacttgactgatgtgagaatatctgggaggaaagctttgtggttatctcggttagagattttagtgagttgaggcacggttgggaattgtgatgtctttagaagggctgaacctccagaatttgctgttgaataaattggaaatggtgatgtgagagggcagaatgatcctaaaggttgttgatggtacctactgatctctgatgttacctcatagtaagatgggaaaaaatgaaatggggtggggcagggaaaagcagactttgggggaagaaataacacattttattttagaaaagttgtttcaaaagctcattagccatgtgtgaagctatatttgtgagtatgccattcatggggaaggttggcactgggaatattaactggggagtcatggtcatataaatggtattttaaaaaactagttagcctgagatcaccaagggaatgaatgcacatggaggaggtctaaataccaagtcctggggtatacctggggggtggggtgggtggcattaggctaaagatagtgaaaattctaatgaatgataagtaatattttgctatgttgatcttgagattgatatgttgaaatggcagcatcctagaccaatcccaagtttaatgccttccttgaagttgccatgtttctgtttcggagtccttggtgccacaggtccctcttgactttcacaggccagggcttcttgccatacaggtaagtgttctcccttcccagcttatgggatccagactcatcagctgcccgctgtaggttgtccttaaaacttagagaatatgcagagagcatacacaattctgcttagaggaggagcactctccttttcctcttgtctcagttgtgatcttgtcttctttctctaatttccttttcctctattgaactttcaacaggcaaattctttggtctgcagagccaaaagaataattgtctttctttttaagttaatagtacttagatcattttgacagttgtcttatttattaccacttacacagaggcatttcttaatgttgaattcaaatgttgatttttagtgtcctagaccttgatattttctgatttgaataccctgagctgttgaccaaagcaacaatgaaatttataatttcttaacgggtgtgtgattcttgggatttctttcagaaaacaatacttccctgatgtaggaatgtatcacttaaagtaaaaaatgtttttaaaatttgaattatagaagagaataatcagtggatgattcacttcgtagaaaagttctttgctttaaaatgactcatcaagtgctattgggaacatttaaaatgttatttcaattgcacatactctttaggaagatacaagtttattgctttatatgtgtgtatcactgataaaaggtattttcatatatttaacaaaaatttaaagggaggaatggttaaatgactgtctaaggactcatacctctttagtgggcaaccaagtcttgaaccctagttaccagttgtcatgtttacttgtagaactaccatcacggccccaggggaacagcttaagaaagggataggaggaataaaatggaagcactctatagaataagtcttcatctgtactcctgatttaacaaattctgatattacccactgtgtttaggtttcagtgacaagttttcgtagcagttgcggctgcatttagctcttcacatcctcccaattctaaaactgcaaggtattgtaacgataatctgtcccatttcctcgtttttgaatgagaaaaccacagcctagagtagccattacttgccaaagctttttttcttagaagagaggggggatcttcagttatcttctagaatgtgacaaaattttgccaagatcatggtgcgtgctcactaaaagatgatgaagtttattgcctaaatctcaaattcagtcaagatgctacttaggccagcttttaaaatttgtataatagctagttttttatttaaatttttaaattgtgaaacagatcacaaattaaagagcacatataacatatatagtattacatatgcatatcatttaaaaatattttatatatagctatatatcttatgtatgttatttttactataagaataataataaaatataaaatgaacacacaggcatcaaccattgagtctaagaagtaaccattccacaatcttggaaagcccctgtgggtccctaatctgtctcaccccattccttgccctcagaggtaacctctgtgcactaccctcttgtggttagaagatggagctaggccgggctcggtggctcacgcctgtaatcccagcactttgggagactgaggcgggtggatcacctgaggttggtagttcaagaccagcctgaccaacacggagaaaccccgtctctgctaaaaatacaaaaagccagacatggtggtgcatgcctgtaatctcagctacttgggaggctgaggcaggagaatcgcttgaacccaggaggcggaggttgtggtgagccgagatccaccattgcactccagcctgggcaacaagagtgaaactctgtctccaacaaaaaagaagatggagctacattactgctccggagccttgggcaagttattattctccctgtgcgtcagtttcctcatctgtataaaaggaatagtaatatatgtgttgtgaggactgaatgaggtcacccaggaagtgtgcttacaaaaatatgttgtgtagtcatcatcgtttactattcttgttactatcatcatgttcagttttacatttgaaggacttgtaatgttgccaacaagatggagtttgagggactaaaattgattttaagaataataatgttgttgttcctttttcaaatcttttaacatggaaacattctgatttggttgggggggggggcttttgacatcatctgtttcaccttatcactgtgtactttcaaaatatcttcaagatgctttcattgaagcaacaagaaaattgttttgaacaaagaccctttagtgtcagtcactatttcagaatataacaccagtcattgtttatatgatttactcttaataggattttgatattctgctgtgtaacgttgctgctgactgaatgtctttgaagacagtaaaatttgaccgactacaaaatattacttcatttttggggggtttagtctgtttggtaaggttactaaagagtacttctaaaagtatgagaggataaaggattgagatataagagaaaagttgacaaaatcagaaaactgtgcaatgaggtaatgagtaaccaaaacttgctatcttatcagtactgagaactgcagaaaaatttcttacttggagatttgtgcttttctttgagtattcataaataagagtgaaaaacaataatcacttttctcagtaaaagaaaacaaccttatacttgaggacttttgtttcaaagttggtaaggctttggatactaatataaaattcaccagtaaagtattttgaaactcttaatgccacctgtgcttctgaattcatatgaagattattgtttgagacctctgtggtgacatggacatcacacttgaggggtgagacatatcttcaccttctttacacactggctcatcttctatttagttgatactattgttcctcaataaaattatttttctctctattgatattattttcaagttgacttctagtcagcaactctgtaagtatctttttattggcttttagattctgtattttaaatgagccagcaatatttcaatttcattgagattgcattatatcattttgaaaacttatttgcctgtgattaaatttttgaacaatgtctgggatctaaaaactcacttgaaaatcattttttaaatcaaatttttttaaaaaagtgttacaattatagcaagtcatcatggaaaaataaagtaatatgggtatgtataatatgccttctaaacctctaagcatctggaagcagagatccatgttctgtgaatgacctactaatcttcttaatgagttcatagcaaggcatgtggtatttgcgatagaaaagactcagtaaaagctgtcttccattcagtttttgaaaagtgaatggatgccagtttatgttatttcctatagtgcctatcttaaactgatttttttttttttacttgctgaatctcatttcatgtcaatatgagttttgtattggtaatatagtgtttgtaattgatgatgtagccaactcctttattgaagtaaactgtgaagctaataaaacatcttcatgttttaaggccattaggagacatttttttctgtgtgtgtgtgtgtgtgtgtgtgtgtgtgtgtgtgtgtgtgtgtttgagaccaagtctcactcttgtcccccaggctggagtgcaatggcgcgatctcggctcactgcaacctccgcctcccaggttcaagcaattctccggcctcagcctcccgagtagctaggattacaggcgcctgctgccatgcccggctgatttttgtatttttagtaaagagggggtttcaccatgttggccaggctggtctccaactcctgagctcaggtgatctgcctgcctcggattacaggggtgagccactgtgcccggccgtgtttttttgttttgtttttgtttgtttgttttttaacataatgaatactacaacagaaacataattaaatagcttctaaacatttgagaagatgaatggatcactcgtttctaaatggatagccaggagagttagttaagtatttctgatcttatagtgaatgataatgtttgtacaacctaatagttgccccttttcctttctttttcttctctaataataatagcaaaaacattgtttctggcattcagtgagtgccagataaatagaaaggctatgagcttgatgcacagtttcttttctttttcctgggtcctctctcctcccaacctacatttcttggcatctttccgctgtctgtttgttagagttctgactctgacgtcaaggactcacagtgagtgacccccgtggcaaacctgtaaaacattatacaacatgaataagaactttcttattagatctgcagctggctgagtacagacatatggcagcaaggatgttttggaagaaaggcattgcttgacaaagaacccagtctcttgaataaaggtttatactggcactctttgatgtttataatacccgatgccaggggcaaaacttttttccccccattatattgttattttactgtttaaaccccatcattttatatgttgcggtggctaaaatgtagaagcagacattttatgtgtgtctgtataactttaaaaggaaaaaaaaaaaaaagcaaaactcaaaaaactttctcaggctctgtctacccggctgtaagtgttcgattttctgaggctgagactcagattgaaagtgagggagtttgtaagaatgggcccagtccttttgagcaggttttaaaaggatgattaaagggtacataggctttgtaatgccctgacaactttaattgtttcttttggtggttgtcctttttatcgtgagtagttgttctcagttgctaaaaatttaggctgggaataatttccaacctaggaggttgtcacactgatttgcatttggtttgttatttcttagtcttttcaatgcagccctgctttcatcttactccctttctcaaaccccagctactgacattatgtacatggttgtgttttgtgatctgtgctagcacactggtgttgaataatatattgtgaaatattctgatggtgacaattcggtagttgccccaggaggaatgatgacactttgaatcagaggcacaaggacagagaagttcaacctagtggagagccaaggtaaatgaatgaaagcttctgcctccacaaggaatatctaagtccttttagcatggttctttgcaaccttgattatgtttataatgttcaaaatctttgatgaggccattgtcttcctagtacttactgcatctacaataatttagtcataagatattgataaataaggtatgcccattggacatgcctgatgggattttaattaacatctgcctttgacaactgaaacaactgaagggagggagaggtacatgacttttgcagagcacatattatgacagacgctaggggtataacatctagcaaataggtacttgatgacatttttatgaatactatgatttatcaaaataagtatatcctgagaagtatatatttatagatgaaacagtatttacagagaatagactctagtttagagaaactgaagagcattagtaaaagtgttaataagaataatattttaagtactatgagggacttttttcctggtttttaggttttcatgttaaaaattcatgagcaggacagatatgtttgtcttgttgattttatctctataacgggaattcaaattttaaatatgttctagaatcatgaaagtcatggctagaaaggtcttggagattatctaattgaggagtcccaaatctctaaataaaatctaccagaagaatcataggtcaattactacatgtataattgttccaaataggtttttccagaaagtgcagaaggtagcacagtcctcaccaagttctttcattcagcaagtgctatcaataccacttaccaagcatatattttacttggagaaaatgaaaattgctccatccataattggttgagagcccctttaggtataataataatcttccctattatgtagttgagaaaactgagacccatatactaagagttgaattgtgttttccccaaaagatatgttgatatcctaagccctaacacctcagaatgttaccttatttggaaatagggtctttgcagaggtaaccaagttaaaatgaagtcattatggtgggtcctaattcaacatgactggtatcattataaaaaagagaaatttggacacagacacccctggagggcagatggccatctgaagacagagaattctaatgatgcatctacaagccaaggaaccccaagaattgccagcaaaccaaacagaagccagggagaggcaaggattcttctcttacagatgtgagagagcataggcctgttgacatctagatttcagacttccagcctctagaactgtgagataataaattactgttgttctaaaccactgaatttgtttacctagttatgacagctctagcaaactaatacatcatagatattagtagtcatggtctcctggagaagtaattagcaaggtagtcaagtctggaacccagtttaattcccaggttcagtgctcaatgcctgtctctagaaataaaactttttaatttcttttgctgtaaagataaatgcaccgtaattcacaaattgttatgaggactatttttctgttgtccatttttttggttatctttttactgacttatttcatttataacacaatcttgaagtctgataatttcaggtacagacttcatttattaaaataaaaactcaaacttgaggagacgaaagttattcgatcatttctttcacttcccacagttggttaatgaaatctggagaataatataattgttatatctttttctttgcttagcgtaaacactcaaactataagttatagctgataacactcaaattataacttataagctgtaccataattcatagtagtcaatgaattagtcagctaaacttgaacatattactacaacttatgggcatacccaactccagatagtagaaataagactcagagtatacatttcatgagataaatctaatgtgagtatccaataatagattcaaatatttttcaagaattgactatgagtctgtgaatatatattaatgactatacaatacttttttttttttttttaagagatggggtctcactgtgtaactcaggctggactctagctcctgagctcaaatgattttcccactcttagctcagccacactctgcgtagctggaactataggtgtatgccatcacgcctagcttaaaatatattttattaagaattggtgctatggaaaagtattgcttcaaccatttcccccttttcaagctaaaattaattagtaatttaaaaagagacatgaacatcaacaaattaaacaatggaacaaggatcattcaagtcctcctataggcctcttgatctgtacattaattggaataatggtctgttctttttgtagaaattaatccatgttcttaaacacctcccatttcagtgtaagttctgactgtttaattaaaactttatagtaagctcaaactgggatcctgaaaatgaaaagatattttttgttatctggttcaggtttttgttaggatgagcactctcccttatgcataatccagaggtctgctcctttgaaatgtcaccccaaagtaggttgcttgaagttcccagaggctaagagggttccccctatcaggacatagttatgacacctacacagctcccctcttagcttcatccctcttagaagagtttctatttatcttcatattctgagacgaaattgttccatttattctactaacctcagcaaaagctggttatgttaaaaacaaacaaaccaaaaaacctaactgcatctaggtaaacattttcccatatttgttcttgcaagatggctgataaggcattataagtggtgatccctttattccatcattacaggaaaaaataatgtttatttgatgtgaaggggaaaaattaaaattaaagataattctatacttcggatacttgaccatattaaatttacaaaatgtatagttgagttttaaaatcacaatataagtagatttcttctactcacaatcattatattagataagaaggtactcctcttgatctctcctttgctccatcataaaatccttactagatgggtaagacggtagttgtgataagacagtagtagcctatcctgtcttatacgtttctgtgaagcccagagaggtgacatgaatttctgaaggttgcagaactgagacttaaaacttagtgtgaaatttattctgttggaaaaaaaaattgcactgtaactatttctttgaactttgggaagtatatccttattagagaattacagtgtcaagacattgcgctattattaaacaaatgataccactattttgacaagagtggtactttccaaaatacctaagaagttaattgaagacttggaattatcagaggatttattttatgttgaaaattctgacttatttttaaattgtttattccatctcataaacttctatttgttatttaattttaggaactttgaaataaaagtttttttttttaatatatcttatgtcctgtgtgcaagtctaatggatagatctgtaccttgaagttccaacttctgccctcagagatgaaagtgacaaacagcaaaatatggagcagatacattgaaaactttaagaaacttaatttttatttagtttgtgcttatttactaatatgttctctgaatgcaaagtaagtatacatgtagagtcatctttatgaaaagctatataaagagctataaataaaagggatagataggtaagacaaaaaaaggcacactgacaaaatctgcggtaagaaatataatgagttagattctaggcatttgtcttatttaacatggagtaatttgtggatatatatatattgtgtgggtatttgaaatttatgtagttattttaaatcatgtaatttatttatgcaattattttatatttatgttaacttatttatgtaatgattttacatttattaagctgacgattatggtatatggaacttaaaggtataaatatacccatttatggtatatggaactgaaaggaataaatctatccatttaccaatcagtctgagagattctctggtttcttacaaatacagattggcaacaccgatgtggttaaacatgacaggcaaataactaccattcaatgtgaatattagcaatactgacaagagaaataacattttgggttgaatagatacatttatgtcaggtttttgtggattagtttctctctctttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattaagcgtcccatgctatattgagataactttcaaacataatacaattatggtagtaataataatttggaacttcaactatactacttgacattttagcatttatgtaattaattagttaactaacttgtaggtgccaggcacagctaggcctaccattaaggagtttgcatttttttcaagatagttatttatagtacagtatgaaaagtacacaaattttgagcagtattttccttttttcatggcttcccttattcaacttctttaagtaagtaaaattccacctcagaaatggttatccatgttccctatctcctccattcctattgtctctgccttgactcaagacctccttatctcttgcctggattatagaactgtgtcataacaggtctttctgcttggagttacccaccttcacttgaccacaatctgtgatacccagtttctttttctttttttttttttttgttttgagacgtggtctcgtcctgtcacccaggctggagtgcagtggcgccatttcggctcactgcaagctccgcctcccgggttcccgccattctcctgcctcagcctcccgagtagctgggagtacaggcgccaccaccacacccagctaatttttcgtatttttagtagagatggggtttcaccgtgttagccaggatggtctcgatctcctgacctcatgatccgccccgcccccctttggactcccaaagtgctgggattacaagcatgagccaccgcgcccggcccccactttcttacactgtatctttctaaagaataagtctgaacaaagtagtgactattttaaaccaatagtatacatttactaaattcttagcctgcctttcaaaattacattcagatttttccaccattttctttttagtgcatcttaagtacaggtcatccgtgcgcccgtcttttttctgagcaaatcacctgtgtactttcacattccttagcatactgccaggggtgttccatatacctggcatgatcctccagcccccactacccgacctactttatttcttcctggtaaaaccctcttcaaccttcaagccacacgttatgcagcctttcctcgcactgagaaacagatactttaagggttatgatatttattatattgtaattatttacatgttttgtttccctctagagaatgagagttcctccaaggtggagactcattcagcttttcgtctctcttacataacctgtgcctggcaggttgtaggtacccagtgattattgaattagttaatatacgcaatatggatttgcttgtcagagcatgagtatccatggctttctgaagtccttcaacctttgcttgtgctacttcctctattttggtcctcttcaataggcgaggtgattatgatctacctctaatgggtcacagtgaccccaaaggcaaagcaatatattgatctcccttaaaaggatgtatgccacgaaataagtgtttttatcttctcatccatattcacatttatactttaagtgcaatgtcctgagtgagacaaaccttcacactaatctgtgtaattaaaaatattgaaatctcattgcttggcaaccactctagacctttggacacattttctggcgctgttaagggggctcaggctgcaattgagatatagattacctatttaaaggaatcatatttttcccctttgaaatgtctgtcctttatctccttttgatggattttctaatttattaggctttgcttttttgggaagtaaattatacctgttgacacagttgcatcctcatgcaaaaacaaagatgatatcattaatattttatggcttaatcattaaatgtgaaagggtgaaatgcttgtattgcaattgaaatgaatcttgaattgaccaggtctttctctgtgggaataaaaagagaataggtatgaactttaataaaaaatggtgtttaactctacatttagcagaggtcttctaagtaattttgccatcagttttcttcccacaaattctcccattacataaataatctgctattatgttgatagactcatctttctgaaatatagacatgttcatataattcatagtttgaagtgtctgatgtctcctcttgcctttaaagaataccctgaactcttaaacttcacgtataaggttccatctgtcttgaccccaatctacctaggatttctcctcatccctggtaatctatacataccttaaaacccaactcaagcattacatgctttctttagctcagttttcactgatgccccagcctcttagggaagaattcattgtttccgtatttgtgaattatagcacctacccattcatatgtggaggaataaaatgtagagagtaagagttagtgtttcaaaggcagaccttctggctgtttgcattctgtctgtgggaccttcagaggattccacggagtaaaagcactctatgtgtcccagttctatcatttatgagagaggggaaataatactgctccagaaggttattttgaggatttttaaaataatgcatgaacagtacttagtacatgcctggtacacagtaaggactcaaccactaataaaaaaaatgttttgtgtgcttacattttgttttgatatgcttacatatttttcttccctattaaaatgagatggccagaattctgtcttcgttgtacaggcagcatccaacagctctcagcatataatattggatatgtgattattaatatatgtaaagggtaacatattggtcaaaacattaattatttggagaattattcgattaataaaatatgttttatacatattaatgctgaaatctctgctcaagtgttttaagaggggatttactcacagaaaataaaggaaaatgaaagctactaggtgaactatagtttaaaataacaaatccaaaaatgttagatattgcatctcttcagtggagtattatgcctggagccaattttgaaataaaaacaatgtaagtacttacaaaatctccatttggttcagactctgcaggtggaactaatgtaagtggaaagattcctaaataattccaaagtcactatgaataggaataatgatcatcatacatatacttatcacttctattagaaataagccatgcttatacatattgtttaatatagccaaaatatcttacacataaagaagttagttataattccctactctattcctcaatatttttaacagtgcttctcaaatttaaatagggatgacaagactgatgtttatcaggttttcctcaaggagatcctttactgtgaggtgtgtgtgtgtgtgtgcatagaggtattattgaaatatgattcacataccatgtgatttatccacttaaagtatacaattcattgttttttagtatattcacaaagttatggagctatcgccactaatccagaacattttcatcatgtcccctaaaacacctatgcctgttaacagccacttctcatttcacctacctctctactacttccaggcttaatcaatgactaatctattttctatctttatagatttgcctattccagacttttcttataaaagtaatcaaaatatttgcagtcttttgtaattaccatctttcacttagcataatgttttgaaggtttatccatggtgaagtatgtatcagtactacttcatttctttttgttgccaaataatattccattgtatggatataccatttttgtttatccattgattagttagtagacattttagttgtttttgctttttggctattatgaataatgctgctatgaacatttgtgttcaaatttttgtgtggatatttgttttcatttctctggaatatacatctagaagtgaaattgctggatcatatggtaaatccttgtttataagtttgagaaactgtcaaatggttttccaaagtgaatgcatcactttgcatttccactagcaaattataaaggtcctcatttctccacatcctcaacaacacttgttattttctatgtgtgtgttttaaaaatggtttttatagccatactgatgggtataagatggtatctcactgtggtcttgatttgcatgtccacagtagctaatgttgagcatcttctcatgtacttgatgaccatttgtatgtcttctttggagaaatgtctatttaatcctgtgcccatttttcagttagattattttcttttcattattgaagtttaagagttctgtatttcatatacaagctttctggtataagtctcatatcagatttatgatttgacaatattttctctcagtccttgtattgtcttttcactttcttaatgccattgttgtgtgtgcttatttttaaaacaaaatctgatgacagattattctaaaggctagattttaaggttgatatttgttttcatgatgcatctactattatttattttcgtattttctgaaattattagttttttaattacagctataacattttgaacaataaaattcttaattttagtgttttccaaaccgtgctctgtggtacacaagatgctccatgactaaggtagattgagagatgttgtttgctttatttcttactctgagcacacaatattaaaggccatatgatattctattttaaaaataacatgtctagcccagcatttccaaaagccgttttaatctttttccctgaaacagctattaaacccaagttctgtaatatatacttcagaaatattgttttaatctattctctgaactagttttacctggcttgtaggactatctgcctttgttcttaaaaaaaaaaaaaaaaacttgtgagagtctttttaaaattctatagtcagatctatgacaacaaaagagactgagacatccacaagttatttctaccatgtttgtttaactcaggagattgaatttgatgtgttatatacatggtatgaaccaaacgcataatagaaattgggtcttctctaccaatcagatagttagaaagatatgcttttacttcagagaaaattcaaagtcagctaaagtgtgtaggtctgtttcttttcaatttccagggccttttccattatgtatttgctgcctaccattattgctactattccatgaaaaatcgcactctgtgtgtgtgtgtttagatttgtatatgtctgctcaaatagagcttaatggtgacatttttatggcttcaggatgttggggtggagggaattatcttcccctcatggtcgctttgtgtcagatgatcattgcttcatctctagaatcctatattgcttctggacagggaaaataggaaggcagaaaggcaaaagagacaagctagctgagttttcccctttttaaagactttccttagaagcttcacacagtgacttctgcccgtatctcattaaccaggactgtgttccatgatctcctgatctgtaagggagttaaggttgggggaaatagtttcctagctggacccattgccatctctatgagaaccagggttctgtgaataaggaagaagaatacgacgtattataggatggacaactagcatttttgtcacacaaggcatgggatgacagaaaattctgagagtgaagagctaaaaattctttactacttgtgtattcaacagtagaattttaaaaatcaactccttattgtagcctaaaccacctgggttcaagcaatcctcctgcctcagcctcccaaatagctgggactataggtgtgtgtcatcaggcctggctaatttctaaaattttttgtagacgtgagatcccactacattgtccgggctggtcttgaactcctggactcaagcgatcctctggctttggcttcccaaaatgttgagattacaagtgtgaaccaccacacctagccttattttttttttttcctggacaacaccaatcagttattctttttaaaaagcatgtattgaatcccttaacacgtgccaattatattccacatagcaaataagatccataaggtttctgctatcctgaaacttactttctaaaatggaagatagacaaaagcaagtaccggttgagaatcccttatctaaaagggaccaaaactgtttggagtttggaatttttcagatgttcaaatatttgcatatacataatgaaatgtcttggggatgggacccacgtctaaaacacaaaatttatttatgttttatgtctaccttatacacatagcctaaaggtaattttatacattttttaaattttctttataaaacaaagtttgtgtacattgaaccatcagaaagccaagatgccactatcttagccacccatatgggcatcctgtggcaaaaaaagtttcagatcttggagcattttggatttttggactaaggatgctcgaactgtaatgaaataattacacaaggttatttcagattgcagtaaatgcaggaaacacacttggtcatatgctgaagagtgacaagagaagatgagggtaagactggccacttttgttcacttaataaaacccagcacctaataccatgcttggtgcaggataggtgctcagtaaacgtttgtgttggatgaatggatagatggatggatggatgatcagtcacagaaagtgtcctgaggaagtgttatttgaagtgacacccgaagaatgaaaatgagctgacaatgctaagaaaatgggaaaatgtattctaggcaagatgaacggcatccaaacctttaggttatatcagtgaaatcaaatttaattctaaaacaaatgagaagccattgaaaggtgttacattgattatctcatctgggcttcacaaaaattacgtgaagtaggtagtcttattatttccattttgcaaatgaggaaacttaacctagaaattataaaatatccagattcacagagctggtaagaatgaaattgggatttgattataagaaattcagctcgagtccacccttaaccactgtgcaatgttgtaaactataaaagtaaactgtaacaggactagattgtttaaacagcaagtaaaagcctgaaaagaagatatctgccaatttaatggattcaatttttaaccacattgtctattagtgactcttatgaattgaatacatagcacagtttctcagagcctccactgaccatctttctctttcaaagtaaaaattgtctttgtatattacattatggactggattattataaaagatctagtttctggttctaatgaacgctgaaatatggaattgctaaaaagtaaatttagttagaataacaatagcttgatagaggaaaatcattacaaactcaagcggagaattccagtttagctatgcccttgaagttgttattatactttgcatataatttattgattctgaaaagttggatttgccatcttctgagaatattatcttgggcatatggggcacaccctgcaaccagaaacagcacaggaatagtcattccttcatgacaacttctacgaaagtgtaaattgaggctaacaggaaaatcaccctattactcctgtaaagtgacgatagctttcagttttcaaatgcgactttctgatcatgtttgaatgtgtttctgttcatgtttatggagaaatttaagaattagaattgtgattcttaattctaattcttaaatttctccacaagtaataggaaactaaagaatttttctgtggtaatttcattaggaaaactttggctaggacatggtgataatgtgcagatattttgtttgccatgtcacattcttccccttcttttctggaatgcaatcaatggtgaaacatgttttacggtaaaacatttaatactccaaattgtgaataaagcaaagagaatgtgtttaatatattttttaaatcatatactttctttaagaccctctcactcctaacataagctagagttttccgtttcaatatataatcaaaaaaccaagtatcctattaagtgtatattgttgactcaaattgacaaggacattggtaaccttccttttttttttttttttttttttttttttttttgagacagggtctccctctgttatccaggctggagtgcagtagtgcaatcgtagctcactatagcctcgaactcctgggctcaagcaatcctcttgcctcagcatctagaatagctaggactaccaggtgcacaacaccacacctggctaatttttaaaatattttttgtagagactgaggtctcactatgttgcccaggattgtctcaaactgctggcctcctcaactgatcctctcacctcagtctctcaaagtgctgggattacaggcacaagccaccatacctacccctctatttatttagtttttgccttcaatcaaggatacagtacatcgcatttgcttgaaatagaaaaaaagaatgagcaagtctctcggttcttgtacttgtggtaggaatagagacagagaagtacctggttaattatttctgcacctgcaattctaacgacctcagttaactacagttttaggtcatactttactcttcctttttttctatttcttcctttttccttgccacatcatctattccactttattttcttttattcctaaatagaggtctgcataatatatcactaagaggaatacatttgcaataaaacttttttctgcaaaaaaagcattggttttattgtaaacaaacctctgaaattactttcaacatatcaaatgggtcatggacccgtgaagaattgagggggaaggtcaaatttaggggcagagatgtactgtaaacttagtcaaaagaatatcttcaagtcttataataaattactttcttcagcatttaagaacttgaacacaaaatgcacatgtcttgttaaaatctaattgaaagtggaactaaagtaatttttggcacaaatcggctttagaggacaaataagaaagccaagggtcgcgtaatggggctagtatatattgtagtccgtctatgcttttctcaacaacctcccaaagtctagctgattggggagtaagaaataagtagcagggaaaatgtttggaattttgtcttttgctgaaggtttcttggcacttatgaaaacttcattgaatgaaataagactttaaaaattttgtaaaagactttttggaaaaacgtaactttcacattaaaattatataaaaaccaattcagtatttttctcatttataagacttaaaaatgaattcaatgttttaagtcacaccaattactgagatatattttttaaaattacctatttatcaattttaaagaccatttctaaaaaaggagtttaagtagagaatattcctttgagttagatagtttttggtatacgtaacagcatacacacacacacacacatacacttttaattttcttggacttatatattttaggcccataaatgtaaaccatttggatatcaaagcaatgtttatgtttttcagcacgtaattttaatgctacagtctgagaaattgtatgttgtttaaatgcaatacatcacaatgtttgataaataaaaataaaaaccgttaaacctatccaaatgcaagaactcctaaatattgttgagttaaagcttttgatgcagctgaggctatgtctggattttattattttccctaggatttccaattttttctaagaaaggagatcaattttatagattagtctcctgaagttgtgccagtgggttcgtctgagttttaataattttctgtagaaaatagccttgaatgtgtcttttcacggggcatggtatgaatgaaacctaaatatatagggaaacagagatattagcatgatccagtcataaaacaacaggtgaagagctagaaataataaatgaggcctttattttattttttatttcctactcatttactcaaattgacataaataatgcaagaggtagtttgacaaactgtacaatacagatttatagtcacattaattggtgcttaggggtttgggtttcacctgaagttaagttcatatagttaataaagtcataatgccttgtttaaatatttcatgagaaaattgcattttgttttgtctactcagaacctaaaatctgttttattgtggttattttataaatatttgcatggaatttttggagtaagtttatttggtttgtttgttttttttttaaacaggcctaactatcaattgcattggaaatttgattgtgtttccaactaacaaataataatacacctggaagtgcaagtcctttccatattgaacagactctctctagcttttccttagctgatcttttcaaacgtttgctatttgggcctctctggccccaaagagtagccttttgctactctttacgcttgaggaagattaagctatcccaggcctctcataaccaaggggatccattaatattaaaatttagatttttccactgttaatgcagaaaaccattgattcagtagacttcatggtcatgcacatgcgttacatgttactctgagtaatgctgcatgaagttttaattacagattgatcaaattctataaattgtgttttggcgtggccaaggaatgggtttttcctattctagtttaatagaaagtcataatatatatcatgtgaattttacgtttctcaatgaattagattgcaacaatgcctaagtttgattatatacttattaatagtgataacaattatagctcacatttagtaagtccttactatgtaccaggtatataaggctttttaaacctaatgattcatttaatgcttacaaaaccatacaaattggatgctattattagctaagtcatggagacatgaaactgaggcacaaagacattatataacttgtcaagatcaagtatctggtaagactgaatatcaagtcagaattgggatttgaaccagtctggactctagagctaacatgcataacatatagcctacactttttaattattcagaaggtacttcaagactcctgtggtgcctttgggttggcagtttcagtattttttatgcttacatagagcataagatatataaatataaaacattatatataatatatattcaaatatatattttatatgtgtatatatatttccctaataaatattgaaagaatgcacacatgaatgagtggatgggtgaatacagaaatgaaaaatttgtattgagatgtgctaatagagaatttggtataactaaacatctgatatataatttatattttgaggtaactctttagccaacattttaaaatatgattaatttatagtacttacgaaggattttcagagacattacatttttctgttatttcactgttttaaacaagatggagattagagggtggaaaatggattctggagaaataaacccatcatattaactataaccatgagttccttgaagacaaatcaaatctgatgtcttttctttttccttatgaatatacttcagtacgaaggacctgatacttagtttggacccagtaattatttattgttgtaagtagcacagtaagaataaaaacgtttatgatttgcaaccagccaacctatattttaatccatatttaaccactggctgggttatgttacatttctcctctcttaactcatttccatatccataaaatatggagcatatgcctctatggtttcttggtgatgaaattatgtattaaaaattataaaactgtaaaaaatatatctcaaaatgtgtttgtgttccatggaaaactgtaaatctctcttgaaacaaaaaagtttctataatcacatacttctagaaatatttcatctgagttcctttaaaacttcctcaagctttaacatgctaacaggtactgggactatccaaggagggatgatattttgcagaatttcacaagcttattttactttattaccatttttcataaaatacctcacaggaaaacttaagcatgagactgatgtgattacattattattaatagtctccaaaattcaaattagcaatagaagttgtaaaaatttcaagtaatcaggataaaccagatgtattaaatgaaaataatggaagctttgtaagattagtggcagcatataggtttagaggaattattatcattgtgataacagggacagatacagaattatggaaacattctaaagcagtatataggaagatcattatcagaaatagatagagaaattgtagtagagaggctagaatttcaaactccagaatatctgaatttgcctctatctgaagccttctcattcccagtgcttatgaaatttacactggctgctatattgaaatgctaagaatcagaatcagggatttagtatcaatcaagtggatggaatttagctagttatcaccaactgtgaaaggaaaaatatccgttaaattcagtcacaatgctatatatcaggctctcagtgattttttaaaggagggtcaattttaagaattctaaggaatctctttgttcctgctaatttgtccgaaggtttacgaggaatacaggagaaagctaaattgtttggggaacagtaagagatttagattctgagaaagatcctggaggaaaagctggggccagtatgctgaaaaagacacagtcctcttgccctaccccaagagtaaagggcaagaggtagtggctgccaaaaaaaaaaaaaacaaaacaaaacaaaacaaaaaaacctgaaaaaacaaaaaagttttgtggagagatatcgaatggatatttatatggctttttgctgtattttgtataatgtaatgatgtcctcttgtctccccatgaaatcgtcagtgaaatcaacatcacttgctaatacattgtagagtgggattgatttgaggagcggggagatgtgatgaagtagctgtaatagaggtattgtgtttatgagactgtggctgctagtcacatctgttttacccacacgaggctgatgtggtcttctagtttgtaaattatgatatgcaggcggttcctgccagcagagatttaaaaaaaattatgcaggtgggtaagtctttttcagcaccacctgtattaggtctttctagatcccaaatcccagtattgacgactggagggctgataaacagtatatggcaaccccaggaattctgttagcttctttggcctaagccccggaccaaatgcagacttccactcttacttttctgaagagtgcaaggtaattttgacattcttactccgttaataagaagagacccaggaaaggaccaccaaaaaaaaaaaagaacaatttcccaaaatgactagacaggtgctgagactggcctaaactatcagagatcttcccaatccagagcactgacctctgctagagcctgcagtcaggggagacatacagttcaggctcatcttctcacatggaatgctgcagagagcaaatataggtagcatagaaattaaggaaaaagagtatgccaaggaaagaatccaatcaaacatgcccaggttaaagaagtgcttttagtttcttatcaaatcaaaaaccgtgtgctcatcagagtaaatgtggttctaaaaggcaacccctgctctcatgcattttgtgactcttgaaaaacaaaacccatatgtaaagggacaataaaattgtactatttagtatgactaatataagggtgtctttgtggcatgtggtgcatattctataaattcttgttgtattgaatggaattaagtaagagtttggggacagaagaatccctggtgtattagtatttccctagataattttttcttgtaattttgaattaatgaagctaataattaacttgtagaccaattttatactaaaggaaaatagtaaataccaaatatatagctatgatcacaaagatccaatccctttttaaatttaacatagagatgctttgctgctcctaaggtaccattcctgctcccgcctcagagcctttacatcttctatttcctctgtctggcatgcatttcccccaggtttgtgtgtctggctctttatacaattatctgataaaatgtcacttttttcagaaaggactttttcgatctactgtacttatataaacttacctctgcttccagcccctaccatccattacccccacttgttctcccttcgtttattctattctaagcttctttatagctttatcatcacctggtatactatgtttctgtgtttgtcttcttccttcactaaaatataatagccaggaggcagagatacatcttgttttgttcaatggcatacagtttgtgcctagaacagtgctttgcacataatatgcatacaatacatatttacttaatgagtacatgatgaaatagaaagtggactgtgtggtaacctttacatccttatatgtatattagttttatatgtcttcagaaatatgttttagccatcttcagctgctgtaaaagaatagttttcttgagagtagtgcaaagataactgtggtgactattactttccatcgttatcctctttttttcatatctaaaacttctcacctctttaaggtacacacaaataataattttttatttcccatctagttacagtcctccttcagctttcatccctttagtaatagttgtggtgaattttttctcccgagaagcccctaaaaaggcgttcatttttacgtaaacaaacaacaggagaaaaacatataaacatgaaagcaaaatattttacctacagaaatatattttcagcaatctatttctcatgctattgttaaaaatatctctacttggatagaacctttttgtttccatgctgacttcttctttgcttctcctgtgaactttttaaattctgtgtttggcagcagttttgttttccttggagctaagtactgtgtaacatactgttagctgaaggctgtgatgtagaaatttattattaaaaataaaagacggagagaagaatttattccataaggatcaaaatgacttagtgtcaaagcagttaggattttcaaaatgctttctataacagattgtgtttcttttcaaggaagtttactttgtttgccaggaataaatttaagggtcttcattgtgcctatcttggttaatgagaactgagaagagaagaaacattctcttttaaaaaaaattttttttagagaatttcttcatcagacggagagattttatttgccatttgcaggcataaccttggtgacctatatatccccagaccttctggtaagatgcttattaaaatgtcattacccagaggagtaatcataaactagccagagggtattttttatagatggtgagagacaaacattttttttctccctgaattaagtagttatgtactcttatcaactagaatatatttaaacttacttttatttatttttccagtctcaatctctccctctctgttttatgtttctagcaactttatgtaactaatcttaaaatcattagcattccttctccaaaaagagtatcatatcatcttaataaagtttctcttttcccagaattgcttaagtagcatgctgctattcatttctcttgaaagtttagtcaaaatgaattattttgcaaaaaggaaaattccacagtttctatttcttttcctcattgtctgtggcccattaacgtcttttatctgctactatgataatgtcaaatgattactttggtcatctgcaacttaacactaatcttatctgtttaattgaaaggatgttttgactttctctttgaaataatatcaacatcattttgcacttaattctgaaattcattgacctcaatgtgcaagctgtcttctttactatttattgtgaataaccatttttttttatttgttgtaatcacacatcaggaaagggctagggagatgtctttgtgaaacatttatccctatggttctgtttaataggagtacttaccagtagctaaatgcctcattttattttaaataatctgtaatattaagtcagtttatcacactatgagtagttttttttaatggattctgacaatatgctgcttattgtagtctttcatcctttatctgagaactatgtttttatgacagtaaaatattttttatacaaataggataaaaattcatatgctgtcatgcgctaatatgaagtttatccttacatctcccactctccaccccatgccccatctagtggccagaatgctgtaatcgtgggaaggaataaagctctgacactacgcagtccctacccccatcattgcctctttctttgcattaaaaaaaaaaaaaagaaaatacactgaaataataaatgctaaattttggctcagattattttaattagaaatggaagtttaatgataaacactttgtattcttcaaatccaaaaggagaaatatcctgtttacttcctttggtgctcttattgactgtagaacattacagtatctcatttgtcatatgcagagttcattctttttgaatatatttcacataggatgtagatttctgtaacattttttattactttgaaaaaagtagccatagtgtacattttaaaatactaccacattcttggtcagctcatacctttcaaatataatataaagatgatattaatatataaataagaatggaaaagaatttctttgccctgcatatttctcagtttgttatataatgctaggaaataactctctgatacataacacacttggcaaattttactgttttatgctttaaaagaaaaagtcaaatttagatagtgaattttttgaaatgcatcttacaagctctgatttgcaaattaccaaattgatcttatcttctggagtaaatgatgacccaaattagtctacattttgagtgtttttgttctttgactaaaatcgtcatcgttaagataattaatggcagaaggcagtgaattacatgctttcctcattttaattctggtcctacaaaaatgtttcctttttgacttactgtcatcatgaaatattctctcttaaatcaatatattgtggattataacttgtgtttgtaagatttatttacctcttttagttgtgataggagaatttaccaccttattttgatcctgttagtttaaactcattagcaaggaggataacagtgttaatagtcagcattttgtaaatcttccagaagattttgataaatcatttcactagaagcctattgctcaatttattgccactttaaagttgccaaaaataatgagctcatcttcctattttaatgtaaggtattgtcaatgtttgaaatgtgtcaagaattgtttttgatagttctagtgaacaactaatgtttctaaatcatactacttatttcattagttaattattgcttgtgaaccatattataatcatctttagtatcaataaatatttttgagatgatataatgccagtaaatccataaattaaaaaattaaagcattaaagaaatatctactatgtaagcattcaattttatataatgattatctgggtcagtgtacccaaaattgtgtgctagccaaactacaattaaatcatcatgataattccaaggcttaaaacaattgactatgtctgttaaaaatgagtagcttaaaattcattaaattactttgttatgttttttacctattatactgtgaacatttcacatgttcttttttataaaggccttggaagccaaattttaattgctctatggtatcattttgtataccgtaatctattgagtaatttcccttttgttggataaacaattagtagcacattatagttactggatttttagatcttagtttactggttcaaagggtatgaatttttaataatatatgtattatatatattttatatgtgtgtaaatatatatatacaatgtgtataaatatatatttgttatatagtagcaatatatatgcttagtttactccctgttttccaaatattcaacattattaatttgcaaatataataggcaatagtagtatcttgtcattgtttatattgaatttcttttacttccaataaagttaaatgtctttccatagatctatttattttgtaagttgttctcactcttccctcagttttttactagggttgggattctttcaaatttgtaagaacccttgatatcttgaagatattattctttacctaagtttactacagatattttaccaatgtgacatttgtgcaaatactctaaagttttatatagccagatcaatttgtcctcttttgtaataaaaaaaaaaagtctttaaaaaaagatttacggacaggattgacagattgatagctctttctcgattccgtgggtggtggtgcatggccgttcttagttggtggagcgatttgtctggttaattccgataacgaacgagactctggcatgctaactagttacgcgacccccgagcgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactgggacaagggcatggcctgtgtgggccgcaccaaggaatgtaccatcatcccgtccaaccactacggacccatcccggggatccccgtgggcaccatgtggcggttccgagtccaggtcagcgagtcgggtgtccatcggccccacgtggctggcatccatggccggagcaacgacggagcgtactccctagtcctggcggggggctacgaggatgacgtggaccatgggaattttttcacatacacgggtagtggtggtcgagagctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaacctgctacgatggcatctacaaggttgtgaaatactggcccgagaaggggaagtccgggtttctcgtgtggcgctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtccccgcgccggacatccaagaaaaccaaggtggagccctacagtctcacggcccagcagagcagcctcatcagagaggacaagagcaacgccaaagctgtggaatgaggtcctggcgtcactcaaggaccggccggcgagcggcagcccgttccagttgttcctgagtaaagtggaggagacgttccagtgtatctgctgtcacgagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggttttttttttaatttttttttctcttaatgaacacattttctaaatgaatttttttgtagttactgtatatgtaccaagaaagatataacgttagggtttggttgtttttgtttttgtattttttttttgaaagggtttgttaatttttctaattttaccaaagtttgcagcctatacctcaataaaacagggatattttaaatcacatacctgcagacaaactggagcaatgttatttttaaagggttttttttcacctccttattcttagattattaatgtattagggaagaatgagacaattttgtgtaggctttttctaaagtccagtactttgtccagattttagattctcagaataaatgtttttcacagataaaaataaaaaaataaaaaaaaataaaaaaagatttagatttatttaattttttttttatttcccaagtataggttgagtatttacctggattttattctattttatatttacagttttgtctttttaaaaatttgtcttttaaatctataattaatattaccatttattataaggttaggctttaattattttttaccctcaaaagtctatttttctttttctttcttttttttttctttttttgtgagacagggtgtcactctgtcattcaggctggagtgcagcagcgcgatctcagctcactgcaatcttggcctttcaggttcaagcgattctcctgcctcaacctcccaagtagctgggattataggcgtgccccaccacgcccacctaatttttgtatttttagtagagaaggggtttcaccatgttggccaggctggtcatgaactcctttttttcattagttgaataattcatcaaatacaaaatatttttgatgttttcttgcttatattttgttagcacacatacgtatatttattccaaattatttcattcatttgcatttttaatgctaaaccattatccccaaatttggttaagttttataatatatcttaataaccagaaaggtattttcatcacttgtaacattttctaatggattcctttcttttgagatggagtctcactttgtctcccaggctggagtgcagtggcgtgcgatcttgggtcactgcaacctctgcctcccaggttcaagcaattcccccgcctcaacctcccaagtagctggggctacaggtgcacactaccacgcctggctaatttttgtacttttagtagagacagggttgacccgtctggtctcgaactcctcaccacaggaaatccgcccgccttggcttccctaaatactaggattacaggcataagccactgcgccccggcctctaatggattcttttttattgtatatacttgaggtgtacaacataatattttgatgtatatttacaatgtaaagtaattactaaggtcaagtaaattaacatcgatcgtctctcatagttttaactttgtgtttggtgaaatcaccgaaaatctaccctcttagcaaacttcagcacactgtataacatcatgaggtatagttctcatattctgcgttgtatcgctacacttattcatctgacataactgattatatatgtttatactctccaatgaaatttatattctttcaaaattaaaaatactgttagcttttgattgaaatctagttaaacctgaaatctagttaaatttgtttgagtagaattgagcactcaatagtttatagaattaagtcttctttaccagtagcactgtatgtcttcagtaaacttttaccattttctgtatatggttatcaaacatttcttgataatattcaaaggcatattatttttgttgctattgtgaacagttgtttgttgttaagtctacttaggagtcattgctgctatacagaaaagctaataacgtacataaattcatttatagtccatcttattggtgtgctagcttattagttgtaaatacttcttcagctggtactgatgactaataagattactgacagatgaatggagtttcatttctctgagtcaatatcttttatttccttaatattcttaatgttaaatgttattttcaataagtaaatattcttctttgtaagcaaggtagctcagggctattaccaccataggaataacgtgatgatattttataggttattattaaaaatctacgttttgtgactatgtgggcatatttcatattaaatatttaataattttactctttagaactctcaagatttttatagttttgaaggaggattaaaaattattgaactgatttggccttctggttcttatcatttgcggcagtagatttaactgcagtagtcatttacccagaatattttcttaaaaagctaaaggcttaataatatgcaaataaagctttacatggtttaacatctatctaggatgttcctgacagagctacacagtagcttcttttatcacacagtgatattaaaatactctcaaaatgattagaagttgaaatattagctatcaaaccaggagtttgctactaatttaggtatgttaatttattcatgatagctatttaatatattactaataaagattggaacaacctgattattctttaaaataaagaagaaaaatgtttgtcaggtaaaataatcatttaacttattataattttcatctttccagctcatggggcattcagaatgggaccacaaacgagggccaagaggatcacaggtaagtttcttttccttttctttttcacgtttcgtttcgtaacactttcagccacgggttttctaaaactcaagagataataaaatgtagagcgaggaagaggcaaaataaccatgccatttgtttttatttaagttaactataattaaagtctggatttcaaatcccaaaggcagatgccaggatattccttctaagagctttctggtatcccagattggttgtgtttatatgaatatagattttatattcatcttgtctcggcagaatacattttgatcagcaacccactctctttattcatttcctttgacaatttttccgtgtattttcttttttcttcagcttcctgtttttggttaaatattttgaaatataatcagactaaactctgaactaattacaagattttgtctctaaattaactctcttcatctgagggaaacagaaagatgaaaggacctattatttttgaaaagaaacaaattctaagtctttctgtattaccagagtgttttcattgtcttgctttatgtcttaggcaaagagaaaagcttccatgacgcatttatgctttttaatgacctaattagacaatgtggatttgttttgctttcataattactttccctgatggaataaaggctgagctttacactgagaaaattatttctcctcctagagcactttgtgaagaaatgtaaaaataatttctctcatggcaggctatggttacctgactgtaaacatgcaaaataaaaattaagtgggtggaaatttttgcttctattgcacacattttgcatttgctactaaaaaatatataaattacaaagggcagttgaatgtgcaatactgtaaatgaaagttcattggaaagtgggggcttctcccaagtgtttacaaagctgatttgttcttgtgttgtcattaaacttgtgtgaataactctatttaattctggtcactaggaaaacaaaaccaagtcaatcaattgttttagttcacattttaatgactgattttatttctgtccagtatcaatttgattagtaaataatgtaaaccaattaaattaggatcatctaaaagaatttatgccttactttatttccctcattcttatctccccttcattttctctgaaaactcttcctctgtacacatctataaaattttaaatcaaaatttgctgcaaggtcagtaatgaagggattaaattaacatagagtaaattcttcatgattcgaaaccagtaaaaatgtaaagataagtgcaaataagaaggtccatggtttctgatgattgccaccaaaacattttgatattcaaaacatgccaagcaagttgttgaggacatgtctcttcaaagcaagggagtgttatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaactgagtaagagtgtgggacacctttgaatatatgtgaatttttttataacttctgtataaatgcttttggatggcaactcttacagcaattactgtgaagggataatctggagaatgctatactttattgactagataggcagaggaagttaagagggtcaagagtttgaaactgagtactctaagaattaggaccattaacacagaacagtttagatgaaagatgatgacttcagggttggcaatattaagtgacaagtgaaggtgacaattccaaaatgaagtttcaggcacatactcgaggcctgattagaacaaagggtgtcagtttgggaatgctaatcatacaggagataattgagctcctccagtagataggcttccagaaaaatattaaaagaaaaaacagaataaaagtctgatttttggaaaatatgctataaagactagaaacaagctgaggagggagttaatatgagtgtgcatgatcttactagagaccaggtggaggagaaatgattcagaaccaaaagtagttacaccaaggagaggaatgaaatcacagaccaaggttcaagaaaattaaaaatgtagcagatgtctttgggtttagtgattaggaggacattagtgaactttcaaaaaacagttttgagaaagaagtggtggaaagaagaatatagaagagaatagtgtaagataccagaagagtctcttggaagagctttgttttaaaagaaagttgggattgcagaaagaggtggcagcaagagtgatttatttatttacttacttatttgtttatttttaatgctaaggtgagatgtgtgtcttaattactggcagatgaaaagaattagtgtggaaaagaaaacactgaaaattctcaatagtgagctgattcaggaccgaggaaatggtgcggttcagggaagggaatgtgctttcttccagagtggtccttttggcacttctttatgtgttttcctcgccggaaacccacccccacccctaccccataccagccatttacactatatcagagaaactggccctgtttgcaaatgaaatactggataaatccaccaaaaagtacagatgggtaagctttgaaaagaaagtagaggccaggggcagtggctcacgcttgtaatcccggcactttgggaggccgaggcaggtggcacctgaggtcaggagtttgagaccagcctgaccaagatggtgaaaccccacttctactaaagatgcaaaaattagccaggagtgatggcatgtgactgtagtctcagctactcgcaagactgagacagaatagcttgagccccggaggcagaggctgcagtgagccaagattgcgccgctgcactccagcctgggagaaagagcgaggctctgctaaaaaaaaaagatatttctaatagaaagagagaaaagaaaaaataagaacagatattataacattaaaaggtattatgaaccgattgacttcagttttcttggtaggattgaggatataatagtgaaaaatcttgaatgctagaaaacatatggaataaatattgttttagatatctaaaaaagggaacttgcttgattcctgcccagtacaaagcagagagctgtgtcagatgtgagtgtgctagcctgcaagatgaattttaacatattttactttgattcgcaaaacatggatatatgtcaggtacttttttttagcctttgaggaatcagaaatagacaaaacgttggcatctagcagcatctaattttttttttaaagtcaaccttaattattgctaggatagagttaagcttcccctggcttctcccgggatacttaataaataagtgattttctcaaatttccctttgtatttcaaaattgtatcatatatgcattatcacagaatttaagatgcaccattcatatcaaatacttgtcctatagaaaaatacctatctctcttctagcaaattccaacccttaattgcatatgactttttagacgcagcaagaatgtcattcaagctgacttatattactttattctcagtaattctctttcataatttgtcagctcactcatagctttctggctgatttttcttctttctttttttaaaagtatataactctcaaatagtagatcacccaaatgtaggaaagatgctaaatgataaataaacttccagcagcatgcagaactcctttgtctggcagtgttcccagtaataccaaatgaagtcaggggatgaaattctcagaaggcaattacttgttgttttttcttcatttttattttttattcttgaaggaaaagttttccagtgggaagtaaagagaggcaacagaaaatatgctttttttttttttttttggagacggagtccggctccgtgcccaggctggcgtgcagtggtgcgatctcagctcaccgcaacctctgcctccctggttcagcgattctcctgcttcagcctcccaaggagctgggaccacaggtgtgcaccaccacgcccagctaatttttgtgtttttaatagagacagggtttcaccattttggccagcatgatttcgatctcctgacctcgtgatccgcctgcctcggcctcccaaagtactgggattacaggtgtgagccaccgtgcccagctgcttttttttttgttttttaaatgcttaaaaacagtaggaggacattccaaggggccaataatttacttatcacttagtggaggctccttgtggaaaagattagttcaatttgtgaatttgtaaacatcctaacattttaatattcttggaaccctcaggcctttatttaccaatagtgaaaaactagcaagtttttagttatttagtatattattggtatttgactaccagccagactgtattagctggacttaaaagtacttacaagaaacaaatttttgtgttgtccatctggttttcaaatgattgaagtctttctttagataataaaattctggtttgtatgattctaaataattcaagtattgtgtgtaaaatactggaagatagctgagtattccgatggaaaaaaagtgattaaatgcacactagactatcatcagtatgcttacaaatgacccatggcctattttggagcaggtctttagtggtttaacaagtcctggaggcaacaaattgtaaaaattctagactaaaagcaactacctagatcagtgagcctttatagcataatgttaagtctcaaggatgaattttgatgaggagtcattgtgctttacttttttgtctgtaatttcaagggaatggatctgattgtaatacctactgaagttgattaacctaatcatttgcctactaatggcctgatgcagtgacaggtcacttcttttctaggttaaatcatttgtttttgataagagaatgtggagagaaatttaaatgccttttcatatttatctggagtaatgccatatatatttattgaagttaattccttttaatacattttggaaagatgaccagccgtatttcccaggaatttgttccaagggattaatgtgagcagattgggagctcattattacgtctctcaaatgtccgacatgttaccagggaataatttatgccctagagctagctgccagtgctactttttctacaaacatagtgtctttcacttgcatttcttcctcctttttcatttttccatatatcaacctaacaactattaatattcgttcagaaatttttccaataattgtttaacttttggcaactctccaaagacagtttggttttggggtttttcgtttgcttgttgttttgagaaatttgtttaaattttgcttatactaacggggaccacacaaaatatatttgcctagggcctcacttagtgtagggatggctttgtcattgcatgtaatagtgacaggaagggacctaaatatcatatctatcttctccattaggtcttcctatagatatttaaaattttatcctttagtcagttctgcactattggacaattattttttactcttcccccactctttgaaattgcttttatttagttactgtttagtattatgtctttaatttgcattgacaaactgcaagacacagtttttagcaaatctatcatagtagggatattgctgacaatcatagtagggatattgctgacaatgtccacagcacacacagtgtcaagaggatggggagacatttctctctgtcctcagagaagggaaaacagtgtttctctttaacaactgaacccactagtatattagttctctagcatccctggtctctacctagtagaggccagaaacaacaccctcagtccccaaactgtgataagaaaaatgtctctagacattgtcaaatgttccctgggaatcaaatttgcttctagatgaaaaccactgaaattacagcataatctcattgataggtgtatggaagatagtaaataaatatttagtgattaatcttgacactttatgtaggaaaatgagaacatgtttcttcaagcatttatgctttcaggttttcaggtttcatctttaagtctatcgaatagaaattttaaagaacatattcatttcattgtgaagtagttttctcagagtggaattatgtccaagaaatctaatggctaggttaggggggaatgtactcttcccacacttacacatttaagtgattcgcaggaggaaagagagtttggctctgtcctcacagtagtttcatggaacttctgtttcagggaaactgatggatgaccttcagtaagtgactctttattacaggccctggtctcttaaaagaacattgatgaacaggaatcaaatccacagaaataaaagggaaaattgccactggcatttatgcttttattgttttccccatgtttatagattagtagacatgttgtttaatacttattgaatgaccctcttatgttggggcctgtggacatcatttccatgacatgggcactaccttgtgtgtgtttagccaaatcacaacctgtggtactttatttgaaacgaaacaaagcaatcaaataaacaaccactgataatagatgtttctctgcagggactgcagatagtttaagcaatagttaattttactaagtgtacaaaagcatattttgagagagaaataaaaacaaaaataatacctattactttaagccacagtttctgaccactgttgcagttgtgacttttcttatattctttcccccagatagcttatagtacacattaagaaaattaatgcaagtattttgcacgtacgttcttgtaaagcaaatatacacgttctgaaaaatttccagctctcaagttttgccttccacttgagagaataacaggagaaaaatatgctaacttgataacagttaattttatctttgaattgcaatatctgacaaagggaaataatttttatctcacgctgggtgattttataccatcagcagcattgagtaagatcttgttttttattaatcctgacaacataccctaaaagggaagttctgtgggtggatttttgatttttacttcacttatagataaaactgataaaaaaagattgtgccaaaaataatcagcttctcatagaagattaaaatctaagactaggatgtattaactagaacaaataatcagatatagaggtaggtaaaggtgatatagggtggaggaggttatatggagtagtaaggacagttaactggagagggtgaattgaggcaaagaaaacgggaaatgttgatcttttaagatgaatattaacatccattttcatatactaccaaaaaaacacaggatacaggcttttagtacattcttggtacaatttttttttatttggggaaattgaatgttttaatttcttattaacacatatccaggctatatgtataaatatgtgtttctaatagcattaacatcttatttatggtacaggaatttttctttacagccactctagggaacaaactaaaatactgtttaatagcattcctcacaagattttatattctcatcaaaggtgctgattttcttacaaagttttaccttgggagaacaaaggtggtttagcagttatgttgtcaacattaagtgattgtcccacgttatgtaaaattcagccatcatgtaaacatcagtaaacccaaagttaccagggctgacaactacaaagaaaaagcctggaataatattagcgatattaactaaaattatcttaaaagtcacaaaaatgaaacttcttgtcagatttgattttctagatcacagaactttgtttttgctttttggcggagtttttttttctccttttttggtggtgatgcattgtgtaataagcgattcttggaaaactcttaagtgttacaagttaaagcttattcttattggaaatctgcaggttatcaaacttgcatcaaaatagtttgctcgctgagttctgtggtgttgtgtttaaatacttctgggtgacaatttccacttggatctctacaactatttccattttagaattttgtaatcatattctttgttttcaaatcattttaaccctgaatttagagaaagttgtttacatagtatcagcgatacacacttaaaagggtatttttttttttaagtttaggaggaaaaacctctcagaaaattgtgggtgagacaaacagatggagtagaaatcacaaaaataaactacatcatgatcagtcaggaagatgtagcgcaaacagatataaaagctctagttctcaaaggactgggagcagaggagaggaaagaagttgtctatcaaagatgatgattggaaaatatagaaaagaccatctcatgaagcaaaaagaacatggccattgaagccatgttgaagttagaaacgtgcagtgaatgttttttttgtttgtttgttagtgggaatgaatgatgatttgggtgaccgacaggtcttaactccacttttaccactcattgtccctattcaggtgtacggtgacttagtgccataactttggtgacatttctcttctggtgcctcaaaaatatggtagtatatgcacaattattgcattttcaggcctttgcatgagtttttaaagagtactccaattaactataagtttaggaaatgtaatcctaggacaatttagttttctttttcgtggagaaatacagcatgacttcaaacaagttttgctaaatagtgaatttgcagcagccagttttgttttatagtgattatggcaaccttgtgtatagtgaatttttaattaatatttctaaaataaatgaaaacattataatttatgaacttacttaagagtttcatttattcaagtaagctttgctgaaccagtgtgtcttgaggaaatctgttaatccataataaaatatagcagcccttgaggaattagtgaaattatatctaaagcatgaataataaagccaagaagccttttgttttatttatgctattcccctgctttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattactatttctgttcaaaaaggaaggaaaaatatataattttactgttttttatgttttggtcttggcactgtggcttttgtttatggaaaaagacaagagaggaaaaaagcattattttaacttcacatgataaataatcataccaaactgatatttccttaaaaagtatttgttcgtttttcttattacaatgagtattgctagtaattcagtgcaagtttgaaatgatatactggtaatatcttctttaaatagcattataggtttaagtacatcaccaacatcataactttatagagatattgcattagaattcatctagtttctgtacttattcatgaataagagatgcttatgtagatgttatttcttgttgacaaattctattagcataaaataaaagcattaatatttacttttaataaaagtcataacatttagcgttaagttcctttataagtaagtgctttatggacattattaactaatttaaaacatcaactatttttatctggagtgaatttctgccaatattaattaggaaaaatagggatataaataacgtctatggcttctaaatatttaaaagacattctatgttcgtcattttatgcactggtggttgtggaacttttaatcagtggatacagcattggaagtaatatttttgggaatgaacagtgttatacatattatatgcatagctagaagcataggagaggctgtcatttgttatactagatatcaaattgttgaacccgtctctcttttcatgtgacacaacatttcaaacatgcagcacagtatagtgaataatgtacaaaagctaggtagatttaatgaatattaaaattttctgtatttgatgcagtatttttgttgatagctatacgactgcttagaaataatctcattaaactttttcataatgtatacattattcccattaatagatatatacttcattaaatttattttactatgtttgaccttttgggaatttagagaatatggataaagaagtagtttagagagcatggaaaagaattagaggaaatggaaaggattaattttcaaagagacaagcaaaattggttgattttaatttttaaaggctgagtacattgataaatgtggatacaagtaataactattttaataccacctggaaaaagctggcatatggccaccacattaataaatatgtgtgtataaatgggttattctaaatgaatgagtgttgtcataagcatgccttatattaaaaataaaatcattatctttatggagatataaaaaaagtaagatattttattaacattattcttttccaaatatgctaactttggtaaccacatttaaagtctttttgaaatcatgttttaaaaaatcatccctatgatggtcaccagattaacttcttaatatcagcttcatttagagaaactatgaaattggaaaactgatattatgtattgcttcactgtcttctacaaatactttctgtacattgtatataaatcatgtgcttaaaagataaagatgttctatatatttttattttaaaagtttatttatttatgagggaattagggttacaatagtatgtctctctcttctttcataaccttgtaaggagtgtcctgttcgcagcagaatagtttttgcagaacaaaatcacaggataagagaagaattgtaaaacccattaaggcattaccctatttaatatttttatcattaattaatatgcccctcataatgcacatttacattttgacatcaaaaagaagaatatgtagctaatgtatgaatgatagaatacagatttagaaagctttctcattaaccttcagttaaaatactaaactaagaagattcaagaggagaaaataaaattttgcacttaagtttttaataaaacttcagtgtgcaaagtacctgcgtatttgttcataagcaaatgaagaaacaaaaagtaagatttaagaatctggattgacgtcaagcccaatatcatatggcttttctaacagcaagtgccactttgggcttcactaacgtatttatggcatacagaacagaataattaattcaataaattctgcactggccagatgacctctgcagtgttgaattcagttctgagtacataatttcaagaaggatattgaaaagctgatgcactcacataaacaataaatatgtctagaaacagtgtcccagatgaagtggaagtttagcttatgaaagagaacttatgatgaaaagcaagagagggagaaaaattgtgctctcttaagttatcaacacggtggctcacgcctgtaatcccagtgctttgggaggccaggtgggtggatcacttgaggccagtgatttgagaccagcttggccaatatggtgaaatgccatctctactaaaaatacaaaaaattaactgaatgtgatggtgcatacctgtaatcccagctactcggaaggctgaggcaggagaatctcttgaacccaggaggtggaggttgcaatgaaccaagatcatgccactgcactccagcctgggcaacagaatgcgacgctgtctcaaaaaaaaaaaaaaaaaaaaaaaaaaaaaaaagggtgtaaagggagtgaaatttttctctttgtctttctgtaaggtgatatttggacaagtgaatagaacacagagcagtcagattttgcttaaatataaggaatacatttctagccattcaaattgatttaaaaataaaataaggcagtggttttcctaaatatgaaataggttaaatgattgtgcatagagaagtgtctgttagagtagatgagccaacttcgtaagcattcatttttttgtttctgagcagtcatgaacagaccaagatatgaaaatcttaatctcctaaattattgtgtgtctcagtgtacctcagagaagagtcctgtaactatgctcttcatttaatggaaatttccaaatctaggcaaaccatgagtcttaagctcagatctaggctgtcttctgtacagactagaattgtcagctccccttgaggagctgtttttaaagcagtcattcctatggactagcagtatccattcagtatcagctagtgaacttattagacgttctgatggacagtgttttagatgaaactagaaaagtcttccttttaagaagtttcccaggtgatgtgacaagtgttcatgttatgatagcatcagcttaaatgtgtcagtatggatgatgattggatttcggtacttaaagtaatctttgtattgcttctgcctaaaattctagagttagagctaaatttctttactacttcatgtttgttcatccatgaattgtgggagcttatattgtaaactgatctcagtcatatattcattagtatggatgaaagataatgagaataatgtttgatgaggaaatgagggaaaataaatgtgggtactgagtactgtgttgaaagacagggaaacagcattgaggattgatacaggtctctcttctcacagcctctggcaccacagcaataatattgtaaactctaaggagagccatttacattatagtgtacatgaatgctgacccccctggagttgtgcagcgcacaacactcacaactgcatacatgatccttttaagccctttacatctacttctgtacttagaattacttccaaagcctaaacttgaatcctacattctgattaactctcaggaaaacaaaacaaggcctgtttttttctgactcctagcttttctaccagtatcttacctctctgtctaaagtagatcaaatatcctgtactctgggtggcatcatgttatttcactcctctgggcctttacaagtacattgtttcaacttttaataaatcttaaatacaactgaaacattatttgagtcccagctctaagcactgttttcgtaacacattttacatccataatgcatttatcatagaacttagaacactatgcaaaatttcccactagactaaagcttctagtatccaagtactacttcatttgactctccaatagtgattgccacccataagttgttcaggaaatgttgaatcaatgaatgagagtggggcataaaatgggaaatttgagcacacagaactttcatttaacctacttcactatttgactatggtgtggccttgcttttaattggaggatagctggagttgcaatcagtattcatgaaagcatgtttttaaaaaaatgagaatcagtctaacagaatctgaactttaaagaacatctcattactgattatacatggtgacgatattttccaaatcgtggagcttctactgggaaaaggtatgaataacctttttgttctataatgattttcaacagaaattatattagagaaggacagttgaaagccttttaaaaataaattcataaagtaatccaaatcaagtttatgataaactggctcagtgtatttattaaatgtatttttagttaatttttaatgagttataaaaatatgacctgggaccaaaaaacttcccagtaaaagttctagaatgattttttaagatgttacaaaactatcttagaatgttaaacagaatattttattaacttagaactgttcactaaactcccaaatgaaaaccagatctttccatctcagtaaaatactaaagtatcatgaaactttataatccttatctagcaccaaatctacatttatctaaagattgacaatgtccatccttctgcattttttcctattttcctcgtggattagtagcatatttagaatttttgaggtttcatgctaaaatttatgaaggaaaatgaaatatataataccccgtcacagtagaagggaatactaaacatctgttcaaagaataactcgttgagcagacaagtcatttaaatataaaatatgcaaattatacaagtgattttagtgctttggacaagattattcactgccacggtccttccaattctgaagttcgtgcatgtattttatgttttacttagaataagttatttttgtaaatgtatgaaataccaaatcagaaatgccaatatataatatcttccccccatactgtactgattggtattcatcagtaactaccagtcaaatgactagtctacatttctaaacacactgaaatttccaaacttgggagttggttcatttgagagtgaagtgcttaactggtgatacttgtgtctttttaaaaactgactttgatggtaagtttttcgtattttataagtaatttttcattgcttcctgtaacaaaacataaaagatttaaaataaaatacttaaaatataccttgaattaattaaaggaaaaagaaagcaacattaattgaatatgtatttttgccatatattgtgctaagtacttttttcacagaatttattttaatctacaaaataatttctgagaatagataatttatttactcagttaaggttttggggcatctcctgtgtgtaggcacagtgctggtggtgaagcagttccatgggaaacaggacagatgaacttttggttctcatgaagctcgtattctagaattctagatattattattatacctttacctatgaagagacagacttgaatagttgttatgacttgctgaagtcactgagctagaaagaggtaagactgtgttcaaatgcaagactaagatgcaagactgttttcaaatgcaggacaaacgcaagaggtaagactgttctaatttgaaaaagccactttcgtctcttctgtgctatattcccttccccaacatatatttaagatgtgatttatcatgaagatatccaaacactttaccatataaggtcaaaattcagtttttttatactgatgctaattatgatcatttaaaataaattcatttttatttaattatttgctaaacctgaattttaattagaaacataatccctatattgtgatagagattataaattgagtctcagaaatttaaataactacaaggtcaatcttcgagtagtgggttttccaaacagtcttgtaaatgtgcaggaaaacaaaaacatttcagaattgcttttctgacaaaaagaaaaaatggagatttcagcccacggaaatatagccctgcattttctgcttctaagcctgccttatgtaaattagatttattatgtccagtacatgaagaaattccatgccaaacctatatagctctttaagctttctacttcaccacatttgcagcgggactgttaagtaagttagtttatttggagtagaaattacctctgaatatgaactttggaagacttctaaaagtgatataacctctcatttaaccagcacgaggtccatgggggtaaaatttactatacctggtcttcttaaagctgcacatctgtgaaagcaaaaggttataattaagtttttctggaatttcatgaaattacacattttaaagtatagtcctgcaggacttcacattaactgaaatcaaagacagcctggtacagtggtgaagagaatgatctttgaaataataaaaattccaagtccaccactgaatgtatacgtgaccttaatgagatatttaacctttggaagtaatgctttttcatctagaaagtgagtcagtatctactttgaaagtttgttctgtggatacaatacgttggaagacattaaattaaaaagtatgtggaataaacactcttatttagatgatagctttcatcattatcattatcatcaccatcaccatcaacatcatcatcttgctcccaccaccaccagctccacctgtatatcatgctatacaagtatgctcagcatgatgagcccaggccttcttttctctgatccttcagaaaatgacttacatgatgcccttggaccatagaggatcaacttacaaggtcacatttgtctcactgtccctaatatagcaatatgtagcatcttctaatctttttctcccacaaacggcaagatatctcaatatcatcctacagtaaagggagattatactgcctcataatctattctaccaaaatgattgttaggaggatcccaccattacacagattttttgttcatactttagagatggcatcgaaaccaagcccccaaatggaaatatcttccttccaagtttctataaatgccattggacatactatttattgagttaactttgactacatgagtaagacaaattatttgtcttaagttggaatgcctgtttttcaagtaatttatgaggaggaatataatattatccacaaagtattccttaggaattttcagtgggaatagtaattttgatgtcctgtatcttatttttatgaaagaaattaagacaaagttgttcttactaaaattggatttactttttaatcgacattcttattagttagcatcaaacaaaatgttacttaagtaaatttcagcttacctaatttatcttatttaactctttcattatggctaatatagtatttggaattaagctataaaattaattaagattaagctgtaagaaaaagttctgactaaaattaggagggaaaaataaagctctgattaaataaacaattacagaaaactaaattttaactctaagataaatttgccttgcaacttggttttgatgtacaatttgtgtattagctgattaggtaacttcaaaagtcatcagctgtctactggttacaatacagggaacatttgggaatctaacctattaacacataatttaataggtaacacatattactctctaagattgtttgggatcatctacagactttcatccaagtgaaaaagagttctacttcattctgagttaggtcacaaggtcctgttaattttagctgtttataaattttcactgagaagctgttctttcatcctcctatttttttttaagctcaaagttcttgatttaatctgataaatgagctcaagttacagattctaatctgataatttttagtttcttatgcacctgattgaaataagggtcttttttaaaaaaatgtagcacaaaacccaatgcaaaacaactaagaaatttggtcaatatttgtatatgtacacaaagaacttacacctaaaacctattgctatatcttaatttgaactttttaaaaaattgattaatttttgtgggcgcatagtaagtgtatatgtttatagggtacatgaaatattttgatataggtatgcaattcgtaacaggcacattatggaaaatgaggtatccatcccctcaagcatttatcctttgagttaaaaataatccaattatactcttttagttatttttaaatgtagaattattaatttgcatttttattatactaatctataaaatgaatactattgagagaattgcttaaattttagcattaccagtctttaagttttctaaatatggttttggagtgaaatattatcttacctttccaaagcaaggaatttgcaaacaagattagtctcaagtattaattgaagtatgagtactatttcatatgttacaatttttatattatctattgaatgttagattggcaggaaatagcaaaattgactaaaatagagatgtgaacatcctgaaataaagacagtactatatacaactaattaaaaacagagggatgagtagtttggcagaagcattaagatatctggaaaatgaaataagaattgccttggtcttacatgatgtgaaaggactatatccactactagcaataaacagaaaagagaaactgactttcagcattaagcattcactggtggaaatgaagttagacagttttcattttaagtgtgctcaatttacggatattcacggaaatataatttgtcaagtagaacaatcttcttgtcagttacagaaaagatattgataatgagaatgttatttatcttcccttagccatgtgctattatgggctcagattggcttctcgttttttaaatggaatgtgtccagttgacagaatacaagattcagcaacctagagagtaacatggaattttacaaagaaataaaaggataagttggaaacatgaagttttttttttttaaactaaaccaggtgaggtcccccaaatacaatgaagagattgaggagttagcaccctccaatacatcacaggtgcagcaaatgcaataccactgtattagaagtactttagagggggaaaatattaaatcttcccatggtaacaagtagaaactggaataaagactactcagattatacatgaaccacccccacccccaaacaaggaattacagaagagttttctaattttaaagagctggctagagccaagttacatgaataggtgtgaaacagtggtgctttgggcacccagtgactaggtgagcatggccaagaacagcattctagagcacgcaatccatgtgggtcaagagtgttgaaatatgatgaaatggtgggttaggtaggaatcactgatacataccttgtttgccctgctaaggacctgggaattcacccagtagataataaagaacaatcaaaggattttaagtaaagaaggtttgctacatttaatgcccctctcctcacagtgttattgaactgtcaataatatcaacacacattaaactgaaccgcatattcagtttaatgtgtgtttttgtataatttgaacaaggctggaaaccaggagacctgaactcagattccagctggcttagccccaaatgagctgggtaatcttggaccagtcaaataatctctttatgttcattatgttgaactagtcaaataacatctttatgttccagttttgttaattttaaaaaagaatgaatctagcttggattacctctactatctcttcttcttttattttgtggttgtgttctgtggcacagaaatggaatttaacacatacaggaaatgtgcagtcattttatttaccaaacacgggacgggccaggggagaagcatttgttttcttgtataattaagagaaagctgttgaaaatataaagacaattgaagtagtagttttcaaaagatgggaaggaagtagaggtgtgaattcggaaacaagctagtaacaaacgtaggtttgaaaaatttaccagagtgggagaggggcagtcctgtgagaattccactcatttcgttacatgttccagggagaaactggataggttagggtcaatgaagtcggaagaaattcttaaagatcacttatgcattaggtttcactttgtctctaggagtttcacactattccaaaagagtacaaggcaggagttagtctaatatgctccccagagaaggcttcataaataagctatattctttatgatctttattttcaattcaaggaccgtgtcaggatagacaaggtggtactgcagtattaaacagaccccagttctcaaaacagggaggttgatttgttgctccatactttggctagggctctgttctgtatcgtcctcactctgagacagagatggtggggcagccaccgcctaagacattattaatcaccgtggcagaaggaaggagaattctattgggtatggctttggcagttaagtgtcacgttctggagtaatacaactaatacacacacacacacacacacacacacacatgtagtactcactaatgcgcaggtggaaaataggatcatcacaataagcactatcatttgaaagagaagaaaagaacccacacaccatcactaacctgaagcaattccaaaatcttactgggaggctatttgaaagtcccttatcctagggctagatacatttttaaattattattattagatctggttctgcttcctgggagaaagcctctgtctatcgttctctgatcccctggtcccactctccctggtctccctgatctgattatcttctatgatcacctataaagtgagcattggaaaggatgccgtcctgggggctttgcagtttcatttgatcacttcctatatgtaagtctttaggagtttaagagttgtgttaggtactgaatagtgttcttttcatagtataatactctcaaaaccatagctccttttaaaattaattcagtacagttttgtatgctaataactacaccatcagttttattttttttctcggatgtacttttaagatttgctgtatttctgtgtcctttaggtgttgtgcttctcactcccaatttaggtgatgataatttcagactgtcaggctttgttgggaaaccctagaagattttccatgagaaaagaatttttagtctcttttccttgagttattctatccaactgaaaagatatattgagtcctataaccttaatttgattttgctcttaaacactttaatccattcataggatttataacgggtgtggtgaccacatcttgattaacccttactgaggctgagttgaaatatgcatttttagctcagtgcccttcccagttcttctgctatttaagaagggaaagcagttgccttttccgtgttcttggacctttctattccctttttttttatccttgcaaacaaatctagtcttttctgagctcatttgtctcttataccttgtcaaatacagatcacagtaaccaataaatgatacttacatcctgttgtccattctctctggtagagctacaagtccattaggtccttcatctaccttcgaaatattgcagacagcagtgttaccatatgctccttctctgtgttccatagaccacctctttccagccactaatgccaggttcctcagcaccagctctcaggcccctcccctattgcctcatgtagttgggatacttcacagcaacagcccactctgggtaccagttctgaataactttctactctgcaatcagcagtatgtacaatgattcagagttgcgcattaggtaatgctttggtaaaaatcaaaggttcttaggctcaatcaaagggattgagaaaaatctaagagactgcagagaaaacaattgaagagccatgtattatagaaattggagtgggaatgagctctcacagaaagaaaagtaccaactgaaaggctggtcaagatttcattaattcacaaagaaaattacaaaaactttaggaaaaaaacctagtatttgggatgtacaaatgagaccatgcacgttagatcaaaatttggtaaatataaaaacaaacannnnnnnnnnnnnnnnnnnncatgatagattaatcatgtaccaagccacctcttaggggattctgtgccagtttaaataatttcatgacttgggggtagagaattgtgaggagggaagaaagatttgctgggtaattcctgcagggttcaaaagacatggctccttacctcaaaacttacaacttgtattaaaaaataataaggcacacaaaaattaggaagacattttaatggtctactgttgactacagtagatggaagttgaagaggagaaaaatctgtatagactgaagccttcagggataatttcatataaactggtggctttaaaggataaataaaagttgtttggggtggaagagaagaaaaggctatttcaaaattcaaaagtcataaccacactggtaatattaaaaatattctcaggtccaaaagcatttagtcaaattaggactgtgatcatagcaatcaatgaactagtgtgcattttgacaagcaaaggctttctgattcttttctgtttctctttctattgatcatggggctaggaaaattgctacaaattatattttgctatttattttttgtgacatcaagagcaataatgtgtgctaagtcagaggaataaatgtacagcctagtattaaagtaatgctcctttaccccctctgcacactcgcatgttgctttcctaacaaacacgcaaatatgcaagcgtttcctagaagtgacagctaatggtataaattaacctcttgaatctggcattttcaaaactactgtagcacataaaagatagtggtgaaatatgaatagtaaatggaagaatgacatgtcctccgcctgctttcagaagcaaatagagggtttcactatcaagaaaattataggctctaggtttgtttaattactgagattttcaaacaacctttcttacaatgaactaatttgggtttgaggaaaaaaatagcagaagacagttctttctaaattttcttttaaaattatgaaaagcactcagaacattggacttaatcattaacagaataaaggcaaaccagaaatggtttatatagtttaatatgacgaatgcattaaattagaatagcgggtaaaaacttaatgccaaacagaaggcttattgccccaaattctcagactttcatgactttgtggcaaaataatagattttggttttggttttgttttgttttgctaaagggtcatcaagcagcacatgactaagtaatattgatacaggtagtggtatgagaaagttgtaaggaactaagacagagaacatgcttcacagcttagaaccaaatgtctactaccacctcaccatttactttttttctcatgttacaatttgttgtaaaccagttgaatacatccatagatgtattttcaacattatagacgttacgactttttctttgtttgaaattgagcatgtagtatgtacatgtacatagatttcttttcttttttttttttttttttgagacggagtctcgctctgtcgcccaggctggagtacagtggcacgatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatgatctcgatctcctgacctcgtgatccgcccgcctcggcctcccaaagtggtacatagatttctaaatgtaaaatctatagagaaactgtggaacaccagaattataaaattgggcatagcttcattgactaccagtataatgaaaagaagctcctttcaaagatttaattctacgttctaaaatatgtattgtgttatttaggttgggatttttttttaattttccaaactcttagcaagtttttgttttctgattcagattcctctaaaaagaacttttaataaaaagacatttgtctccaaattaagaactaaggaaatatccttttgtggttaatcactttaaaaatgaatatgaaattattattatcgttattattgagactgggtctcactctgtcaccctggctagagtgcagtggcatgatcttggctcactgcaacctctgcctccagggttcaagtattctcccacctcagacccaagtagctgggaatacaggcatgcaccaccatgcctgactatgttttttgtatttttttgtagagatggagtttcaccatcttggtcaggctggcctcgaactcctgacctcaagtggcctgcccgcctcagccttccaagatgctgggaggatacaaaattattttgatggaaataacacatgctgcatgattaataattatattttaaaatattacagaatattgtaataaaattatagtgataaatatatatacgcttatatagtagataattaaatttagaatggtttgtcatcattgatccatgttgcaagctagactctgaaaccatatttattgcaactacagatattgatatttataggaatatgttttgagaccatagacttttttcatttttgtgtttggttttgtctatttgtaaatggaaacatttatttttaatgtgattcttgattgcactcaaaaacaagtgcactggtggagtcaatttatgatggagtatagaggtgaaagaataaagggaaatacatatagaaatagcattctcccacaatcttaatatgcagagggaaaaatagttaattttagaaataactgaaacttagctgttcttgaaaaactacccctcaaatgaactcttgaattccaaggaacaatttaaaaattacagactgattcccttatccttcactttttcccttcccccaattgtctgatgtctggctttctactcaaattctactcagttcagtcaagcccctgcccagaaacctggttagctggtttgttttccctcagaactcagattctgaaatactcccctctactttgcctcattcatagagtaagtttttgaatataaataaaaaactacacactgggtacagtatacactgctctggtgatgggtgcaccaaaatctaataaaaattcaattttattttaaaaactttattttttaaatcattttaaatctctcacaatgtctgtagtttcagtgaataaagagtttggaattaggaggtcatgaaatttaactatataatcttcccagtgatttctatactgacctcaagtagttgtttcatttgccctatcttaattcctactggtgatttcattaggaataagggttttgataagaatagctttaaactggatttcagtaatgagatggtactttgtagaagctaatggttaagagcacaacaggctgtagagttgcagactgcctgggatcacttactagatgggagaccttgggcaacttacttaaactctatgagctaatctgtaaaatacacataatattagtacctacttttctggatcataagaggactaatgaaataatctatataaagtgcatagactgggccctggtataagataaaccttcaacaaatattcatttttatttaatttactgttactaattggctttttttcattgatcaatgaaaattgttttaagtaactaatgtacctactttgatttttatagcctggaaatagtaggaaaaaaatcacaagtgatgtgaaatatgtgttaattctattatagaacaggaaagctgttccatttctatgaaaactgggaagtacaaagagtttgactgatgagggcagaactaatgctgattggtgaaggtaggtcttggctcaggttcagagagagccatctaatgaccacaaccttcaagttctagacgcacctactgtgtgaaaggtgaattcctttttgctttcaataaaggagaatccagagaaagactggttgtgctcttgagcagggtgggacacctaggaagtgtctcttgtcaaagacataatccttgattttgcaggtccagaaattcattttgtgaggtaacctagaaaattaaagtctgaaatattagttcattagaaagttacaaatgagtgagatgaaactttgtcaactcaaaaatacataataggtttgtcagaaaattacagattgtgatcaatagcccagggcattccaacaagcagtacatgacacctctcagaatctcaaactgtgattcagagagatgtagaacattaaatgaatgttatgctgtataagtctcctacctccagaatgtttctatttataaagtttagtagcattttccccaaatatcagaacctcctttttaccaggacaggatttatacgcattgatttttccttgggggttggcaacctgtacttttaatttaatgcagaacgccagattcttgattaaaatattttattttaaaaaaattgactataagactgctgaataacttctattgtccctttattacattacaatccttaggaataactcagaagaatatggctatgaatttgagatgttttattttgacccaagctcagacttgttcttaggcaagataaggcctgttctgtaaaaagtatccatctcaagtgtgccgttaatattctgaatgtcttccttttctggcaattttcattttttttatgtccttgctttccttccccttaaagcaagctacctgttttccgggcagttttactctctgttctcttgattcctctgttattaaaagaaaaataagtttcacttaaaggtagttatgattaggcaaggcactcagaacatttttcacttctttgtttcactatagaaaatacgttagaactttttgctcattgataaaagcttaaaagtacaaatctactaatagtacctcaatcttgttctttctctagttgctaatttgacattttcctctgcctgattatgttggaggatttctcattttctatccctaagccgtgcacagctcataaaaaacagtagttgccaagtgacaggtgtttttggaaaacttgcttagtttatacgttcagagaagacattgcctctaaatcagcagctactaatgaccttttgttccagggagttgttagagatccagatgaagtcctgtaattgaagcatagtttaggcttagcccagagttggtattttccaaatgtactttgttgagtttttgtctctgccctaagcatttattcttggaattttcaagattcacacagtttcaacaataggttattcattttcttgccttctcttcccattctcatgttctgctttaaccaaaacaacgtaagttattgaatatcatgtaatgctagagtgtcaacagacctgtgtttcattctgtcctcaccatttgccaactgagagacctttagtaagtaacaaaacttctgtgagtctgaatctccaaatgtaaatggtaataacagtctcacttatcaagcttttgttcattattaaataatttgtgaaaatgtctagcatgctactagacagatagtatatgttcaataaattctcattgttctccttcagccttaagttatcttttgagtgctttattttttatttttcactcttttgctttctttagtaatgatatttcagttttgactttggttcataccttttcctttctgtgtcttcactgtgcttgccttgccttttcttctttcctttcttccacagacatatactgaacactcaatactatgctagacactgcggatacaaaggtgaatgatactgtttgatggagttcacggttttatgggagcatggatatgcacaatcaaatgtagaatttaaaatgaggacaagtgtactgggcatttgcaaagcaaaacaggttagcaaaggcctcctggaggagggtaatagctggagtaaaccttcaagggtgggactaaaccagtgcacaagggggtgtgtcttctgtgtaaagggaacatgttccaaaagcaaaaaggcaagaaacaatctgttaagaagaaaccacaaagatttcctaagaagagagaatggcatgagttgagatggaaatgattgggaaaggagagttaagtcatagagggtctgggtttagatatgacaccctcccctttaaagttagtctgagcaaactttcaaattatacagcactcttattatttcttctgacctccgccaaacctctcacgtgccctttactaccttagctatttctcctagtgggactgcgtcatattcctcatgtaagttggagtaggattaaaagtttattagataaaagggagctcttaaaaaagatttagtcttaaagtgacatagtcatatatgtactttaaaatcacttctctaacttataggatgaatgaattttcacgaaaaacttagattctgtatgaagatggctccgatctactaaaactttgtttaacttgaggaactcagagctatgtgaaatttgtgaggaattataattggaaaataatggttttaaaggttattgttaatattagaatgtttaactttttttaaacaaaaagtgaaaaagcaaaacttaggaaagacgaaggcttaggtctacagcaatgtaactaagcaattccaagattgcttagtacttactacttagcctaatctttaatttgatacataatattgtttctcaaaaatcttttgcactgatagtggactaagtagcaaggatcagtaatatatagaatctcattcagatatgtatttttttaccttcaggagtggtccacttggttggcttttaatgaggccattttactctttgctgttaatggtatttgctcatttgcaggaacaggctaggtattgtatttatcttttcccttataaagaaaaaagtgacagtaggcaataaataacttaaaattagtaggctctgctgggcgcagtggctcaaacctgtaatcccaacactttaggaggtcgaggtgggtggatcatgaggtcaggagttcgagaccagcctgactaacatggtgaaaccccatctttactaaaaatacaaaaattagccaggcgaggtggttgcgtgcctgtaatcccagctactcaggaggctgaggcagaagaatcgcttgaacgcgggaggcagaggttgcagtgagctgacatcacaccactgcactccagcctgggcgacagagcaagactccacctcaaaaattaaataataagtaaataaataaaattactaggctcttctataccatgtacaaatattgggatgaattttttttttaattaggacttctggaaaagatttgtgtttcatagtgtttcttctagaattttactatttctttgacagagagtacaaacattcagttgacctgtttgtcttttgttcagtaattcagaaaaatatattttttatggaacatatctaaagcaaaatagcttaataggtatatcatctgatttcaacttcggaaaatatataaatgtacatctaagcttctagtgaatggttgaaagaagtatatatggtgtgtaagttcttaagccaatggattcagcctagagcagcagacctgttcccagcattttaacactaggtgtttatttacagtgatcaaagtgagaatgtgttacatcagaagttagattaatagttttctttaacacctctactttcacaataaatgtgctttaagtcctgacatacagatagaaaaaggctttaaagttgctttttaatgtgatgatctatacaacctctaactggaatttgaaagctggggccaaataccactgcagctcagatgctaaagctgtttcttaaaatgaagcagataaaaaatagagaaaatcttttttaaaggctactttgctcctttccttctccataactaaatgttggagctttctgctggggaggggagagcaaaattggaggtggaagagaaccatgaagaaggcggtaggggcagttgtttttctgtgcctgctgacgtcaacgaaattgccagatggcatttgaatgctttgcaaaaagacaggagccttttattacagctgtcacatggggtttcattcatttgcattcccagaagtggtctaaagctttccctaatgtaggagtaatgagggctctgtaccttcagagacccagagggccttttgtaggatgttgttactttaagtggctctgataagggacacaggctcagagaatgccatgtttcactgtcagcttcagaggaccataaactactcagcttcaattaggactataatgtgatcattcaaaaaatattctctccagaaggacttttcatggatcgtgacagctgcggaaacacattcagggggacctgaagggtctagcatggcagtggtgggctacagaacaaaaatgcagattccgtgaattgaccccaagactgaaaaataaccagtgcacaacagacctgagcatactacaaacagctttgctcttaccattttgccccatgctgccttgtcagcccctgctcaatatgggggaaaagtggacctttccgataatctggggccctatatgtaggagaaaaagaagttgaagtgccaggagctgctctcagaagctgaccctggggacacattctcaggccaggctggcctgtcctgtctatacctcaacccttcccactgccagaagttttcatgttttacttattttttgcctggaatttgtcaagcttttaattcatggggttatcctttttgtttgtttgtttgtttttgagacggggtctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgaggcaggagaacggcatgaacccaggaggtggagcttgcagtaagctgagatcgtgccactgcactccagcctgggcgacagagcaagactgcatcttaaaaaaaaaaaaaaaaaaaggaaaaaaaattagttcacattagttcatatgaaacattacctagtttcaatcttatgcctacactcacggtcataataggttacctacagtgcaacagatctagtgaaaaatcttatgccaccttgtgagttggcaacgtattacatggatgtgaaggccactggcttgagtgatggacaaacctagaatagttttccaagtgctctattacgcagcatataaaacaaaggtactcttactatcccgtgctccaaatgcataatgcataagctcagccatggaatattttccaaatgtaaatagtggaactgctgctgagtgtattcatttcattctgatttctctttctgattcggcttcagggtttggggagatttaggagatgatggtgaagattataaaatttcaagaagcaccttccaacttcctctgaccccttttcttctctcaactgcaggggaaaggggcacaatcagtatctcgtatgtatgagcaagttccagacctgagtgagaggtggcatgtggtcagtttcaaggaacgagagaccaacatccaagaatagtctggaggagaaaggacatatcaagaaacacaactcaagctgggtgtagtggctcacgcttctaatcgcagcactttgagaggctaagttgggaggatcacttgagcccaggagtttgagaccagcctaggcaatataaagagccctcatcttaaccagaagaaaggaaagaggaaaggaaaggagaggaaaaggaaaaggaaagaaagaaaacaatctaaatggtcagagtgatgggaattttaaaaggcagcaggcacacatttaaattatacattcccaccctagacagtacaaagatatgcagatagaatggaaattagaaatgaattcatgaataaatgtttcacctcgggtatacttgggcctaaatcccaagagcatgtaggttatggtgggtctgtgatgtgtgtttcatgtttctccaagaataaaccttaggaaagctgtaatgataatagcattgtcccactttgcacgtcctagctccctgtccacttcgaaagtgcagagcacttgtaccaggcataagtattgccattgttgatagtataatggttgttattatcatcactactctgatatgttaaggtttgcctgaatatgaattaaaacaatgtgtttctgaatgtaactgcaggtgatagtcctttctggcatattatgcctttccccctaaagtcctaaaacagtaaacctaggtctcttttgtgtctcagctacagaaaaataatgttttgttaattcatctcctttagccacaaaataagtttttgattgtacagtaatatactatatttcatatgttgggcagtgctacagttcaaggacagtatacagccaatgtacatacttaactctgttttgaatgacatgaaatgacaaagaagtgaataatcaattgtcaggctaccttagggtcaaactgtcatctgatctgactttaataatactatttttcaattagaagaaattagcataaaatattttaggacctagcatctcaatgctcatggcttgttccagaatacaattacattttacaagaaagtagccacgggagtggcttcatgataacacacagatacaaccttctaatgccgaaggcaaattgccaaaatatgtgcattgttagggatcagaggaagaaagaatgatacactgttctgttctctcattttgagccccgtaagtccagtctaggggctggtagagaggtgttattcttttttctcagactcaaaaactgtaagcctacccagagaattcaggtttcacagaacttaggcattttaacttatctcatgagaggctgattaataaaccagaatgtcagtgtactcatttttcttgagaactgtcatagccaaacagattgtaataatcgtggtggctgtccagtattttgttttcaaagtaagaaagtctacctgggcaaacacatcagtgaataagtaaatgtatttataatttggcaaacatttttatgcacttcattatgataagcactggtgatataataaagggttaagtaaaatacatggtctaactttaaagaaagatctgcaaacaaataattcaagggcaacgattaacatataattttcaatatggcacagatagcagtatgtcttccaagcagaaagacaataattcatagtcttaggtaggttacattactgaaagctgataaattgcatctgtttaaagatgttagtttggatttaaggggaattttttttaacccttcaaacctaaggaagaaagaatattgtgtcttaaaagcatatggaatgccagtgtactaattacagtggaaaggtcaaaaggttgtatttgttttgagggaacagagagattgactctagattttcagaattacctttctttaaaggtataaattgtcatcctgcagtaaataaaaggaattcgaacaccatatccaatcattatgtttttaaaaactataatatcaaacgactatgctagcaataagtcaaaatttgttcactctatttttttccttcagtgttctagtgttttccaatgatgtatgtgtgctgttattataacgaaagccactttctgtgaagtgtccacctatgcttgagtactaatcatagaaaggagctctgaaaataagcagcgggcctgtagtcagggactgctgaaaatgagggagagcatcagggaaattagtgcactgtgcctcttctttcttcagtactcctttatgttcattgctcatggggatctgtgtttgcctgttaattgagtgtgtttattgcaggcagttgccttaagtgacatgatactcagtaggaggttgtgaggactagaaggaggtcttgtttgaatacaaggggtgggggagtcacacttttcagaccgattagaataatgagattctctaaacagttgagaaccatttgtaagaatagcacgttgtgttagaaggcaattagagctcattcttttaataattaggttttttgagttcttacagtatgctgagtactaagattataaaaatgaacaaaaattgttctcaaatgcataatctggcaaggaatttagtcataattagcaatacaacaatatcataatagatgttgaacaaagtactatggagacttcgaggctgaagcgattaatttggtgtcagtttgagaatgaagctggaatgtttttatatattaaagttgaatcttgataatcaatactaaataaaagaaatgaagtggtaggcagaagtaacaccataaaccaaagcatagggttgtggcatcatatctgtaaagagaatccaggttagctggagggatgaggcattagtagagcacgtggagatgtaactggaaaagggcggcgggttaaaggttaaatgttaacacacttaaagacaaccaagaagttgaatgttgttccctaacttcgcggagccctgaagtggcagagcagcataataatatctctgcattgggaaaagccaagtttgtggcaggaagaaactagaagaaaaaaatattgtagccatcctcgtgtgatataatgagagatggattaaagcagggatgagaggctttttaaggaaaaaaaaaaaatgtcagtcttgcatgtaaatttccagatccactgaccaatttgatgttgaaggtaagaaagcaaagaataaatacaaataaaacctaagagtcaacgtgtccagttttggttagtgattttggttttagccaagtaggaaatacatgaggaaaagatttccaaagataaaatattttcttttggaaagttgagtgtgaaattgctttggaatatctgagtggagctgtccagaagctcgaaggagtggtcagtgttggaacaacagattagcgggtactgtattcattataacatagggtgagggctgggagggaagggcacagattaatgtggataaaaataataaaaaggaaagcagacagtgagtttgttctcaggctggaaaaaagctaggccagaagaagaggagatggctgtgcctgaggtgctaggcttcagtaatgtctggtggtgaagcaagaaaaagccaggaatgttgtcattagatattttgattaagatatttattaatattgatagagaattagtgagagcagaactctctttaagggctttcaaaatgttaatagattataattttttaaaaaatggttagctccttagagatggggtcaaagaccctaattttgttagtagaggaaatgctaacaatgtttttaagttgcgaggaaaaagcgaggaggaaaaagagaatgaataagaaatgcactaattaaaacaaatatgctgtctattagaaggatgaaattaaaagtacagtggtaggagactggtattaaccaaaagaaaaaatattatttgctcattgaaacaatagggaggaagtcaagaattaagaagtcctttctatatttagaaattcatatgaagccgaattaaagtcctcaataaagattggatagcttatttttgtatattttctgccaagaagaactggagaaaagagaattcatttaaactaattaggggctttttttttttttgctgagcctggtacctgagcaaaatgctgtggggttagaaaatgagtatgaaatgacgctcatctttaagaagcttacagaatccaaacatgtctgaagtgcctttctataagaatattaaatgagtagcattttgattattaatttgcctctaggattcagatatggatagtatgttgggggctcgcttgcagaaatgagtcacttggctaagagaactagctggtgctcatcactcagccctcagtaggttaccgtgtttggctgaacctaaggtaatcatatttttttattgccttatagcattctgaatataataagattataactaaaactgttctcctaaactgaagttattaacccagacttgtagatcgatacattataaaattttattattaccacctatttatctatacagttggtatattatatatatacagttggtaaaaaaaaattatgctgtattagaatattttcaactgtaaataaaagaaaactttacttcaactagttgtagcaataaagagatgttattatttctcatgaatagaaggccaaaggagggaagccttcaggattagtgcatttagtgaattcagcaatgttataacgcacctaggttttttattctctctactctgctactgtctatagtattggtctcatcctaatgccgattctacttgtgatccaaaaatggctgctggcagcaacaaactttcttctgaagaaaaaggatttccttttctagaagcatgaagctaagttcccctcatatctcattgactcacattgacttggcctacccattcttgatcaaatccctggctttggagttgaaattatcatgattggcacagagagtcaatcatgatagccactgcatatgctttgaagacagtttagaattagacatttccaaatgtctttggacctatttgtcttaatatcagaatgttatcatagtccataggaaatttaatgaggctgtcaattggtccagcagccacaagacatgcttgatggatattcaagaagctcttataatcttttgagccagagtagaatgtagctgatgatagagataatatagcaagtttaaagtatttgtttgaagtattgaaactagtagggagacattttgaagctctttttagttagaccttattctgtcttaattatatattcttcagtttgccagcagggccagcacttgaaaggggccattgcatctgctctgtgtccatttttaagataaagctttgcttatttgtttttatggcatatttcaattaaagcattgccaccctactttagtccttatctccctattttaagatgaaatgaaattaaaattgactgaaatgatggttaaagacaaatttaatatcaatgtttttcctacatcctcctccttattttcagaaaaaaacatatttttaatcagtgcttgtattaatcttatgattataattttaaaagattatttttgaattcattttgtccttttttgcatagatctttgtcttaaagaacatgtgctgaatttctgtagaaattgactcttcatattccataaatctgttggtattaccatacaaacactctgtggaagcattgactgaactagcaattatgtctacaagaagaaaacaaatctatgacagaaatcctgagtgactcactattatgaccaaatgacttatttacttacttaatttcctcctttattcagcaacacattgttgctaaatgtggagtggggtatcattttgaaatacttcccatacaaaaccttgatgatcctgcctgacatctgcccactaaatgtcttggtgagccaccatgtctgctgatcctaggataatcatattttttaattgtctcataacattctgaatataataagattacaactgaaaccagtttcttaaactgaagtgattaacccagacttgtagacagatacatcatacaattttatattcattaccacctaagaggaaaatgaagacggatgccttccttttagcaatagaagtctccacaagaatccacaagtttttccttccggggcaaaccatatgaacgatctggcttaagtatcagaaatagagagaataagtggcatttttcttgatggaaaaatattaatagtgggacctttcctaatacttagttctgggaagagtctaatttgacattttcaaagaagatgtgaaagaagggagtcaaccatgaaatcttggagtttactgatgatgttaacaagttccccttaataatctttatctacttaggctctcattaattggaggaagtgtttatttaaaaaaaataccgtatagcaaattggcaaggatattttcatatcattgaaggtaaatgactgtacataggaacggtacccagtatttagcattgtgaatagcgtagggcttcggatccagaccacctgggttggaatgtcatctctgcagcttaagatctttgtaaccttgggcaaattacataaccttttgtgtgcactgctttcaaatgttgaaagtcactccctttacaatgtcattgtttagatctcttgagttgcatcttagaaaatcaagaaattatattacaaactgtagtgtattacacctacctgccctatatgtaaaatgacttacagataagcttactccattctcaaaaaccagtaagcaagaaggaaccctcaggtattctgagagggaagggagtttcaagttcccaactcattgctgggtggatcagaagctagaaagccttgaagtccatgtttcaaagataagacttaggtgttggatctatgagacttataggggctcaagattttgagggaaatgctatattatagtgataagtatgtttgctatctgtctttcacccttctcacaattctcttttctggataataggcttttttgttggtttttttctttttttgatcctactttgaagagaggtatgaatgataatggtgactctgttcagagtgaccattttcaaagtttggaaaagaaccacatggacagattcaggtgttttaggatctgcactttgagaaacaactgttttcactttcaaccaacttctttcactcttcttataaccaggggtactggatacacccacagggttttctcctttatcctctaacccctttcagttccctgaatgccttccactagactgcaagctacctaaaggtagcagccctgattcattcatctctgtagccctaaggtgtagatagtaccaggtacccaatagatttcagttaatatttgtcaaatgaatgaagaagaaatggatattttttcagtacctctgtattccctttgtgacattattgaaatagggtaaatttgcagtggaaaacaaacaaacaaaattctatcatacttatgttttttttgtgctcataagcttcaaaatcacttctaacagtgtttctttagagaaaacacactctgttttccaaaaatatttttacaagtgttttgaagtttgatctatttttaagtttgaaaactttattattcgattgatggaatccttgattagttgtagcaaatgaaatttactgacttttatttctttttttaattattattattattattattattttgagatggagtcttgctctgtctcccaggctggagtgcaatggcgcgatctcagctcactgcaacctccgcctccttggtccaagcaattctcctgcctcagcctcctgagtagctgggattacaggctcccaccaccacgcccggctaattttttgtatttttagtagagatggggtttcaccatgtttgccaggctagttttgaacacctgacctcaagtaatctgcctggtctcccaaagtactgggattacaggcgtgagctaccacaccaggccctactgacttttaaaatacatttatgaggtgtttaatgttgtgttaaaaaattgggggctattgaaatcacccgccccctcaaatgtttacactgtggaaggcaatagagattgtcaaaggggaacattttcttagttggtcagacacaatatagattttattaactcacaagtgaattattcacaaattattttgtgaagcctggggtacttagagatttctgaaagaagaaattgaaagaatactgtagacagagtaaagaagactattataggaataaatctatttcatttcttatgtcgccatatctcacctatttccaagtgcaaatgattctccttaatgtaactttcactcttttcttcctgggacattcatgctgtgaatggccttgtttcccatgtttattgttgtggcagccttggtcaaatcagccttcttctatgccacaccttaatcttcctcaagcactgcatactgtttgattatatcattttccttgtcagccatctttcgtcattcagttaccaactgatagaattagaaatctttgtctttcattattgggcatctgaaatctagcctcatacttccctttcaaccttcatttctgctaataaaaagcagtaacttcccctgcctgagagtctagtctgctaatggacttctttacccattcatccttcttatgcagtccccacgtgctgccttcatgcttcttccagcttttctgctctgccccccacttactctctctagacctgttctttcacctcaccaggatctccagtccagttggccaatctttctttcctgtctgtcatacttctcctgttttctctttgttgccttttcaagtcaaattttatgctgagtaacactgggaagtactcaaccgggcctttgtattgcttgagaatctagccagctcttttttatccctctttcaaaacttttcattctcgtttgtacttctaacctcaacattgcccacatcacgttttcagcaagggactcagtgcccaattcacggtgtaattcacagtgtaaataaaagtcaacgtataaaaatttgtttaacttctcacctataaatctgtattcttctttcttactgttatcatggaaaaggtatctcccattgtgaaaggttactcctgtaccccttannnnnnnnnnnnnnnnnnnnattttacagccagttttcatgagacttgtctctatgatcttcatttttctatcttcctttcattgctcaatttattgcaatgtggcttgctacctcagtgtttcactgaaactgtagtctgtagagttgccagtgaccttccaaatactaaactcataaacatttttcaagatttactaatctctcaaacactgatccactgctgaccactccttgcttcttaacatttccttggtgccatggacactacactcccagttcttacttgtcccttcttatttccttttgtggatttcacttctgcctggcttttaaaagttgatattgattatggctctagcctcagtatactcctttctcttcacacactttcatggcaacatgctgttgaaatgaccatatatatgtcttcaatgcccaaatgtatatttccagttcagaagtctctcctaatatgccactggaatcatccaataaatacctcagtaccctcgtccaaactgattccttctcttttgattcctcattctatgaaagactcttagctacgtatcttcccaaaccttcatcctgaaagctagcctgactcctctctccacacatactgatgatgccagtattctacaggactttcttattgcccttactagttaatcaaagctcttgaatatggctcatattcctgccatgatctgtttcctcagacctctccagtgtcaacctttcaaactgaagcactgtgtacttcacctgagctttgtcttcaaaaggccattctttacctccaggcctgttaagatcttttccttttccagaaaacacaccctaatcctttgcttactcttttcatgtatgtacccaattgtggaaaaatttgtaggattgctttttgtgtcagtactattacttctccttggcattttcactgttttctggacagtgcttattccagaatcaggttgttaaataatagtttttaatcatgactccagtatttcagtgtaacaattctcagtatactttaagtgtgagattagaacatgcaattgtgctaggaggttgaatgttttaagatggcttccagaaaagcagtgatttgtttcaaagaactgtctcaaacactttaatttacttgtcttttaaggtacagaattggagagagggcatttacttatctttgaaggtttggagtatgttacttatgcagtcatcatttctcatattattgagtgcccacaaagtaccagataccacactgggggaatgaaacctagcattgcccttgtccttgcacaactttgagcctgaaggaggaagacagaccatcacatatagacataccaaaagctgaatcgagaattgtggcaggtgctattgcaacgaggatctatgtatatatgtaagatctggtcagagatgcaaggtttctcaaaaggtatagctccaaggctttttgtttgtttgtttgtttgtttgtttgtttgttttttggcttgctttcgtttctgctgttttcagagtatgaatggaatatcccaataggcattaacgtggaaatgtttgtatggtcctgaagcagtcagggaagatgtcctggattaagtgtagaagaggcaagtcagtagcctagataaacacccattgcatatggggcaggaaaaagtctagtgttgatatggataaaacaaatggcagtaaagttccacaaaacagtgtgttcaaaggcatttgatgttttgtgttaatattttaatcacagtagaaaattacatgtgggaaaatgttaatcaaattgtgcatgggaagaagtcacgtttctaatatgtcttataaaaattgagaaacgtaacaactaaaatgtttgcaacttagacaaatcattaattatgtaattgtaatttcactttaacaatgatcctgagggataagacacattttaaattttttatttctaccagtagacttatgtaagttattcttttttagcttttttttttgttttctgtgaaaaaaaactaaattctgcctgttaatgaggcagtagcacttgttttaaaagagatggtcagataattcttttaaaaggcagaatactgccatctgttgttcactgaagtttttagcctaagcaaacagaagccttaagttcaaatttaatagcaattcttgatatttaacagacaaagaccagcccacatttatcagctttctgagttcgtacttatttcagagattcttagttattcctatcattttttaaaactctttctcatatcagagaagtgctcacatccagttaagttctctttgcttcctgtttcttccaacaacagaaataataatgttttttatttacaaagtaatttgtacttaaccaagccttcccacatttgtgtgagcagtcacatgagtagctcattgcctgaatttattatatctttgccagctacatcatcttttctaattaagagaaagagagaaaaccagcgtgcaacttaaagacagctaaggttatcttctgaaagatgcgggttcttactagagtaagtgatgaataagtatgttccatttcctaaataataaaacactattgtaaaattgttaactttgagttgttacgtgagttcgctagtgtctggaaagtagttagaaaatataaacaagacagaatttttcaccaatttttgacttgtttgctgatagcttgcagggacttgtataaggacagaggccatgtattccatctcatttggtgacttgcagtgctctttgaacatcaaaagagaaggatgttaagaattctggtaactaatgaagtttgttatgtttcacatctcacatggaacctgcccacagacatgttgggaagcagtttgatgaagggccctataggttttcctcctactgtacatatatattatcttaaggaaaaaatccaaatgtaaactcatattccctgccagaaaattaaaatacgcaaacatctgcttccttaggatggcctttagccaaggttcagcctacaatgagttactgcaaaattttcacatgatttcattttttaaaaatttcccaaccaacttcaagtctaaaattataaatgggtcctatgaaagtataaacacatatgcaattttgctgtctctgaggtcagaaccagtaatgcaccaaagatcattgtatcaaatccagctcatcttctaaattaatgtagtacattaaagaccaagataccatttcctagtatcacagacagcctcccagagaaagagttggagggatggagtggcacgtagtgctacagagatgtaggaggagacagcttccaaaaactcatcacacatcttttcccagcattgaggaccaaagttggatgagaaaagccccagtgactatttcctttttatgtgtcatctcttacactgtttattcgtctcttatcccaactccctttccaccctaagaatattcctcccatgctgtgtttgcctcccagggtgcctcccaggatgactaaatagaaagaaaaaaatacttccaacaatggagctatgatgcctgcttttagaattcttttcacatcctgtgttataaatcattccaatgcaatcaaccatattaactgaaaccaggacttctgtacaatcactttttaagaacttaaaattaaaatcaggactattatgagtattttgcagtagggagtacaatatatctgactgcatttacctagagtaagaagtggaaataggtttttgtttttattgttttatttatttatttaatttatttatttattttggtagagaaatcatatctctgtgctatcttcatttataaaggaactactggcccagttcatgtaggggacaaacacccacgtgcacaacatacatttctttgcacacacaatctttctcaacaacaatgtttcaccaacaataatgataatgttggtgatgtataatacttatcaaacatatattttggaccacgcactctcacaagtctttatgtttatgatctcatttaatcatcaattacactatacagtcgatattactattaatccctttttagagaggagacaagagctaaagaaataaaatgagccaggcatggtggctcacgcctgtaatcccagcactttgggaggctgaggcaggcggatcacaaagtcaggagttcgagaccagcctggccaacatggggaaaccctgtctctaccaaaaatacaaaaattagctgggcatggtggcgcatgcctggggtcctagctattcgggaggctgaggcaggagaattgcttgaaaccaggaggcggaggtggcagtgagctgagatcgtgccactgcactccagcctgggccatagagcgagactccatctcaagaaagaagaaaataaaaaaggaaaggagaggagagaagaggggaggggaggagaggggaggggaaagggagataaaatgaatttactttttaaataaaataaaaatcttagcagatctgaaatttgaacagaagcagtctaacttcggttcttgcctccttaaagaccccatgtattacctcatataataaatatttgatattgatgaatgaaaaaaactttctcttatatcccaacgttttaaaactctgctttccaacttcccacatacacaaccttacaaattatatatatgacaaaaatatgtttttctacctttttgcttcccaaatgctaattcataaaccaggcttagctttctagctcttgttccaggaatgttaatgaatagctttaacaccgcaattacattatgtctcattttaagggaaagaaaatattgagtttaaaatactatggagctctcttaacagacataattaggacaaatagctggtctgggaattttaaaaagtttttaaagtagagaatcataaaaatatgatataaattttctataattctagtaatatattttaacttaatacatagagtatgcaggtttttgcacatctttgatgaagagccaagaatgtttctctcaagtatgtgtccactgaagtgactggagtttcaggttgccgttcttacttacaccatacccatatttcctatttcattgtacatgcttgccagtttccgtttctttatagtggaaacaacttaggaacttggaagcattctgagttgaaaagcctttaggtgtgttgtgattttctttttgaatctttatagttgtatctcccctacttaaatcaagggaaatacattcttaggctctcacccttataaaatctatttatgaactctgtgtaaagctacctgacttcgttttcaagggaacaattccatttttctgcaggtgtcatttctttgtagatattttgttagtctatgtaatttacagtgacaaatataacaggcctaaagagatttgggaagaaaggaaactgacactaggcaaatgcgtaacttacctattgggagaagtatatggaaattccaccaaatagcctattccttgtgatctactcagtgtacactaggcaatttaccataagaaggaaacagcatcagtgactcaataacaatttataaggtagagcttgtgaaagattagcaattaatacaataaggacttttctaagtctacataataattttaaaatctttttttaaatgtaaaatgcttaaagatgccaagatgtaattttaaaatctttctttttcttttttcttatttgatgggggtgtgtatgtgtgtgtgtgtaaatgtagagaaatgaattacttgcccaattggaagggaccttcaaaagatcccgcccagttctctgatttcagaggaaaagagcctgattgctctgttggatacagtattgcctataaggaaacctgtaggtttggttttggaagtcatcataaaacttaagatatttttaagtggcctaatttgaagtatatagcatttctacttggttatctagataatttctcaattctaatgtttcagcatttgtaacctatcttcaagtttcatgtagacttacgaagagaggcttttggtgctgcttctaattcttttcctccagttagaataaattaatttccaaagcaagtgacacgccagaatgttcactgagtcagaagactggagaattattacattttctgcctgtcagcctatttaattaagttatcaatttaatctgtgatttaaaatatgtagaaagcagagtcataacttgactatattggtgctacctcaaagcaaatttatcaagaattggatgcattatcttcatctacaccccaggtgctagataatctccttaatcattttaaagaataaatttatgttgaccctaccatttctccagtctttttctgatttttcctttgggcacctttactttctttaaaaaaaatgatgtgtatctgcttttttttgtttgttttcatttactcttttcacataattatttcctaagcattcttagattttatcttttagaaattctccagttctcaatattttggcataaactcaaacacagcaccacagcaaataatctgatatgttacttaatgatacatgattttattttacattctgttcgtaacttggttacatagacttgttagaatttttcatagtttgcaacttacttagaaaattttagaaacttagatgccttttatagcacgcaaataccttttgacctccacacatattcgaagatttcccttttatcatatcagtactgcaatgtcaaagtttttgcccactagtaataaaaattaaaacaaattggccgggtgcggtggctcacgcttataatcccaggactttgggaggctcaggtgggcgggtcacctgaggttgggagtttgagaccagcctaaccaacatggagaaaccctgtctctactaaaaatacaaaattagttgggcatggtagcatatgcctgtaatcccagctacttgggaggctgagacaggagaatcacttgaacctgggaggtggaggttgcagtgagctgagatcacgccattgcactccagcctgggagacaagctccatctcaaaaaaaaaaaaaaaaaaattaaaacaaattttctgtaattgattgataggcacacgtctaaaagtatgtataatattgattatacttgttgtattttaaacttcttatctatagcatcagactttctgggcctttggtttatgatgagtgaaataacttagaaccactctagattgtaatataccaaggccattaacagttgtggtagtctaaagccaggattaggtaggacatcctggaaatgggaaagtagactggatgaagataaaagaggaaaaggaagttgtttaaaaactgagtactcagtcgggcgcggtggctaacacctttaatttcaacactttgggaggccaaggtgggaggattgcttgaacccaggagttcaagaccagcctgggcaaaatagcaaaaccccatctgtaccaaaaatacaaaaaaattaggcatggtggtgtgagtctctagtatcagctgctagggaggctgaggttggaggattacttgagcccaggaggctgaggttgcagtgagctgagatcgtgccagtgcacttcagcctgggtgacagagtgagactccgtctcaaaaaaaaaaaaaaagaaaaaagaaaaaaaaacacattggaaaatggtgaatttaccaaaagtatcagttatttttggcttgatatataaaaccgcactttcctccactgtttatcgtactgaaatgccacattttctatttaaaggtggcaatccaaatttggttgccatttaaatagtgtctagggaaatacacttgcattttctgaaatgttaaatataaatatttctattacaaggagagtctgtgaagtagaatgttttatattgcttggtaactttttttttttaaaggaaaagatttgtttgatcatctgcaccataagaagactcaactgcgattttgtgcttagtgtggctcgtactgcactgaaagatggtttcagattgttagttttaagacttttctttaaactggcttttatataaacttaacatttagtatttattatcactatctaagatttcaccagttaaataaaacatttctgagtaccattggtatacctcaatatttaattatattatttttttcaaagttaataggcatggaaaaaacttctgtgtgaatcacacaattttttctcactttgtacatgatttaaaaaacactaccaaaaaccaaaacccctctcccttaaaattccttaatagggacatcctagacatacccatcctttgtagcttacctgctatttattgaaacagcagccagtccatctttctgtttttcaccatttcatgtgtggttagccttggcaggtttgctgcaaacaaatctgattgttggttttaaattgcatgcctcattgaagcctttagttatttgagcaaaaaagtggtaataacttcttacgtgtgatgtgtctgttgactgtaacataattttattctagaatcatgaaaacaacaaagtgaggacctgacttaatgatactaaggatatttttttttccaatagtagaagtgttcacttcagtttcttagctaatttcaataaggataatttgtctctcggcttgaatgttgcttttgttttcacttaaagacctttgcttttgcaaaagctacagcataatagtagcatcaaaatacataatgtgcttattttctgaattcttatgtaactgtgacattgacttataaagatgagttttcagtttctattttaaaaagtactttttaaatgtttactattttttctatatatacaagaaatacatctattactttaaagaaaaaataaaatgtattataaaaagacacacaatttgataattataaaaaaacttgtcttcttcccaataatttatttaaaacttgtaattctcatgaacatgttctactttttcttcagatttgtagattttgtatactgagaacattttaagagaactttgtagttattactagagaataaacttaatttcattggcaaaaacatttaaaattttgtcttgaaaacaaagtttgacttaaaatttcaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacattaaaaattgaataatgatattatgctctatttgcagatgacatgatctttatatgtagtaaaaccacaacaattctacacgcacaaaaattgttagagctaacaaatgaattcagtaaagttacaggattgaaaatcaacagacaaaaatcaataacattttttatatacaaataagtccctagctgaaaaagaattaaaaaacactcccatttacaatagcataaaaaatacttagggataaatttaaccaaggaggtaaaagatttgtacatcgaaaattataaaacactgatgaaaagaattgaacacagaaatatatagaaaaatattccattactcaatcagaagtattgttaaaatatttatactacccaaagaaatatagaaatttaatgcaataactatcaacatcgcaatggtgtcttcacagaaatagaaaaatgcaatcctaaaatttgtatgaaaccacaaaaaaccccaaatagccaaagcagtactgaggggaaaacggttgaaggcattacactttctgatttacaactatattacaaatctatagtaatcaaaatagcatgctactggcataacaacagaaacctacaccaatagaacaggatagagagcccagaagtaaattcaagcatacatgttcaaataattttacacaagggtgctaggaggacacaggtggaaaggggagtctctttgataaaaggtgctgagaaagctggatttctacatgcaaaagaatgaaatcgtatgtttatcttataccacacacaaaaatcaactcaaaataggtaaagactgaaatgtaacacctgaaaccatgaaacttacttatagaagagaacatgggggaaagctctcggacattgaccttggcaatgaattcttggataacacaccaaaatctcaggccaaaagagaaaaaataagtaaatggggccacatcaaactaaatagcttctgcacaggaagggaaacaatcaacaaaatgaaaaggcaactgacagactgggaaaaaaatattggcaaagcatgtatctgataaggaattaatatccaaactttataaataactcttataacacaataggggaaaaataacctgattaaaaagtgggcaaaggacatgaacagacatttctccaaagaagacatgaaagtggccaacatatatgtatggaaaagtgtttaacatcactaagcatcaggaaatggaaattaaaaccactataagatatcacttcactcctgttaggatggctattattaaaaagacaagatataacaaatgttggcaagggtgtagagaaaagggaaccctagaacactgctgttagaaatgtagattggtacagccattatagaaaatagtataacggttcttaagaaaattgaaaatagaactatatgatccaaataagataaaatcaccacctcataaagatatctgcactctcatgttcattgcattattcacaatagccaagatatgtaaataccataagcatctgtccatgaatgaatggatgaagaaaacatggtatgtatatatgcacacacgtatatacatacaatggaatagcattcaccctttaaaaaggaaggagatcctgtcatttgccataacatagatggacctgaagaacattatgctgagtaaaataagccagacacagaaaaatattgcattatctcacttaagtgtagaatcttaatttttaaaaaaggtcgaatattcagagatagagaataaaacagtcgttaccctgggcagagtcaggggaagggtcaggaaatggggagatgtaggacaaaagatacaaagtagcagatatataggatgtataagtctagggtatctaatgtacatgaggattacagttaacgaaattgtattgtattacagatttttgttaaataaggagatttcagctgctcttgtcacaaaaatactatgcaagacgctagataatgttaatctgtctcactatagtaaccatttgactatctgtacatatacacataacatgttgtaagcctcaagtatacacaatgcaaattatttttaaaataagtaaataaaataaaattctacttttagctcagaaaaataaaattaaccctatagataacaaatatgacatatgcatgactatgtatcctaaaattattaatattacacttaaattttcatattggttcataagagatatttatgcctgtgatcagagaacatgggtactagtattaaattatgcattaagtaattacagatatatttaagcacataaaattaagattttctgtttttgtttttttgtttttcaccgtactggttcaacacttgagctatggaatgaagctatttttctttgcagcctgatatttccactttccacctgtctgattttggcaagttatttgtgtctaatgaaagtgaaagtaataatagtacttactaatactttgtagacttgtggttaatatatatcaactttaccattattattatagttattgtaattctagcagtaaaagacataacttttctgtatgataattttacagagtaatttattcattacttacaggtattgcaggactagatatctttatggatgttaggtgtcatgatatttttctaattacaagaataatatatattcactttttctataacatacttttccaacccactgaacaatattttctagacaataatttatgaatctacccacatcttttaaacaaggatagacaactttataatacagatataatgaaatttaaaaaaaaaaatttatctacttatatgtatctcggttgtcgttgccagaacactgctataccctttgtgttattgtttttatatgtttagatatttgtagaagtatttctttcgaccagatatgtatgttgttttgctggatcatagaatatatacatttaagctactaattgataggcttagcaaagtttcctgccaaacattttggattgtttttcctcactactcgtttacccaaaccattactaatgcttggtgttataaatcttttactgttttgccaattttgtaaatgaaagttgtttttattatgttgatttgcaatttaattatagtggacataagtggctttatatatatatatattggttatttacattttgtttgaattgtctattcacttcctttttcaattttgtcctttagtgattttttagaagctctctgtttggatatgttttatcttctctgtgtggcaaacattttctcacagaccatttcctcctttgcttatggtttattttcttatgtagaagtttttatcttcatttagtcagatacattaggaatatccttggcagtctatgaattcatattatttttaaaggttataatttcaagattataaaatagtccctcatattttcttttaatcgtacaactttatacttctgttttttctctctttggagtttatttacttacttatataagtaactatatataagtaatatagttacttatataagtaactatatataagtaatatataagtaactatatataagtaatatagttacttatataagtaactatatataagtaatatagttacttatataagtaactatatataagtaatatagttacttatataagtaactatatataagtaatatagttacttatataagtaactatgtataagtaatatagttactgatataagtaactatatataagtaatatagttacttatataagtaactatatataagtaatatagttacttatataagtaactatatataagtaatatagttacttatataagtaactatatataagtaatatagttacttatataagtaatatagttacttatataagtaatatagttacttatataagtaataaactatatgtaagtaatatagttacttatataagtaaatatatatggcctctgtgttttgtgctcttcgtttctgctgtgaggacagagtaatgactctgctctgataggcagtttggcagaatatgacagatgtgccacagaatcccagaactgaaatttctattccaaccaacaacaggaagagagacagattgtgaactagcacacaaatggagtttttttgtgtctatctcgaataacattcattgaataactaccattagcaaaaatattcattgaataaacaccaggttcaagtgtcacattaaaatattactaaaaataacattttatggtatattaatgttacttttggagtgaaattcctaaagaacatagatgtaaaatgttgagctcttcataaggagtgatatgaagtttttcttccccagatctctgaaactttttgccttttaaaaactagtgttcatctttttaatttcttcaaatatgcttgaccctccccaagttctagcattaaaaaatgggccacaaatgcaaaaaagggtggcagctagggcacattttagcagaatttgaaataggtggtgtgaattttactgtactgaaatcctaaagaatcagcccaattcatttcttagtgaaaaagtccaaattaatgctttgtgccttcagattcaggccttttcttgcctgatcttgtcttggtttgtgtctcagtcttcaggaaccagtattactgtggacatcgccgtcatgggcgaggcccacggcctcattaccgacctcctggcagacccttctcttccaccaaacgtgtgcacatccttgagagccgtgagcaacttgctcagcacacagctcaccttccaggccattcacaagcccagagtgaatcccgttacttcgctcagtgaaaactatacctgttctgactctgaagagagctctgaaaaagacaagcttgctattccaaaggtaggtagtaatgacataccccttaaagggttaaactattttttttaattctcttctaggtctccttcctgtcacctcaactccatctgcagattcatatcagtgactcaggcaaaatgtgttgatcgtggtgacagaagtaataaatatttaaacataaagacttctgtccttatacttgatagttttctatacatagaaaatttatctttttatgttacctcttttatttaatctttcatgttacttgcaaaacgttttctcttctatatgccaggcgcttttctaaggtgataaggatattgcaacaacaacaacaaaacaaagaaggcagaaatccttgctcctttctagtgcagattctgtttaaaattcattgactcctaaagctaaaggttctttactctttgattctcttgaatgatatacttcaaaataccctcctgactttccaatacacaatcagttttgaacccagaacagttttagtcaattatagattatttaaagtaaaatatatccttagtgatttctataaatatatattttatatgtaaaaggaagaaattacacaaacattctttttacatatatggcatgagttttatgaaagtaaattgtaggaggatcctcacccagtttagatctcaatattaattaaaaataagtcatattaaagacaaatcagtgtcagtggtctctggtatattcagcacagttatttatttagtaaacaatcagctatccctttgagctggtggtcagtcagtaacatctgtgcttctgctgttgtgagtctcttctctcaggaatgtgatcttcataactttgtcaataacatatttacatagtttccttccaatatgaaattccctgataaagatatacctaagtataatatgatagtaaggaaatggagagagagattaactggttccttcaggtctcaaattagacctgaggttagtgacagatttaaggcaagaaatctggtatttaagagtgtttgagttttctcttccaactgaattaccttctaagatgcacattcagatgtttaagagacactggaaactatttaatatcagagctattcttaaatcccaaggtgacatataattcacttctcaaaattttttaccttctttggaagagcagaatgtctttgtgaactatgcctatgtggttggtttattaggagtgattagccgcagataaaagtgggttgtggttctgtgtgttatgactgttgctgaagttataggaaaaagaccttcggtttaactttttcttttcttttttctttctctctttcttttttttttttttttttttttgagacggagtcttactctgttgctcaggctggagtgcagtggcgtgattttcgctcactgcatgttggccaggctggtctcaaactcctcgtgacctcaagtgatccacccgccttggcctcccaaagtgttggaattacaggcgtgagccactgcgcctggcccagtttaacttttaaggtcaagaaccactttagagtgttggtgctcatcctagtgatcccagactcttgtctcagtgcagatgatgctacatgtcctgtttaggatatggtgggagaagaaataagaaggggaacagcaggttggccagcagcgtctcctattaagaggagttgacactgatgacattacccatatctctgttgtctaagttacattaatcataagagaagtggtgcattttatgaaagacttgagctcctttcatttgtgaatgaagataataaagtcaataatacttgggggtatgactgtggtgcaaggtgatataaattaattcatgcccccaaacaagtgacttttgaggaagaacttctcataataactaatatgtgtgtataggtgtgtaaatcctgttgaataaatataactataaaattatcccagaggcaattgactctcactcctataatcacatatttgtataagcattgaaataaagaccctaaaaggttggttatgtatttatttatttatttattagacagacttctgctcttgtcacccaggctggagtgcagtggtgtgatctcagctcactgcaacctccgcctcccagtctcaagtgactctcctgcctcagcctcccgagcaactgagattacaggcacccaccaccacgcccagctaatttttgtatttttggtagacggggtttcaccatgttggccaggttggtctcaaactcctgacctcagatgatccacccgccttggcctcccaaagtgctggaattacaggcgtgagccactacgcctgactgcttatttttataatatgcattcattttggtcagagagtcttttattaaatttctgagcactcaaattttagataggtgatattaaaccaatgtaatttagtcaattcacttctaattaaaagcttgtttccttctattatattacataaaatttaagagatataaaatattctgggtaatgaagtcaagtctctttcctagcgcctgagaaggagtttgcctcctggcttgttgagacgagtttcttccacttggaccaccaccacctcggccacaggtctacccaccttggagcctgcaccagtacggagagaccgcagcaccagcatcaaactgcaggaagcaccttcatccaggtggcatacggctcctgctggtttaatgtctcttagagaagttacttgccaaaaatgagttataaattacaggagaaggaaggctaaccaattacatttggttggaggtcagctttgaagatggaaagggtacatggttcaaatgcagagcagtataggggttaacatcagataattaggcttaacatctgttgtgtggccttatatataagtggaaagagtgacttgatgtgatctctgccattgtgaccttagatgggaagggttaagcccaggataaaggtaggtaattttatctacattgagattcataccgagacccttaaatcaaaagcatacaacttgacatttgcatttgatatgagatcccccagcccagtcattagcctcccacaagaccagctgtcttagcgttgtacaaaagacaaaagagcaaatcaaaagtagatcatcctaagaacacctagatatgttcaaacatttggtaatttaaacttttctgaggatattaattccaatttttgaaagcaacttaaaagccagaattatcaaaactaaagaaaaggttatattaacatctaaaaagaatcttgaagaaaatagctaaggaaagtgcatttagagggagatactgtgtccttttctatttagaataaaaatattatacttatcttactttattcaaattcattaattgtgagaacatttaccgtatgatttcaggtttttgaaacacatgtataagttttatcaatgacctaatgaatgaaaaaatatccacatctatgtcgtattatatgacagcaatatcagaagtaattttctcctgatcgttagcctgggatataaataaaccaccatactgagactaatagaaatatttcagatgataagaatttaatgactgctgacctttcttttttgattaaaaatttttaattggtttcttccatattatttgtattctaagacatctatagaattggaaacaaactcaaatgtcattgtatattttatatgtcagtataatcccactccatcctattacctggacttttgtaaaacttgtaaatgagacaagaagagattatgtagtgtttcatgaaaatttcctgacggttgaaattaattagaagtcaatgatcaatatttttctctaaaaatattggtcattgacaattgctacagcagcaaatactgataaatgctaatagtattatagttaactattgcttaataaaatgaattatgttttcagcgtgtatcattagagtctgcccattttgccagtgcaacttgctaagtttcctgtcatagtataggtaatgcttcatgatttccttcccatagaatgactctatgaaaaatccactcatgccttctcaaatgccttttattctgttattctttgttacttgtagtcaaatcctatctcccctgcttttctcttctcttagtcaattaaatgaacttgagggtttaaattgaaatgatgacaaggaaggaagttccaaggacttttaagaacttaacgcccaaggatcttgtcattcttctttgtaaaatggatcatccaaatatttacaatagaaataaggaaaatacttacaatagaaataaggaatagcatacaattccattcattctcattctctcattcctgaaaatactcgtagatgtcttgtctggacattcattttcctcactgcctaatatactatctcataatctcactgtcctatgaaaagtactgatgtaaaaatctgaaagcaatataattccttcatcattgtgaagaaaggaaattcattctgaatagaatttgatccctttaagggaaaactatttataagtaagtggcagtagtaccaccactaaatacagctagttttggcttgattataaatcacagtcaaaaccttcttttgagttttagccctgaaattgcttcccttttagcccttttatttatttattcctttccatatcttttcatttattgggtttgctttgaggaaggactacattgatcaaaagaagaataagaatgagaaataataaaaattagaaacacaacttaactcatattcctttatatatacagctggataatttacccctgggtaattttaaatacagtctggtagaaagcacactggactgagaatctgaagggtcttggccctaccaaccactcagaaatgaaatgtactgtgttcttagaggcaagtcattagcctgccagaatctctgtacccaattacaaggagtcattaggaaaaaggggaactatgacataattggaggggtaaattagatggaagaatacaagtaggtgcttaaaaaataggctttagagaaataggaaaagctgaaataaatcagaccctaaatgattccaagttgaccttggaattgacccctgcctgtgtattcaggcaaaaagaaggcagtaaacttggcaaaagagactgttacctgatcagactttaaggacttagaatggagtcattacggggataataagagcataagaccacctttgggaagaagattgagatcttccatcacaggcacatagataattttcctctgctgtgccagcatgagaaaaccgtgtaaagcctttcctaagctgttctgctttacagaatccaaattatttcatattcatgaaatttaaacaggaatcaggaaataaaggacagcgatgaaaagctgaaaactgtgagggtctcacacagcaatatatgaaagcacctgtgaactataatgcatttatatataatacattgatttattgtattaatagtaaaatacaattatttagtgtattaagaatgtgatatgactaggatgttatttatcttgagttcattaaatctgcatttattaaagatactctagtgtattttgcaaacttgaaaatgaacacattttaaatgtttttatttgaaaaaaatagtaaattgttgagatagccttcataatatatctttctgatatattaaaacattcagttactgtaaggcattgtctttaaaaaggctacttagaaaagtaaaagtaataacctattcactgtattatgtaatgagaactgcaaacatttgggccacatatacattacataatatttcttcacagtaatcagttagtcaatccagnnnnnnnnnnnnnnnnnnnnnnnnnnnnnnnnnnnnggaccagcatcacgagaaaatagtcagtgttgttatctgtttcagatccaaagtttctttcagctcattatttcctaaatgccaagaacttgtgaaatacctaggatgtgctttctgaggaagatgtcaaagaaatatttttatgccttacttaattgcattttataattgctgaaggtcataccacatttcaaatgtcctcatatatggaaaactgctattagaagtaaggagaaaagatgaagttttaaaatacctgggtcagtagttgaagaaaaatctctctgaaatggaaaaaaaaaattgagataacaagtgtcagagtgtcaaattgacctcaacacaaattacacatcttacccattgccgaatttactagtaattaatggatacagacaatagtaagacccatgcttagcattctttcctttgagaggtctattagtacaattttctgaaagtccctttattccacattagcacatgttctggtttggatttagcatgcagtgttctaagcaatgcatgcataatattacttgcacagagggaaccattttagctctggaacctctccaaattatatcgtattaattataagcttatatggcaatctccatgcatccatgagcccataattctatcaattttaggtttatttacaataggctacccagacagaccaagcacatcctgcttacattgccaatctaagattggcaaaagatcaaattgtcaaatcatatttacgtaaattatagattgtacccagtaccaaatttactagtgcttgaaaggacacaggtgttagcaaaacacagaccaagcacttttcccttggagcagtccaagattgtcaacacaactttcgaaattcccttctctcccacattaggatggagtctatttcagattcaacatgtataagttttaagcaacacatgcagagaaattttgtcttggaatacctccaaaatttatatcacaatcattgcatgacttacataacattctctagttcagtcttccatgaatctattaattccacatttatttgcaataagcaacctaggcagaccaagtacatcttggtaaaagcatttgctagaggaagattctccattgcctttctcctagttcctatcatcagtgtgtttagcatcagctccattgttggcatgtccctttttacaaattcccttgtaaaaaggtaatttgactagatcatttccgtcacaaggaaataatgcaaaaaaacacaccattatttatgaatgatttcatggtcattcaatttttgaatacagatccaccaaaaataatagagtactgaagtaaacattatgacacttacagcttatgtaaattcacccgcatcttaaccagttaatctgtaagcctcttttagaaaatctgtgaggaacgtaattttagagtacagtgagaaggtgtttaatttttattaattggataataagaaagttatctttcctctttgttaacccagtatgcttgatgagtaactgctatatccctgcaacagagattgtttttacataatctgtttcatcatttggaagtacagtggttctgtcactgaacctgaaccaatactcagattggcaaatctattagagaaatgatggttgggttctggcaagactggcccaataactgatgaataatttgtttaattttcttttaattctgtctttctggtgcttttagtcctgattcttggaataatccagtgatgatgaccctcaccaaaagcagatcctttacttcatcctatgctatttctgcagctaaccatgtaaaggctaaaaagcaaagtcgaccaggtaagtaacttaactggagaagggttcatactgtgagtgtggagttctagagtaaaccagaccttaagcgttgaaatattctgagggtgccctatattcagatatgtttggtttgtctgttctaataaccaattagttattttttagaagtctcaataaccaattagttatttaaatttctaccttatgtgatgatacagattccttcaaagttgttgtatcagatttcctatcttgaactaattagatgcataggaaatcacttttaccatcaaggatcatctgtggtagcatcatctcataatagaaattccaattttttagtgtctgttaaaattatttttcaggagtatgatatatatgaattcaagaaagtgttttatttactacacatgagctatgataaggaatttagatatcaaaattaagaataataaagctttaaatgggaacatgaaatgatatcggggaagactacctcatttgttcagggtccttgctcacccaaaactgtaaaaggagtttttgtcagattccgtctctgaattgcctttcccctagaagcccaattaagaacctgggagatttcctctgacctttcctttttggaatctaacttcatggtttcacttctcagtattacagaaaatatcaatgagattttcagtaacttcctgcttagtttcttaatcttctgcctttagcagtttaagagttcatcaaatggttaaaaggaaaactgcccacttcccactgagatatgaaacattcaagttctggcttccatggcaaccccaaactccaatttttatgtcaccagcctcatgacattgctagaagctctgctggcttgcctcccaaatagctgcacccctctgtctggatccttcacttcttactccatgccaatagtcagtaaatcatgctatgaaggcaagaacaatttgcaggattttggctcacctttctgaggttctcttctttatgggaacctagtccctcagaattgtgtgctttgcctcgatagcttttttgtaccattttattggaattacatcagtaaaatagaccattaaggtaatctacttttccaacaactaatctggtcctctctgctctttagaaatgttcattaaattttgtcacttagaagtcattattgacctgctaataaaattgagctttcatcagggccaggcaatgtaggctaatgtaggcaaatacttaaattgagatattcctgaaggcaaatacggatttgctcagtaataaggagaatcatctgggaccccagcaaggtagagaaactgcatttgagaattccacattaaacccaagactcttaaaggggtgctaaagtggttttaggtatgtaggaccccttggctccctacaaaaatatatatggatacttttggaagggaagcatcaccagttaagggccatgagattttatcagatcagattcaaacatggagcttacaaccaggatcactaattgcacaaagaaacaccatgagtttgagttaacagaaacaaaaatacaactttctagatctgtaaaagggttaaaatatttaaattaaaatttaatttaaaaatttacatatttaaggaaaaataatagcaatgagaaaagacataactgcagagcagctaaatgtaacttttggaaatgtagtcaaggaaatattaaatagcatagtagactactgaagaaagaattattaaactgggtagagaaagatcggaagaaattatccagaaagcaacacagatgaagaattgggaagtataatagattttaggagatatagaaaaatgagtctaatgtacatgatatatgtaatcatagttttagtagcagatagaagacaaaaaatacttaggtgaagcctagtaaatggaaagaaactcacacgtagatacaaaatagtgaaactacacaacaccaaagatatacacaaacaaaaatcctaaggtctaccagagaaaagacaaatttccttttcagaaaaggcagtcaggctgagagcagagttgtcagaaatactggcagtcagaacacagcagaatattttcttcaaatttctgaaacaatatggtaacctaaaattttgtgcctggcagatgcatcttacaagaataggagtgaactaaagacaatttgaaagaagtcaaaactttaccacccgccaaatctttactaaaggaatttatgatggatatattctagaaagaatatatgatggatatattctagaaagaatatatgatggatatattctagaaagaatatatgatggatgtattctagaaagaatttatgatggatgtattctagaaagaatttatgatggatgtattctagaaagaatttatgatggatgtattctagaaagaagaagaagaagagaaagtttgagatctaatgaaaatgttaaacaaatctgaaaaccatgggtcaatccaaacaaacattaaattcataaataatagtatttccagatttgtgaatagtttttataagattttttaaggacagaactaaaatttcagacagtaataatacgtaattcaagagatgaaatataaatttaagtgttctaaatccatgtgtagctcaaaaagggggttcagatgaggaaactgagggaaaagaaggttaagtaatttgctttctctgggtcatgcaattaatcctgaatactttcttttgtcctaatgacttcatactagaaaaaaatgaggatgacaaattgtcataatttaaaactaggatattttgggttctgtccttgggtgggtacaagataatggaagggtttggttttctcttcctgtttcttcggttaagtaataacataaaaaatattgaataaccaacatgataagatcaagaagctgaaaattatggttagggcagaccctggaaatatcagatcaagtgatggaacagcctcatattcctgtgtcctgatccccagtttgtatgacttcactctagaagaaagagcaaaggagcaaaatgtaaaagggaaggaatgtccacataagataccacatgggcaggtggtaggaatgagagccacaggcatagcaagagcccccttccattcttgccatcaagtgcataaggcatttctatcatgatcattttggagcggattttgcattgtggcatctttagacagctgtcacagcacagctaaaagtttataaaataacctatatcccaggcatgctgaatccaactaattaaattcctaaagttcagccaaaagagacaaacacatctatcaagaatcagagagcctaaagagattacaaccctccctaatcagatgggcccttctgctttaaaatccttgcttccctgtttgggttgatggagctaagtggttgtgacatgtttgatgcagttgactgtgatgcatcctggttttccataaactccatggaaagaagctgggaagagccccctcgtggcaaagagtgtaagcaaatggaatcaaatgaaatgtgaagagagtctgaggaaacatgtagcagcaataggcaatgaggcggagagaaagcgagtatgaagtaagaagaggcatacagaaagataaataccctgtttccagagagggctaatgaaatctgttctttgcgcaaatcaagtaaacagcgtgtcctctagttcagtcaatcaatgttaattttaaatagctgaaacacaaattattatgcagttactaatataaaataaatgaacgaaatcacataggactcctttaataaaagcttaaaagcaggagattcaaatataatttgtattttcaattttgctcttctagtatgagtcactgacattgtggagctaccatgatattattctgctttaaaaattccttgaatttatcgttactgtatttgcagtagtcctttcccggattcttgtaagtttggctgccgactgcagtgataagagatatctctacacctataatctagactctgtttttcctatacaaaatttgaaaatatagagaactttaatcatggtattgtgattcttcttctttggcattctctttagatgcaatttctgctttggaaaaaatattcgggctatccattttcacctgggcatggaaaaaaagagatgtctttatcagacaagctggttccttttttgttccattaaaattaaactgagagagttttatagcacaaaacagatggattcacttaaataattcccctgtagtattgtttattttctctctttgattgcccaaaattccttgtgtcttgacacacattttctcatgccctcaggaacaaggaattaaaggccgaattactcaaaggagttggcattttagactttatttttaaaattatatttttaattttttgtttttaaatgttttgattttaagtatttcacattaggacagtttgaatcattcaaaaatttatatttcatgagctatgtcttcttcctggaatctgctaaaattactcaaatatgaagtgaagataaacattaatatacttgagagaatgcatgtttatcggaatctcttcactcatgggtgagtgtgtaaatgtgtgagtgtgcgatgtaaaattagatgagattttcaaaggttttaacggtcatccctctaactttagacatgattacattgaaagcattttagaaaattttaaaaacttccaaaggttattcatccctattccttagactgtcctctttctgtatctgaaataatttatttatagtttatcctttctataaagaaaatttggttattatctgcatttatctccctatctttttgaagaccgatacggtcttcaaaatatgcatgcacatcctaattctttctgtttttaaactttaagtaaactaagataatgcacactaggaaaaatagtagtttggctttggaaaaaaaaaaaagagaacttatacttttataactttagcttctcacctgcagaatagaaatatccatgcttctcatgattgttgccaagagttacactttttttatatttatttatttatgtattttttgtgagatggattcttgctctgtcgcccaggctggggtgcagcagtggtgggatctcagctcactgcaacctctgcctcctgggttcaagcaattctcctgcctcagcctcctgagtagtgggattgcaggcatgcaccaccacatcaggctaatttttgtatttttagtagagatggggtttcaccatgttggccaggctggtctcgaactcctgacctcaagtgatctgccctcctcggcctcccaaagtgctaggattacaggcatgagccaccgcgcctagccgagttatgcttttaaaagtgttcaaaatatgtagacaaacactatagaagcagagcttctctcttacaggtttattttaaatttcatcccaggcagtaaatttgatgtcttaaaatctgcttgtttgtttaaatttagttaatccgtgagttccaagaactctaatggttgtgtgaattttaaaatgtgtgtttgagagtgaattgcatgtatctgaagcaatcagctggcagctactaaaacttagcaatgaaaaaatcactcttctcataaattgccttcagaaaaaacagggtgtcaagacagaaatggacaatgttctcatgggctttgaactattgttctgttaaaaaaaaaaaaaaaaaaaactgtgtagaaaactgtcccaaaactcacagtttactatgagaacagctaaggaattgcctaacacagtgtctatcaggaatctctttttcttatgacacagcaattacttttaattgctgtttttgcaattacttttcattgcaaaaaccacaattacttttgcaccaacctaataaaactttgccctggccctacccaaccctatccagacttgcccagcaacctctctgaccacgttccctgcccctctttttgctttttgctaagctgccagccactgacctcctgactgctcctctgacatcccccaggtatgtccctctttcctgaacatgctttccccagctacttctctaaatgtcttctgtatttcatgaggcctctattcaaattttacccacccccaccctttcccagccagagaggccttctcagtccatcttatctaaagagcatttctgttcttccctgccttctactctgtgcattgttttcttcctattacttgaatttaagttaattttcttttttattgactttagtttttagtttctgtctcccctaaaaaagtgggagctccattagagcagggtttttattttataacctactccatccgtggagcaagactcacaataactacttgttggatgaagaaatcattgagatactcagtacagatacctcggtaaactttctaccacatcatactaggattcagctccttaacggctacagtgcctttctaagattatctggagtccctgtctaaatccaaaaagtggtcaaaactagaccaaccctttttaacctttacatcagagcacccatatatgtgtaatagtatttgtgaatatcgtagcattagagaaatgggaagggatttcaagtttgaaaactagacttcctttattttataaaattataataagaaaaactaattatgagctattagagataatattaaaaattgagttttttctagagtttccaaataaaatatttccttttttaaaaatattttcaaccattaaataattcacagcaaacttataacccacttgctgtgcagaatcatacattgactgggaaattctgagttaaaacctttgtgaacttaattttttgttttgtttttggctcaggatactatgtaatgtgaaggtttgtcgttatctttggaaaaataaatgagtctttttaatagacgtagaaaccgaaataaaaaccatcaggcatgacgtaaggagcaatgcaaacgctgcctaatacgccatgggttttacttcccccttggatagtctctgatagaggtactggtttataagctgcattttactaagagtagctgggtttactctatattctcccatgtactagtactgtgaccttgggagggttttttaacctctctgggtctaagtggtttcgtttgcttagtataaaggctgggagggggttgagctgctgattaggaactaacaatagatatgttgagaaagaactagaaggggttgctgctcttcacactgaagcaaggggagagtgagatttctcatctttaacaacaacaacgacaaaaagaaataacagcgccaacaagaaattgaaaagaaaattacacacgaacacacaaaatcgttcaacaaacttaatattcttttcagtggaccagaaaacctttggtatgacaactcaaacttttgaggaagctggatcctggaagcaaactttgctgtaagccagctgccagctaaccacacacataatttgatgatgtgaaggtggatggctgtaaatgttcctaagtggtgagaaatagacaacgacttttaataatttcatttcatttgccctacattacattgttcagccataaaatcatgaaaaccagtaagcaggttgttaggcagaagttatttctctccttttttccattttaactgcaggctgccttctctgtgtttgggagagagtaacttcaaaagacatcgtcctggtcttccaacagccacgttttgaaatctaagccagtatcctgtaaaattcttacaatctagagtaaatacagacagtttggcccaaatacccatacttgaaatggaaactttaggtctattgtttgctctgaaatggattatattacattttaaaatgttttcttcaaaaattattttgatcaaagcactctttcacaccgaaaggtcttatttcactgaaactgcgaatggttaagaaggttaatttcctctcagtaatgcatcttctgtatttacatattttaagcatctgatgcctgctgaactctgcccccagatactggttaacgtttaaaacaatagcagatcctgttcctgctaaaaccttcacaacctaagagaaagtaaacacatgagaaaattttaactattatttccatgtcagaatgacaagaagaaacaaaaatgggaggagaaaataatatccttctgtcctgaagttactccacgacaccagggctttggctgtatgtgccaacattgccactattttttttatgatgattcattcctcccatttaatgctgtggagacaccccaaccacactggcttcagatgttggtatgtggaggaggccagcccggtgacctgagcaggcacgtggttgttactgagtttgtaagagtccaggtgaagttcaacagttgcaattttgcattttaaagacatttgtttagttacttaactctcattctttctcaggtgccctcgctaaaatttcacctctttcatcgccctgctcctcacctctccaagggactcctgccagcagcctggtcagcaaaatttctgcagtgcagtttccagaatctgctgacacaactgccaaacaaagcctaggttctcacagggccttaacttacactcagagtgccccagacctatcccctcaaatcctgactccacctgttatatgtagcaggtaaggattttttatgaactgaagtttaataataaaaccgatgatagttttcccctagaaatacctaccaccagcccacgcagcttggggtaggtttgccaaagtattagacaaccaagtataggataatgtgatttgtgttgaataggctacaataaaaacttatgttttagtagttttctattaatgaagtttagaatccatgcagttcatacagccaatctttagagaggatacaaaactgttagctgtatatgttgcctgtttgctgatggggaatatagaaaatatataactaaaaaatgatatcaagtattctgttgtaattcttcattttgttggaatgtttgtacttgttctccagggaatgggttacattgatattaggcatatttaattgtcagtttgcatttcccatttttgcaattttaaaatgtgtgaataatacattgcacaggatggctggactcaaatagttctctgaatgaaatttaagcaattgtatgtgctattctatcatgttgaaacaaaattacaaagtgttatctatcacagagtttaagaaaaaaatggcctagcatggctggagtaattattttgccaatgttgtcacgaagaaataattatctcttcttactggttaatgtatttttattgttcttcagtaacagcttgaataatttatcttaaagcattatgatattttttaagtagaaaaacagttgagtgtttttaactatgagagtaccttgaataaaacagtatttcatttctgaggttgatgaggataactatttgaataaatgagtaacttgttggttttctagtatcaaatattacctcatagactcagattttttcattgtattcagctttaagaaatagcaacttatattaagcctcataattttcattttcatattttttactcataagttctgtaaattaaatgaatgttatttataatttttatttttacctcctttatctttaccggcatttttacatgagaaattattttcattcgtttgcccagagccaaagttattctactatgcaaaagttattctgctgccctctatgagttttttaataaaataatttctgcaggatattaatctcatctcttttccacaaaagagcaagttctgtagtaaaatattcagaagatatatcatacatccctgttagaaattcacaacacacatggctttattaaaacctctgagaagctctgttaaaagaatccctctttatttatttttgttgtttcatttagtgttttctgaatttattcgaccacagaaccaatttctttgggttaacacccaagaattgcccatggatcgaatgtttggcagaacacaattaagaagcattgttttattgtatgcaccctgagccaagatgaagcccagtggagtaatcttcatcaaggacatctgggttcagcatttttagggagagtctcccactgtgggttccggacttttgggaaataagtcccctaaagaaaggagagagatgttcagaaaagctctaccactcacgcagcttttttcatcatagtgtattttttttttttttttttttgtattcttagcaggaagaatgtaatgggatttgtataaaaggtttcagagaaaaacaagaggatttcactgtctacttgttcagtaatgtttataaatccagtagtgtgtgttttatttgtttgggctttataaatctgtaattcaaaccaggttttattattgccttaaaggcagccacccatgtaggcacagagagctccagaaacacacaactaattgttgtggtttcccctgctgaacttgaagagtttggcgttgaatcccagtctcttggctgctgtaatgtctatgcaacaagctatttttctggcatgagagctggcatatttgaagtactaatttaaatggtccttttaggtattattttgcaatgaaaaagtttaaggctaataaactcgacttctcctgagcttcgtctgagaatgtaagcctaccaattgcatctcctttcttttccctttttgtcctatcattttctttttattctctaacccaaactgacagatttaataattagaaatattttacaggtaacgtttttctatttacactcaagggttgaaaagtaaaattacttagtatgcagatacggtctacctacctcttctcttagtgcacacacgagcacaattcaggaaaaaaaatgatgagttatttaagatattaaacaataagctatcactacttttttcattttagagtgggtagtctgtggttaaataacaaacaaaaaaatcccctgagaccctttgtaatatcagtcagaaggaaagaacccagcagcaaatgcagaatcaaaatctaatcatgaagtttctaaacaagacagaagagggaagagccagtttatggcctgtgccaggccatttgtggggttactgtttaatatttaaaacagtcaaacttcattcctccaacaccctctgttagagggcattgctcacctctcttacctttgtttttcttggtggtttacggtacttctagggcctgtttctctcaaccagcatcctatgtagtcagtcatcaaaatgcacccctcttttgttcatttccttagggccttaacaagtaactgatcgatctgaaaaaaagaagtcaatttttattttttagcaaaacataaaattcatatactatcattctatttcaacctatgctgtcttaaagttctgtttagacataaaaatatcataacccaattaaataaaataaatctaataatgaggcttttttttttttttttgagatggagtcttgctctgttacccaggctggagtgcagtggtgcaatctccactcactgcagcctccatctcccaggttcaagcgattctcctgcctcagcctccccaagtagctggtattacaggcatccaccaccctgcctggcaatttttgtatttttagtagagatgggatttcaccatgttggccaggctggtcttgaactcctgacctgaggtggtccacctgccttggcctcgcaaagtgctgggattacaggcgtgagcccataatgagcttttaagcagcctggcccataatgaggcttttaagcagacagaaaggtatttattggggaagataacttttgtctaaatataggtcaacacctgcaaaatggctactataagtaggtagcagcctataccagtattctctaaataatctaacaaaattttaccatcactttcacctcaaatatgatctagataaaggaggaggagaatgagagtcaaatgaactttctaatcctttgtattgattactctctcacaaaaaagaaagtagtacactgcatatcagcatttatgtatcaaacaaaatgcatattttcacaaaacaaataagcagaaggtagaaatatttgactattgttgtttatcttaatgtatacatagatggtatgtgcctatgactttttgaaaagaggaggctacacctatagctcttccaatattttttagctgtggcagaccatattcccaagggaatcctgctgatgagcccctggagagaagtggggtagccactcggacaccaagtagaacaggtaattcattgttttggattctgttgcccaaaatggaaattgccttatttttgttttcctgatcaaaacagtgacctacatttctgatattttggggggcgctgggagatggggtctcatgatgttggccaggtcggtctcaaactcctggcctcaagtgatcctcctgcctcagcctcttgaagtactaggattacaggcatgagccactgtgcccagcctgattttttaaattatagatttaaaaggacaagggagaaaattaaaatcatctgtactcctactctctagagttaatcattggtaaagtttgggtgcaaagctttccaaaattttttaatacatttatacatgtgtatatttttaaaacacaagaggccattttatataatatatagaactatatagaaatattattttatcttgctacttctgacattggaagtactttaagtggttcccaaaacatagcaaatactcaataaacttccttcaggcaccttagtcagctatgagaaatgtcacagttgctcagagaggatagacttcagactctgggtgtttactgattggtcttttagttagcacagtttactgctgactgaaatggcgacagtgaagaaggacagatgaggaaggaagccacaggattccaagaaataggattggatacataggattgcccatgctcccaagcatatgccatcactctgtgctacacagagaactttattcctgggtgtgtcaactcagtttctcccacctcacgtgcccgttctagagtgttttagtcactcagtggtttaatgtatagggagagaaatagagaaaaaagaaacataaagctgtaggatttgttaaaggtatgaactgttgatctaaaaaatattattgaggggttattgaatgtcatgcggattacagattataatttccatctgttttactttgttaagagatgtgtgatgttctccaccctatgatcctatgttcttggagtgctcaggaaagcagtatttccctaaacactatatttaccatatgcatcttagcaaaatttgcttaaatgagccccctttccccattgtagatcttgtaataagttgttctcttttaattgtagatgacactgctcaagttacctctgattatgaaaccaataacaacagtgacagcagtgacattgtacagaatgaagatgaaacagagtgcctgagagagcctctgaggaaagcatcggcttgcagcacctatgctcctgagaccatgatgtttctggtagtcccatatcacttaactcactcatttacttgagagatgagcttctgttacagatattggctcagaaatgaatctttgaggccaggcaaggtggctcacacctgtaatcccaacattttgggaggacgaagcgggcagatcacgaggtcaggagttcgagaccagcctgaccaatatggtgaaacccctatctgtaataaaaatacaaaaaaattacccaggcatagccaggtgcagtggctcacgcctgtaatcccagcactttgggaggccaaggcgggagtatcacgaggtcagcaatgagttcaagaccagcctgaccaacatggtgaaaccccgtctctactaaaaataccaaaattaccaaaattagccgggcgtggtggcacgcacctgtattcccagctacgcaggaggctgaggcagtagaatcgcttgaacccaggaggtggagtttgcagtgagccaagatcgtgccattgcactccagcctgcgcaatagagggagactctgtctcaaaaaaaaaaaaaaaaagaaattacccaggcatggtggcaggtgcctgtaatcccagctacctgggaggctgagggaggagaatcacttgaacccaggaggcggaggttgcagtgagctgagatcatgccactgcacaccagcctgggcaacagagtgccactctatctcaaaaaaaaaaaaaaaaaaagaaattaatctctgaaacatgagatttacagatgtatttcatccggattaaacatgtattacagcccttcccatacatatcaatatattttttctctttccaagcattattggtctcttaatggttctattatctggtgattagaagcataagtatttatagttatacaataattgcagatatttattaacccaatcaaaaagtaaatataggaaaatgtattatttcattccttaaaacaatattttataaagaaagaaaagaaagatgaaggaagggagggaagaagatattcattgtcttagggcatctgctggttttctctagtatctccttgacttagaacatgaaccaatatttgtttttcttgtcatattgtcaggcatatattggcactagccacctattaaaatattctttaatgattacttactttgtgtatttaaaaagatccatttaaggaggatggaagcatatatttgagtcagcttcattttggggaggtggcaagtggtagaaaactgttgactctcaagtgatcatcaatggctgctattatcatttttcttttactgtatttactgtttgtatttctaagtcagagagatcgtcaggtaaaataatgtatatgtttccctatcctcattctctttcttcttttttggcaaatgtactcttaagaacatcctcgtttgggaccaattataaaaaacctttacttttacgtagtacatgtttctcaagaaacagtaggtcacatgaaataaattaaaatccctaaaaaatatggcaattgttattctataggattaatgtccattttaaagcattaatataaacttaattaataatagtaggaatgatcaggtcctactactcatggatttcttttgagagcttaatttaaggagggaaccctcatctcagaaaaatttacatgactatgtagagatataaatttacatgtaatttcagaatattctgaagtctttaaaactttatttaagaaccttgcagtagtcccaaagtagttatactaacttatagaagaaacatccgtgtttttgctggagtgtatatggaccagtgataggcaagcacctaatagtgcaaaatttatatctgaaatggcatttgttcctttccttcttactttggcgtcaatgtctcgttcatgttgacttttttaagcaaagatcacttattcaccttggagttttaagtcatttatttccgatagccacagttgttattgaatttagcaaagcacaaattgccctgtagaaaaactgcatgctgtttaagtattttaatgttaaacattacaggacaaaccaattcttgctcccgaacctcttgtcatggataacctggactcaattatggagcagctaaatacttggaattttccaatttttgatttagtggaaaatataggaagaaaatgtggccgtattcttagtcaggtaagaaatgcattcattcacactaatttaaatataggaaaaacagttcctttgttgcttaaagctctgtaaattcttgacacttgtggataggtgttatgtggagaaaggaagttttagaacacaacattctgtagattccttgctgtgtgttaacaaaagaaactggaacttcaagtgagtcgagtgtcatattctacaattaaaatatgatatatttttaaagacaaagtaggtggggatagagatatatagacaagggacaaacgatctagaattcatagaattaagcaaaagaaaatctgacacaagcctctaaaagaagaaaactgcctatttagagatactaatttattgtctgtaattatttttgatgactttttaaaaacttttgaatattacagagcttaggccttatcaaagataatacattgtgccaaaatgtgtttcctcctagtgttatgaaaaacacatcacatagagttatagaataatactgttgctgcataaccagcctttgagtattgttttctttaggctagactactctcaaggcttttcacataaataattacttgttttgctgaagaagaaagaaaacatgtagaaattaagaatttgaaaatgtttgttttaaaccataaaacaaaatgatggatttgctgtactatggaatagctatcgaaatacacacccttaattaaataaagaggatggtgtgataatatgtatcagcttatcttcacatgttttaggtgtattcttataaatttgaataagtatcacagcagagatagtaaagaccatcaaacttgtgaatataagacttaggtaagaattcaagacccaacccagatctactggggccactaacacttctctgcaaaacaatagaagagaaatcactgaaatgctgatttctatgcagtgcatcagagatgagctttctttggaccactcaacacatgtctcaatgtggaacttcgtttggggtgagaatcctaatctgtgaagattgaagggaaaagatagcaggcctttcttctagtgtttgattctacaagcacatatggctgtctagtctaggggtacactaacattattgatggaatataagacacaaaattcttacaaagtctgtaaaatattcaattattgcctctgctagactctattctgtccatcaccatgttgaggaatataatggcagcccttgcactttgctaggagttgagagtcctgttcctcttcccttcctttcttcttggtgctaagcaatgtctcttacactagctgatcttcaggacagatttaagggtagctgttcagtccaattcaccttagcctcatactttagggatccccctgggagattgtgtattttctttctgaaacccatggaaaactgcaactttgagggagtgatctttcctgcaaataagcctgtaacggtgccacaggatgtggcaatgagtcaggaagcattttctctcttgtttttatttttttgctagggagtgtgttccctggtatagagagacacatctcatctcattttatatttgatgtatatctcacagactctcgaaaacttaatcttcatagtaactttagtgcaggttttttttttaaatatgtattttatagaagaagaaactaaggcttaaaagaggctatgctactcttctaaagtcatatagtaaatattcaacccaggattccaaagcagatttatccatatcagaagcctagggcttttacattcattcaattgcttctcatatcttcataaaacaccttgacttattatgtcttcaagttctccaaatgaggattcatacctagtagaaaagtggttatgatagcagtcagttttacagcacaaatgacagcatacagaatttcattacaggtaccaaccactcccttgaagttctgtgagctgggaatgggagaaaacaatttgaccaaaattgctacaaaatattttctaagagtcatggataccagtagacaataaaaagattaaggataattaacaattagatccatgcaaaattcaataatgtatcttttgttccaatcatgttccaaaaacagagtaatatattgatatatgatccttattagtcactgtttatgttcctaatttcccagacattaaactttgaacaaatgtagtttcatatgacttgctaagtagaactttttgggatttttccttttatttgagtttataagaacaaaaatcatgaaattttcattatggaaaatatgtatatatttttgccatagtgagactttaggacagctgaaatgaattaatgtgaacattccaataaatcaccttttggctgagactaaatggaaaaagtctcatttcaaaagatttttaaggagacatgtgcaatggaaataagttctcagtttcaatatacagcctgccttttgatgactatcattttaaccaacttaaaaggacacccttcagattttgaaaaggcatttaatgttttccgttaccgatatttacctagtttcaccactgttctctttatgtctgacatacacatagggatgtttcataaggctttgtcttcttttacaggtatcttacagactttttgaagacatgggcctctttgaagcttttaaaattccaattagggaatttatgaattattttcatgctttggagattggatatagggatattccttgtaagtatatgtgatttgtgaaataatacttttaaaatatgtcgaatttgctgtgggtaaatgggatagtgaatcattagcaggtagcacagaattacacatggtagacgctcaatatggagacatcatatggtgattaggaaatatcgcctgtgtgttagaatcctggcccctttacttttcagctgtgtgagaccctagggtttacttaagctctacatgcctcatttcttagttcataaaatgagaattatagtacctgattcatatgattgttaggatcaaataagattataattttaaagaggttattttagtgcctagcacacagtaagtctgacataagtccactttaatatggctattttttggaaataaataaatactaaatttattgcccatttaataacccatcccttttattgggtaaattcaacttttgttgtggcatctgaagagttaagtcactatatatgttttctccacgtaagataaagttggctggcgtttagagggacaggaggatgatggtctgatgaataaaatagaaaagacatatggaagtggttatggaaaaatgataagaaacacttaaaaaatcaggtaaatggaaagacccaaggaaaacacacaatcaagtattcaagctttgagtcttgtgggaataagtttcccatttataacaacaagaaatcggaacacagaggagatgttaaattttcattatgtagcatttcaggaatcatcgattataacacataagtaaaatggtcctatagtgctacgaaatatatggtttgggagacagtgtctataggtcgaaacagggaaattgtggagatgttcaaaaatcatgtaacacatgaaggaaataaatatatagaaagaaaaataatcaaacataatatattgatcggaacatgtcttggaaatatgttatttaaatcatattttagcttttaagcttttaaaagttttaaaagcttttatatttgcttatgcacctcagacttcagagtcccataactttttcgtaattgtaaagagctgaaattacattaaaaaataattaatactaataaaacacaagtatttccaggaaggggtatcacatcaacttagggatttattatgagcatatttattgttttcaaaatcccatccacctgctacattggaatgaatatacacagctgttagtgtatcatagaaaaagagaatgaaaaactgaatctacaagtgagattttctgaagaatgtgggaccaaaatacagacagagtaaggcagttggagtacgggaaagaggagctcaacagtaccagggcccctgggaacatctggctgacaaatccatggaagttggaagagaaacatgaaaaaaggggtagttggaaaggatctcaagataagccttgctttcttaatacagttttcccagggcccaccctggttggatgccagtgattgacctaagtgttcacgatttctcgaaggtcaaggagttatataaataaacttttatagaaaggaagacactaaaaacactaaggaacagctaatcactagactgaatttccaaattcatgttatattttcaaatgtattttaatgatgtaattagccatagcaaagttccactgagttcaaattgatactaaactccatagacataactaccaactttttcacaggtggtatatcattaaatcatagttgaaagatggcaaatgtttaagtacaaaaataagttttcagattctaagatttattattcacttttatattttcttattacatttttatatgttacaagtaatagatattttttacccctgaaatagtgggttctttattccaggtgaaaagaacttgttgtaataaacctgcttgttctattagaagtcccagatagtctccataaagggaatttatttacatcttctcataggaaagctctagcttcatttgtgatcacttttatctaataatatttcatatgtgctgagattgtaaattaatatgaatatttattaaaatcttcacttatcattagttataatcagcacatacaaaaatttgctgtatacctacttgttttaatatttattttggactatatttctaatggtcctatctaaataaatccttagttgaaaagaagcataagaggaaccaaagttaaaatggggttggtttaactttaatatgataatgtgtgcaaatattagaaactaaatttcttattatagttctaagtgtacctttaacggttttcaagaaaagagggtaagtaggaaagcttttaaatttgtaattagaatccttacaaaaattgaagaatctagatttaaacagagaattaaagtaatttcatggtagtagcaatagaaagacaagaaatatggtcaactcaataatataaatgtgataaaaatgtatttgttcaatcaaacttaggataaattaatgtatggtgaatacccaattgcataaggagataaataatgtttggtgtcattcatagtccctttcagttgggcattttacttaataaaaaatccattcatattcattcatcgatccagttatttttgaaggtagtttttattttcaaagagtttcctctctaaagcatattctccctaacacctctcattctgatttaagtttgagaagtggggagaatgcctcagaagtacctgtgatcatgtagctatttcatggcagcaatgagaatagtcctgctcaacctatatttagttcagttcaattcagctgtacatgatgtgcccactgattttaaagctagatattgaagtgacatggtacatgctagaggggcagaactaccagagtattaactatattccaaaagaaaaaaaaatatttaaagtgttacctctattctttattacttctgcttaccctatggtgcataggagcatagacaaaattttaaatacaaaatatataaatttggatcttaaaatctgtgaatttacatacaactccaaccctccataccagctcacttcaactctgtgcttgagggaaaaggagaaagttgagaaaacaagtgtatcaagacggaagagggagatgggcggactctgggaaagaggtagggtgtaccatgtgctagtgtatgcatgtgcgtctatatgttattaaagagggcgagggggttgccacatgagtgaaggtgtcatcgagaaggctaggggtttgtccaaaatgcagagatgaaggaagaagtatgatgagaataaggataaaataaggatagctctgatagcatttcttatccttctcagttgcctaccctggccagaagaagaagaggaatctttgagcatttttatgtattacatagaaacctgtcagtaacttacattgaccttgctagcttctttcctgggtgtctttgctcctgggttgggttaccagagaattaatgacaagaacaatggagatgccagcacttggcataatactgagtacatgctaagtgaatatttgattaataaacatgtcactgactgctaacaggacagatggttttctattcttcaatctaagtgattgatgacagtattattctcctacacatacacacatataactagatgtatatgtttagataagcagctggatttggttagtgatttttttttatttagtacttttaaacctgtactcgaaagcaaaaggaacatgtttaaatatacatactgtctttacctagtttttaaatcaagattgtaccagcctcataaaatgagtttggcagcttttcttcttgtattttcggcactagattatttacttaggattaattgcttgttgaaagtttgttttttgtttttttgtttttttaaaataaaacattacctataaagttttctgggcctgggccttggggtgggggacagggtggattagagctcaaaaggattagagctcaaaagctgcaagttcacctggaatagatgttatcaattccttaccccaaacaggctctgccaacactgtgatactgccccccatccacctccgtactgctatgctcatgcacaggtttctctgacttgcaacaataatagtaactactggcatatagtaatcttcccagcttgcaacaggagaagataatttaagaagctggcttccaacatatctcccaaaagtggaaccctactcccagactgccattttcctaccataacaggtcattactatcttctaccgatggaggcagaagatattttattttattcttacaaatccagcattgattctgggagaaagctggtgatctatactagttctgtcttgttctacagcagcaatttattttacatgaataatgtttacacaaattacaaattcaccgtgtatctggccctttaaaatatatttcctaatgtaattgtcacaattgtaccatgaatttggcaatattattcccgtatttttaagataaataagactttttactctgtcttatttttaagataaggaagtggattttaaggaactcacccaagttagcatggataatattatagcagaggtaaaagcacacctgtcccaaatccagaaaattctagtatgatcaatttcataaatagcccaagtacagacataaaatatgatcgtaattctcttgcctgtgaattatttgtaaatgtaatgggctcatatcactggagatgggctatactcagggatatagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccagaaatttaacacctacccaggtgctacaattgccacattgaccataggtttcctctttcttctctgactagggaataggtgtttctctcatattctcattgtcattcttgttctctcctgtttctctcttctccttattttaagtattatgaagaaatgtaatctcttatactagagaaggaaacagtatcatggttggttagcagaaatacaatatataaagtataggtatttacaatatgtaaatacaatagaataaagcatactaatcagtgaagtattatgaggggtctgataaacaaaaaacttggaagaattgcacagaaaaggaaggtgagccaagagcacactgggcacgtggttatggtttgaaagaagttgaactgcacatgtggagtatgacccccttcccttgatgatggcattatgaccagatggcattatctggttaatggcatcatcaaccagatgatggcattatctggttttcctgtaggttttaactcttctaaatggcttagcttcctacattattatacaagaggcttttctttttctttttaagtatttcttagaactatattctgaaattagaatttctagatcagagaatataattgattgtggctttgaattttgcttgtggatgaaatctacatataaaagatatgttattgcagtgctttaagattgatacagaaaaatggtattatgttctattcccagattatttttgagtaccatctatcagagatgaaatattatgtctcatctagttgaagtatgtcatagctattacatttattctcattctctgcatagttttatgcaggagcatgaaaataagtaccagagtaaacattacacttttttcacacagtatgtttcctatatacatagtttgtagtcgactgttgacacagatttttccacttcagatacctgcatgcataataaatgttacaagtaaggtttttttcttgttacgatggatgttatggagttatggaagagtaatcaaataatatttgtcctagaaagtttggccaactttcatggaaatagtaaaatgttaggactaaactgtttgtccagtagatggcactcttagttcttggaccccaaagttcataaactgatgactgttcctgttcactggttacagatcataacagaatccatgccactgatgttttacatgctgtttggtatcttactacacagcctattccaggcctctcaactgtgattaatgatcatggttcaaccagtgattcaggtatgtacgaagtgaatctgcactgccttatgaaagatgggaacaagggtgtttttgtttttgttttttttcaaaaagaaagaagtcaagacaaataatgtcagtacttttttaaaaacttctttgactctcattttctcttctcagattctgacagtggatttacacatggacatatgggatatgtattctcaaaaacgtataatgtgacagatgataaatacggatgtctgtctgggaatatccctgccttggagttgatggcgctgtatgtggctgcagccatgcacgattatgatcatccaggaaggactaatgctttcctggttgcaactagtgctcctcaggtaaatctttagattttggttaggagaactaatttaaagatttctcaagaaagtgaagttcagtgtgatttataacaggcaccaagttaatataagccaaactatacatagtcttacgttgaaattctcagagaccgtgctaattctgaaaagaagccatggattcttccaagattctaatagcaggtatacaactttattatccatgggaatcatttctcagttttcttcttaggaagaaaacctacttgaattcatgttaatggacctctttaacaaacaaaaggcaacctatacaaaagcccctttctgaaaagattagagaaccaagcatttcttggacttttaagaatgtaaggtttctttgtatataaataccattcctttgaaatatattcaatataacaattatgattcttatgacattatctataggttggtaggattttaatatcaatttatttcattggaggattttttatttttttgcctaaacatagattccaaaaacagtgaataaatttaaagttcatcttggtgtatagttctaagtaaaaaattcatcactaagtatgtagacatacccatttatacaatcaaatttagcccctcatttatttaattagctgaacccaagttgctaaacattctgagatcctctgttcttctacaagatctagaggccaatttcattcaatattgacttttctgttttcttctttgcctcttctatcccattgctgttcatttccacagctcatcttataggctattctatagtttttcttgaatctatatacaataaaaattatctgataattttttcttgactatctaccttctttccacttgtctttcatacaccagaattattttttctaaatataggcaaaaatccactggccaggataatttaccattcagattattttacacgtctacatttttatatacctctatgttaatattctgtgcttagtgttttctttttgtcctatgtctttttatttctccataggctatacttgcacactagtgttcaggcattttgtaggcagcttcccttttaaaaaaaaatctctaataaannnnnnnnnnnnnnnnnnnnaattctctaataaaacttctctctgcattattagagaatttcagacaagtaaatgtcattttatgtctccgaatactagataaaaggtgatatttcctgtggagtggagtgagaatgttttaagtcatggacattttgggtattccattcatctttaatagctgtatgtgtttaagaggagataatgcttatgccagatagagaaagtaacctagttacctcttgaggtattgtggcattggtataattatatattatatttatatttacatatatatgtaaatataatttttttcttttttctttctccctcctcttttctatttgtatataatttttatgtttaaattcctgtaccctacaaagaaatctaaagaaaaaatcttttaaaaaatatctattaagataggcgagtgccccctcaaaagagtttggactaagttttcaaggaaaggaatttatcttacaaaaaggggaaatttaaccaagaaaaataatagagtcattgtacagtaataagtgattcttaataagcaggagttacgtgattacatttctttgttgtatgaataaaaagcaatttcaaaagcattgcatattctcatgatttttgtgattattttcttaaaaagttgaactcttaactgtcttatttgcctaggcggtgctatataacgatcgttcagttttggagaatcatcacgcagctgctgcatggaatcttttcatgtcccggccagagtataacttcttaattaaccttgaccatgtggaatttaagcatttccgtttccttgtcattgaagcaattttggccactgacctgaagaaacactttgacttcgtagccaaatttaatggcaaggtaaatagagctgtacccagttttcttttttttttctttttttttttttttttttgagacagagtcttgctctgtcgcccagactggagtgcagtggcacgatcttggctcactgcagcctctgcctcctgggttcaagtgattctcctgcctcaacgtcccgagtagctgggattacaggctcatgccaccacgcctgcctaatttttgtattttgtttttttagtagagatggggtttcaccatgttggccaggctgctctcaaactcctgacctcatgatccacccgcctcggcctcccaaagtgctgggattacaggtgtgaggcaccatgcccggctgcatcagtcttcattttatagacacattgaaagatatcatggaagcaaactgttgaacaaaacatgttactatgaactcccatatttcaaatgtgaaaatggaatacaataaaatgtttaaccagaagcagacatataggtattgatctgaatctagatgcccaagaagctgagatgctgtctctatagattctactctgtgctacagaggaataacacattctgtcattgtggtttttgtttgatttaatttgttttcatctctatggtatatttgtataaattatctggcagcagtacagatcaaaaacttgaagcagaattttatacctcaaaagtaaatgcccaaatattaagttatgacaattttttatgaactgtaactatattattttaatagtaattgataataaggccaagcacaatggctcacgcctataatctcaacactttgggaggccgaggtgggtggatcacttgaggccaggagttcgagaccagtctggctaatatggcgaaacaccatccctactaaaaatacaaaaattggccaggtgtggtggcgcacccctgtagtcctacctacttgcgggggctgaggcaggaagattgcttgaacccaggaggtggaggttgcactgagccaagactggaccatgacactccagcctgagagagagggcaagactctgtctcaaaaaaagaaaagagaagtaattgattatatatgccaatttaaaaaagcatttgttgctaattcaataattaatgatttttaaaattttcatttttgtaggtacatggtaggtatatatatttatgggttacattaataaattcatataatgtataataatcacaacagagtaaatggggtatctgtcacctcaaacatttatccattgtgttacaaacaatccagttatactcttttagttattttaaaatgtataattcaattatttttgacacactcaccctgtcacccattattataattttatccataattcgtttactttttttgtgaactatttttaccattaatttacacagccaataacatttttaagtagctagaggttcccaattatttgatattatgatccctatataatatgaagacaataaatgttctattgtttttctcttctcttcaacttttgtttttatcaaagcaaaacatatattaactttatctctcaaataggtaaatgatgatgttggaatagattggaccaatgaaaatgatcgtctactggtttgtcaaatgtgtataaagttggctgatatcaatggtccagctaaatgtaaagaactccatcttcagtggacagatggtattgtcaatgaattttatgaacaggtaactgaccactgtttaatacagcttaatctgtacttacaggttgctcatgaattgctcaaagcttctaacagctatgaaagtatgatcactctattttatattcatacttttgtcagaaaatgcactggtcaattttgatcaggagacaaaaagtgacgtataaaaattggactaaaatataatcatagaactctatgataaaagttatttgcaagcatttggggggaagaagatattgagatagtggaagtcagatgttaggaagatccttgaaatactgtttttttatagatttatttattatcatagaaggtagtttaaatgtatatggagtagcttgtatgtatatggtagtttaaatgtatatgcatatcacattaatttcacttactttcctaaaaaatttatttattatcatagaaggtagtttaaatgtacatggaatagtttatatgtatatgtatatggtagttcgaatgtatctgtatattagattaacttcacttttgtaaaaaaattaataagagcattatgtgaaaaagctaaaaagaaatagacatttcatttgacatgataactaagagttaacagactactcagaaagctaccacaattacataagctgggggtgatcctcctgacattaccctacacccatcagaatgcacttgaaccttcctgtttggcactgtgaaccactcttaaaaagaatgtggaggtgaaggagcatgcataaaggacaggaataagtgacagaaaagcatgtggaaaaaaatgaaggtatttactcttggggaaatataactgtcttcagatatttaaaagagtgacatactaatttagaaatcggttaatcaacattgctgtggagattaaagaagataaattatataacatacttagcacaggatctgattcataaaaaaagttagatccctctctactgccctaaaaaaggtatgaatataccagtctatagaagttattgggaggtagtgttcaggtcaatgtcagaaagaaatttatattgctaaaggtatccaaaaaataggctgagacaccatattaatggtaataaattgactgtcattggacatgtttaaacaagagattagaatgaaattttatggttactataggtaggattcatatatagaatgaaagatttgttttttttattttattatactttaagttttagggtacatgtgcacaacgtgcaggtttgttacatatatatacatgtgccctgttggtgtgctgcgcccattaactcatcatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctaactggtgtgagatggtatctcgttgtggttttgatttgcatttcactgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagatgagtaggttgcaaaaattttctcctaaaaccataaaaaccctagaagaaaacctaggcaataccattcaggacataggcatgggcaaggacttcatgtctaaaacaccaaaagcaatggcaacaaaaaccaaaattgacaaatggggatctcatcaaactaaagagcttctgcacagcaaaagaaactaccatcagagtgaacaggcaacctacagaatgggagaaagttttgtgtttttaaaacatcatgaaatcatgtattgcctttcctaagaatgggattaattcataaatctcgaaatatggaaatgcagaaaaatgtaaattaaagggaaaattcatgtataataataccacttcttaggcataattgttgctgatattttgggatatttcctttattaattttgctagataactgctggttaaaaatctcccttttttcctcagaaacatttgaagcacttcaaaataaaacatttgtacagtaatattattaaacatatagataaataagaatatcagaaaccacacaatcacaggagatatattaaaattcaaacaaaatctgggataaggtaaccccttgaattgagcaataaattctttaaagctttctggaagccaaagcaaaaaaaggaaaataggctacatttatatatttttaaaaaaattgttctcactattgcatttttttttttgagatggagtctcactctgtcaccctggaatgcagtggcacgatctcagctcaccgcaacctccgcctcctgggttcaagtgattctcctgcctcagcctcccaagtagctgggattacaggcacctgccactacacccagctaattttttgtatttttaatagagacggagtttcaccatgttggccaggctggtctcgatttgcccactttggcatcccaaagtgctgggattacaggcgtgagccaccacgcccagcctcaccattgcattttcgtgcatttatattctcatataaaagacactgacttgtgtgattaaaatatcatctacttatacattagaatttagactttctgtatttctccttgataaaaagcaaaaacctcaagttcagaaaagtactaattagcaacagtgtttctataggaaccttagcacttgaggtaggatcctttagctgtcaagtaaagaagtttgtgcattaatgcctggggttttacatatttacaaatttcagatgccaggtgaatgttgacttcacttgtattttatttctagggtgatgaagaggccagccttggattacccataagccccttcatggatcgttctgctcctcagctggccaaccttcaggaatccttcatctctcacattgtggggcctctgtgcaactcctatgattcagcaggactaatgcctggaaaatgggtggaagacagcgatgagtcaggagatactgatgacccagaagaagaggaggaagaagcaccagcaccaaatgaagaggaaacctgtgaaaataatgaatctccaagtaagttctaaaacctagttctaatgtgttttccctgggattgctttcttactttagatgaattttatgcttcttatgaaatacacaatacttcaagtctaaacatcatttgcggagtttgactacggatagctcccttccccaatatcataataatagaaatcccagactatggaatctataataataacacatatgatacaaagatatcttctccgtcatgaagtcatgaagttagaaaaaaataataataaggagttgaagcctattcttcagggtatctggttttttgtttgttttttgttttttgttttttgaggcagagtcttgctctgtcacccaggctggagtgcagtggcacgatctcggctcactgcaagctccgcctcccaggttcatgccattctcctgcctcagcctcctgagtagctgggactacaggtgcgcaacactacacccggctttttttttttttttttttttttttggattttgagtagagatcgggtttcaccatgttagccaggatggtctcgatctcctgaccttgtgatctgcctgcctcgacctcccaaagtgctgggattacaggcgtgagccaccgcgcccagctgcttcaggttatgttagcgatttaaaagtgaaagaatttcagttaccataaagaccagtcataggtttttattggcttggttaggggaactccatgtgaatagataggaggtagtattcatttgttcattcaacagacatttattgagcatctgctctgtgccaggtatccttccaggtactagagatagagttgtggggaaaaaaagacaaaaaataaaataaaatccttgcccttatagaagtacattctagtgggatcagtagacaataagcaaaacaagtgagtatatctatagtatgttaaatacagtattatttactgtagtgataaatgctgagaaatatgagagtaaaaataaaaggagggagatatgaaatattatagagataggttaaaattttaggtaagatatccagggataggaaagatgtaaagcagggaaagatttgtaaaaagaaaaagaaaagacctgcaagaagcaagggagtgctccctggggctgtatgtggaaagaggattccaaagagaggagaaagcaacctgtgcaaaggtccggggatgtacattgggtggggtgttcagggagcagcaggagaactgggatagctggagcagcaagacagaggcagccgggaacgaactgtccaagggagagaatacagtcatgggttcttagttgctgtttctggttgggccagtaaagccccttcctcatcccactgttctgcttatcactagagacagaaactaaaaaccatggtttcaggtgctaaaagcctaaaacaaaacaaaacagaagaacagcaacaacaaataagtcagcctggacaagcttggaaggtgggactctgtaggtcacggtaagtgttgtggcttttactctgagtaagatgggaaatcgtcagtggttttgaacggaagagttagtagactcaacttacattttaactggactgcttcagctgctctattgagaatatgcttggggttgagaagggagcaaggatagacatagggcggtcagttaggagaccattgaaattatccaagtgagagatgcctgtgactttgaaccagggcagtagcaacagtgacagtgacaacctatcacatgtgataattggctggagtgcatcatgtggccaatctaacctatttagcttaattgactatgaaatcatttttatttatgcctctaaagctactctcctatttatcctgtcatgaaacaaatagtgactaatagcataattagtaaaaatccatgacccttgcaatgatattgcacaaatactgctcctaagaacatagtatgtgatttctgtctacctttacagataaagtacaatcttaatatcctcaaggttcttaccaaaaatacaaccagtgaaagacattctgatcatttcgtgcctatttttatcacagtcaggataatgcacaacttggttcattccaaccatcttgtaaggagattaaccttctactgatccattttgctctcatataagcaccttgttgtaggcacacataagcaaacataaagaagtccttatcaattatgaacttatgaagtaaaattttgcaaattgagttttagatcagatctggcctgttaattactttttgtagaatgggggaaaattaaagttgtttttcttcaatatgctactgtcaaagtaattatatttcatttatctgatgcaaataaaaagacttccattagaaaatttgtactaatcttgagattcagagctagaagccaagacttggaattcatgggttattcattcatttttttcacttaataaacatgtattagttttctctttttgtttgttttcatttcaaagagccaggtagtttgctgtcttactaagaataagacagtttttccactgaatgaaggtattgtcagcttagcctctggaaaagctttgttcccaggggccctgacttactgctctttgaactcaaacacatggaaaatacagacgcacagatccaggcattgggaattgaaggacccaggccaggagacttaacaggctcaacttgtcaacctagcctttagcagcaaatgctacaaccacatattccatttctttctgttctgtagggttgggttgtcataccttcccgtttttatcaagttcactaaagcaggaatgagagactttttgggttctgtttgctcatgccttccaaaagttaactgaccacattatattacaatttaaaaatatcccatccacaatgatttgatactgtagctttggaaatattatctttaaagtatttctttacaaccaagaaaatgataaatatggagcaacattagtatttaccaaatattggccacatagagtaacagaattttagaaatgaagggggaatcaatgcttatcagttagctgcctcactttacatatattaaactaaggctcagaaatttaaatgacattgcaaggttgtagaaccagaaagggaacctaggtctcttaatttttaacttcaatgcttttggctctcagtaatgttaatatcagaattcatactggctaaaatggttaccttgactttgcctaatacttaggtttcagaaaaaaataaatatgcacagataacttctgtagtttgtaaaacttggagatgtcccaggaaacagaataaaatgtttcaatatggtatcctaggaaaagaaggtttttatcccaccttataattaaatctgaaagattcctacagtgaactaagaggttcctaatgaagtactaagctgcatttagaattggagcaatgaaaggctctttgttctcctttcaaaaggttccagtacagaacaatttggctcccaatacaggcatgttttagaccacctgcaggctctaatctacgcaaatttatttggtacaaactttcttctacgtcaccttcttattcagtataattccagagaggtttattgctaacatttaacagtattaataagagaacagttgctctcatggggactgccctggaaggaaaaaagaggaaaattgagcttttgttagcttcttccctatgaatgcactgccatcaatgtgtataactttaagatgaaataatcaccttaaactgaagagtgtttgctacaactgtgattcaaacctgtccttcagacaggggtcctctgtaactctcttgattcaaaggattagcttaaaaagtatattaacatttaaacatttctcaacagaatttgatttataacaaaaacgaagtagaaatagacaagtagagatagaagagtaatttttaatttgctttaaaaaatctgatgtattaatgtattttattgactttcatagaaagaattcaaatttatttaaatttcaattgtatctactgcccttgttaggaggctttcaaatggaagaattgatataaggggtcttggcctgtgccccatacacttttgcctatgtcccagttcttcaaactttgcttggaatactgctagctccttttcacccagtgttatttaattctcattacttacatccagcccaggtaccaggtcctttaaaaaaaaaattctacctaattttccacagtttgtgtcatttgtgttgccatggtttgatgtatcaaagagaaattgcaccagacatttgttaaaaatggcaacgaaggcgttattcaagactactgtaataggggagacagattgaactctgttgaagcaaaaggtgggagaattgttcaatgctgctgtgagctagtgaaaaagtgctggaggatgttatgtgagcattggttagtatgattaagccacctgttaattggtacttactaaagttaggctcctacctcccaacagagactaggagataggcctgcctgctggcctacctttcttctttccttccatccttccttccttcatttaaatcttttttaaattttaaaatttaaattttattttgtaagactgcaaagctaattagaggctgggagaagatttatctatattccagaggggcagagaaagaatttgctattacaggttttctaaagtaaatgttctaacaagagggaggtcaggggcctatagtctagaagtctaaaatagtgtcaaactgagagaaatggcaagcccatcttggtcacaagaatatgtctgtcataaaacatagcacatgtatttcagtttttgtcttcttggcactctctcttacagagagactgtaaactcctttaaggcaagatctgagcttaattgatctgtgtttccaaagtatcctggaaagtatttgccagttagtttgagtccatctcatgaagaaattatgaatatcataatttttttttccttttgactctgcctgtgttcatttccctcagcactcattcaatttaataattgtcattctgtgtctatatggttcaaaattaattcaagataatttaatgtcctttttattcactgtgttttaaaaattaattttattctgtacagtacaagaaatttctgcagtatatcaaaataaaactgttaaaagaatgactagcccttccacaaagatgttggcagatgacctccaagtttctttgtcacccccatagaaattggctttttttctttcattattgtgctattattaagacttttcttttttttcttgctcccagagtaagtcatatctacttcattaaatagacccaaatatcccttttgatcttcctgctaacttgtactgttttttttaattgtttatttacttttgtagagacagcagtctcactttatttatttctgtagaaacaggacctcactatgtttcccaggctggtttggaacccctgacgtcaagtgatcctcttgcttcagcctcccaagtagctaagattacaggcagcatgagccaccatagccagcatgaactattaactctttaatgcagtctcaattagatcagcatctcctgtagaccactttttcgtattagttttatttttaccacttatcaatacttcatcatttacctggaaatgtggaacaaaaactagagagaaaattattcatttagtaaacttttactgaatgctttagtaaagtctaggtcttcacagatattacatatacacaaaagtaaagagaaaagtccatataccaggtgatatggtttggctgtgttcccacccaaccctcatcttgaattgtagttcccataatccccatgtgttgtgggagggacctggtgggaggtaatcgaatcataaggggagttacccccatgctactgttctcatgacagtgagtgacttgtcacaagatttgctggttttataagaggcttttccccctttccttggcacttctctctttgtatgaccatgtgaagaaggatgtttgcttccccttccaccatgattataatttcctgaggcctccatagccctgtcagtcaattaaatctcttttctttgtaaattactcagtcttggggagttctttatagcagtgtgaaaatggactaatacagtaagttggtaccagaagtggggtgctgatataaagatacccaaaattgtggaagcaactttggaacacagtaacaggcagagattggaacagtttggagggctcagaagaagacaggaaaatgacagaaagtttggaacttcctggagattggagggtcatatggtttggctgtgtctccacccaaatctaatcttaaattcccatgtgttgtggagggacccggtgggagataattgtatcatcgtggcaagtcttttctatgctgttctcgtgatagtgaataagtctcacaagatctaatggttttaaaaagaggagttcctttgcacaagttctctttttggctgctgccatccatgtaagatgtgagttgcttctccttgccttcctgtatgattgtgaggcttcctgagcaacatggaactgtgagtgagtgctcaattaaacctccttcctttgtaaattgcccagtctcaggtatgtctttgtcagctgcatggaaatggacgaatacagtaaattggtactggtagagttgggtgctgctgaaaagacaaccaagaatgtggaaacgactttggaactgggtaacaggaagaggttggaacagtttggagggctcagaagaaaaaagaaaatgtgagaaagttagtttggaattttctagagacttgttgaatggctttgacaaaaaatgctgatagtgatatgaacaatgaagtccaggctgaggtggtctcagatggagatgaggaacttgtcgagaactggagcaaatgtgactcttgttctgttttagcaaagagactggcagcattatccccctgccctagagatttgtggaactttgaacttcagagagatgatttacggtatctggtgggagaaatttctaagcagcaaagcattcaaaggcaacttgggtgctcttaaaggcattccattttataagggaagcagaacataaaaattcagaaaatttgcagtctggcaatgcaatagaaaagaaaatcccattttgtgaggataaatccaagcgagctgcagaaatttgcataagtaatgaggagccaactgttaatccccaagacaatggggaaaatgtctccagtatatgtcagaggtcttcatggcagcccctcccatcacaggcctaggggcctaggaggaaaaagtggtttaatgggctgggttcagggtccctgagcagtgtgcagcctagggacttggttccctgcatcccaaccactccagttgtcactgaaagaggccaaggtacagcttgggctgttgcttgagagggtggacgcctcaagccttggcaccttccatgtggtgttgagcctgtgagtaaacagaagtaaagaactgaggtttgggaacctctgcctatatttcagagggtgtacggaaatgcttggatgatcaggcagaagtttgctgcaggggtggggcagtcatgcagaacctctgctagggcagtgtggaagggaaatgtagggtcagagctaccacacagagttactactggggcagtgagaagagagccactgtcctccagaccccagaatggtagatccaccaacagctggcaccgtgtgcctggaaaagccacagacactcaatgccagcccatgaaagcatccatgagggaggctgtaccctgtaaagccacaggggcagagctgcccaacactataggatgcccctctttgccttccaccatgcttgtcaggtctctccagccatgtgaaactgtaagtccaataaacttctttcttttgtaaattgcccggtcttgggtatgtctttatcagtagcatgaaaacggactaatatggaggactcagaagacaggaaaatataggaaagtttggaacttctagagacttgttgaatggcactgaccaaaatgctgatagtgatatggacaataaactccaggctgaggtggtctcagataaagatgaggaacttgttgagaactggagtaaaagtcactcttgttttgcttaccctgcagagccacaggggcaaagctgcccaagaacacctcctgcatcattttgacctggatgtgagacatggagtcaaaggagatcagttttgaactttaaggtttaatgactgccctattgaattttagacttgcatggggcctgtagcacctttgtttcagcaaggaaactggtggcattttgccctagccctagagatctgtgaaactttgaacttgagggagatgatttagggtatctggccgaagaaatctctaagcagcaaagcactcaagaggtgactttggtgctattaaaatctctcagttttatgtattcagaaagacatggtttggaattggaacttatctttaagagggaagctgagcataaaaattcagaaaatttgcaacctgaggatgtgatagaaaagaaaaacccattttttgaggagaaactcaagtgggctgcagaaaatttgcataagtaacaaggagccaaatgttaatcaccaagacaatggagaaaatgtctccagggcattgtcagagaccttagtggcagtccctcctatcatagacnnnnnnnnnnnnnnnnnnnnaccttagtggcagtccctcctatcatagacccagatgcctaggcagaaaaaacgatttcacaggccaggccccagaccctctgctgtgtgcagcctagggacttggtgccgtgagtcccagctgtttcagccatggcagaaaggggccaatgtacagctcaggttgtggcttcagagggtgcaagcccgaagccttggcaacttccaatatcatgttaggtctgtggtgtgcagaagacagaaattgaggtctgggaacctccacctagattaaagaggatgtatggcaatgcctggatgtcctggcagaagtttgctacaggggtggagccctcatggagaacctctgctagggcagtatggaagggaaatgtggggttggcgccaccacacagagttcctactggtgcactgcacagtggagctgtaagaagagggccattgtcctccagaccccggaatggtagatccaccaacagcttgcactgtacacctggaaaagccacaggcagtcaatgccagcctgtgaaagcagctggagggcaaagctgcccaaggctgtgggagcacacctcttgcatcattttgacctggatatgagacatggagtcaaaggagatcattttttaactttaaggtataacaactgcccttttgaattttagacttgcatgggacgtgtagcccctttgttttggcagatttctcccatttggaatgattgtatttacccagtgcctgtaccatcattgtatctgggaagtaactaacttgcttttgattttgcaggtttataggcagaaaggacttgccttgtctcagatgagaccttggacttggacttttgggttaatgctggaatgagttaagacattgggggacttttggaaaggcaagattgtgttttgaaatgtgaggatattagttttgggagaggtgaggggcagaataatatgatttggctatgtcaccacccaaatctcatcttgaattgtagtttacataatctccatgtgttgcgggagggacccagtgggaggtaattgaatcatgggggtggttattgtcatgctgctgttcttgttataatgagttcttatgagatctaatggttttgtaagggacttttccccctttgcttggcacttctctcttcctgccaccatgtgaattaaggacatgtttgcttccccttccaccatgattatgtttcctgaggcctccccagccctgtggaactgtgagtcaattaaacctctttcctttataaattacccagtcttgagcagttttttatagcagcatgagaatggactaatacaccagggaaattcacaatctaatgggaggatcttagctgaacttctgaactcttggctcaagtctaaaatcgtcacttagatgagggtactgagagttaaatgatattctggttgcttggaaaagaacagacctctcttctaagctgtctaccagctgcctactttacctctctactcagaggtcttccagacacttcatgttcagaatacctctattcattttctgctgatatggttttgctgtgtccccacccaaatctcattttgaattgtagctccaataattctcatgtgttgtggaaaggacccaatgggagacacttgaatcatgagggcagtttcccccatattgttctcctggtactgaataagtcatggatctgatgattttataaggggtttcctcttttgcttgactctctcattctctttttgcctgacaccatgtaagacatgccttttgccttctgccatgtttgtgagacctccccagccatgtggaactcttgagtccattaaacctcttttttctttgtaaattatccagtctcaggtatgtctttatcagcagtgtgaaattgactaacacaccctcaaatatactcctcatccaaccttccctttctcagtacatcttaccaacatactcaactgctcaggccagaaaacagggttgtctctgattcctccctcttaattccctacctctaatcagttgccaagtcctgttgattctcccatacaaatatatctcatatttattgacttttcttcattttcattacccctgtcctaatccagtcaccacctccatacaatattgtaccaactgggccatctccctccctttctgctgactttcaaagactccataagactcagtataaatgtacctgcttgttcactattttcctactagagtaaaagcctgctgctggcaagcatcatatttatcttgtctgtcagagggtcactagaactgaggacaacattttggtacatatcgggtgattcataaatagataaggaatttagaaacctcaatagtgaatgctgacattaaatagtcttctttgaaatatatttttttctgtttaaattgggtttattatttttcctcaattaaaggatgtaattctgtgaaaatttttcttaatatttgcatgttgaaaactttgaatcatttggtcaaagaaaatgtaatgtatttcttttttaaatgcatacgtgctgatgtataagatctgtacaggtttgtccaaggctccctcacagaccctatagtctagaagagaaactatttggaatatatgaaaataagatttgagtttattttttttaagtagggtactcatttattcagattaatagacagaagcaaataattttccaaagtagatgtaaaaaatgtacattcctataagcaatatattagttctaattgttaaattcttcgtctacacttgattttttatagtcattttcattttagctattccaagtaggcatagagtgctcttatgttatagttttcatttgcatttccctgtcttatgtaatatgcaactttttgtatttttaatcaatatatatttgtacatatttatgtggggcacatgatattttgctacattcatcaaatgtgtaatgattaaatcaggatatttagagtatctgtcacctcgagtatttgtcatttctttttttttttttttttttttgagaccgagtctcagtctgtcacccagtctggagggcagtggcacattctcagctcactgcaagctcactccgtctcctgggttgaagtgattctcctgcctcagccccccaagtagctaggacaggcatatgccaccatgcccggctaatttttgtatttttagtagagatggggtttcaccatgttggccaggctggtcttaaactcctgacctcaagtggtccatccgcctcggcctcccaaagtgctgggattacaggcatgagccactgcacccggccatatttatcatttctatgtgttgggaagtcccctcttcccactattttaaagtatgcaatacattatttttaacaataatcaccttactctgctatcgaagaacttatttattctaactagtatgtttgtgctcattaatcaatatctcttcattcctcctaacccccaaccatacacccttctcagcttctgatgtctgtcattctaccctcacttccatgagatcaacttttctagctcccacataagagtgagagcatgagtatatttgtctttattgctagacttatttcatttaacataatgatctccagttccattaatgatgctgcaaatgtcataattttattctttttatgtctgaatattattccattgtgtatgtataccacattttctttatccattcatcagttgatggacacttaggttgattccatatctttgctattgtgaagactgctgcaataaatatgggggtgcaattatctttttaatatactaatttcttttcctttgataaatacccagtagtgggattgctagatcatatggtagttctcttttgagattttgagaaatctgcatactgttttccatagtggctataccaacttatatacctacaaacagtgttatgagttcccttttctccacatccttgccagcatctgttgtttttctgtttttagtaatagccattctaactggggtaagatgatatctcattgtggctttgatttgcatattcctggtgattagtgatattgagcattttttcatatacctgttggccatttgtatgttttcttttcagaaatgtctattcatgtccttgcccactttttaatagaatttttttgtttttgttttttaactgttgcttgattttcttgtatattctggatattagttccttgttgtatgaacaatttgcatatattttcttccattctatagattttctcttcactatgttgattcatttgctatacagaaggttttcgtttttagtttagtcccatttgtctgtatttgtttttgttgcctgggtttttgaggtcttaatcataataatctttgcttaggtcaatgtcctatagaacttcccttatgttgtcttctaacagttttatagtttttggtcttacttaagtctttaatctatcttgagttgatttttgtatatagtgagaaatggagtctagtttcattcttctgcatgtgaatatccaattttcccagcaccacttattaaaaaagatgtcctttcttcaatatatgttcttggcacctttgtcataaatcagttggctataaatacatgcatttatttctggagtctatgttttattggtctatatgtccatttatatactaacaccatgctgttttgtttactatacccttgaagcatattttgaagtcaggtagtgtggtgcctccatctttgttcttttcgttcaggattgctttggctactcaagctcttttttggttccatagagattttggaattgtttttcctgtttttctgaataatgtattggtattttaaaaataaagattgcgggggaggagccaagatggccgaacaggaacagctccggtctacagctcccagcgtggtggatgcagaagatggtgatttctgcatttccatctgaggtaccgggttcatctctctagggagtgcgagacagtgggcgcaggtcagtgggtgcgcgcaccgtgcgcgagccaaagcagggcgaggcattgcctcacttgggaaacgcaaggggtcagggagttccctttcccagtcaaagaaaggggtgacagatggcacctggaaaatcaggtcactcccacctgaatactgcgcttttccgacgggcttaaaaaacggcgcaccatgagattatatcccgcacctggcttggagggtcctacgcccacagagtctcgctgattgctagcacagcagtctgagatcaaactgcaaggcggcagtgaggctgggggaggggcgcccgccattgcccaggcttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacaggcagactgcctcctcaagtgggtccctgacccctgacccctgagcagcctaactgggaggcaccccccagtaggggaacactgacacctcacatggcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcaccaatcctcctccaaaggaacgcagttcctcaccagcaacggaacaaagctagatggagaatgactttgacgagctgagagaagaaggcttcagacgatcaaattactccgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgtgatcaactggaagaaacggtatcagcgatggaagatgaaatgaatgaaatgaagcgagaagggaagtgtagagaaaaaagaataaaaagaaacgagcaaagcctccaagaaatatgggactatgtgaaaagaccaaatctacgtctgattggtgtacctgaaagtgatggggagaatggaaccaagttggaaaacatgctgcaggatattatccaggagaacttccccaatctagcaaggcaggccaacgttcagattcaggaaatacagagaacaccacaaagatactcctcaagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaatttccaacccagaatttcatatccagccaaactaagcttcataagcgaaggagaaataaaatactttacagacaagcaaatgctgagagattttgtcaccaccaggcctgccctaaaagagctcctgaaggaagcactaaacgtggaaaggaacaaccagtaccagctgctgcaaaatcatgccaagatgtaaagaccatcgagactaggaagaaactacataaactaacgagcaaaataaccagctaacatcataatgacaggatcaaattcacacataacaatattaactttaaatgtaaatggactaaatgctccaattaaaagacacagactggcaaattggataaagagtcaagaccaatcagtgtgctgtattcaggaaacccatctcacgtgcagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatggtaaagggatcaattcaacaagaagagctaactatcctaaatatatatgcacccaataaaggagcaccaagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaatagaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacaaggctagagtaaccaaaacagcatggtactggtaccaaaacagagatatacaagaatggaacagaacagagccctcagaaataacgctgcatatctacaactatctgatctttgacaaacctgagaaaaacaagcaatggggaaaggattccctatttaataaatggtgctgggaaaactggctagccatatgtagaaagctgaaactggaacccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcatacaaatttacaagaaaaaaacaaacaaccccatcaaaaagtgggcaaaggacatgaacagacacttttcaaaagaagacatttatgcagccaaaaaacacatgaaaaaatgctcatcatcactggccatcagagaaatgcaaatcaaaaccacaatgagacaccatctcacaccatttagaatggcaatcattaaaaagtcaggaaaccacaggtactggaaaggatgtggagaaataggaacacttttacactgttggtgggactgtaaactagttcaaccattgtggaagtcagtgtggcgattcctcaggggatctagaactggaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactattgcaagaacaaaaaaccaaagaccgcatattctcactcataggtgggaattgaacaatgagaacacatggacacaggaaggggaatatcacactggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaataaaaataaaaaaataaaaataaaaataaagattgcactgaatccatacattgcttgggtagaatggtcattttaacaatattaatacttcagatccatgatcatgggatgtctttgcattcatgtgtgttgtcttcaacgtgtttcatcagatttttgtagttttccatgtagaggtctttatccatcttggttaaatttatttctaattttttatagctattgtaaaagggattgccttcttaatttctttgtcagctagttcatcattggtatatagaaatactactgatttttttgtatattgatttttgtatcctgcaactttactcaatttatttatcagatctaagagttttttgatggagtctatgtttttctagatataggattatgtcatctacaaagagggacaatttgacttcctcttttccagtttggatgcctgattgttctgagtaggacttctagtacaattttgaatagcagcagtgatagtgagcaccttgtccttttctagttcttagaggaaaggctttcaactttccacattcaatatgatattagctgtggttttattatgtgtggtgtttattatgttgaggcatgttccttcctagtatttttagtttttatcatgaagtgatgttgaattttatcaaatgctttttctgcatatattgagaggatagatgcaaaaaagcatttttatgcgaagtcacccagtactgaactttttattgttgggagtctttattgctgatttaatctgattacttattattggtctatttaggttttctatttcttcctgattcaatcttggtatatgtgtccaggaatttatccatttcatctaggttttctagtttgctaatacatacttgttcaaaatagtctctgatacttttgtatttctgtgctatcagttataatgtctcctttttcatttctgattttatttttggaggtcttctcatttttcttggttagtctagctagtggcttattcattttgtttatcttttcaaaaaaccaacttttgtttccttgacacattgtactttttaaatttttattttatttagttctcttatctttattatttcttttattctactactttgtggcctagttagttattgcttctcaagttccttgaggtgcattattaggttgcttatttgaaacatttttagttttttgttgttgatatttattgtgttaaacttccttttgactactactttgtgttgtttccattttcatttgtttcaagaaatttattgatttattccttaattatctctttgacccaaaggtcattcagagacattttttttaattttcatgtatttatacagtttccaaagtttcttttgttattgatttctagttttattcattgtggtctgagaagaaacttgatataatttagatttttaaaaaatgttttgagacttattttgtatcctagcatctggtctatcctggagaatagttccatgtgctgacaatgagtactctgcagctgttcaacaaaatgttctgtaaatatctgtgaagtccattggcctaaaatgcagtttaaatccaacgtttatttattaattttctgtctagatgagctgtctggttctgagagtgggatgttgaattcctcaactatttttgtgttgaagtgtctctctccctttagatctattaatgtttgctttgcatatatctgggtgtgatactgcttctcagccttttggctaagatcaggtttagtatctggttgctctggtattggtgcatatatgtttagaactattctatcctcttactgaattgatctcgttgtcattatataatgactgtgtcttctttttactgttttgacttaatttctgtttcatctaatataagtatagctactcttgcttttttgcttttgtttgcatgaagtatatttttctgtctttcacttctagtctatatctgtcttttctatcttttacttctagtctgtatctgtgtacaggtgagatgagcttcttagcacataattaagtcatgttctttaatcaattcacccattctatgtcttgtgaatggaaatcttagtctgtttacacccaaggtgattatcgatatctgagtcttcattcctgtcattttgttaattgatttataattgttatgtatatcttttgttcctttctctctctctctctctgtcttattgtttatcattgcagttgggtggttttctgtagtgctaacatttgattcctttcatttccttatttgtgtttgctctaccagtgggttttatactttcaagtgttttcataatgatagatatcatccttttgctttcacatgtcagcctccctgaggtatttcttgtagtgctggtctagtggtgatgaattctctgagctttgcttctgtgagaaaagactttatttttccttcatttataaaggacaacttggctgggtatatggttttttctttcagtgacttgaatatattatcccattatctcctggactgaatgatttctgctgagaaatctgttagtctgattggagtttccttataagttactagatacttttcttttgctgtttttagaactctctatgtctttgacttttttttttttttttttgagatggagtctcgctctgtcccccatgctggagtgcagtggcgtgatctcagctcactgcaagctccgcctcctgggttcacaccattctcctgcctcagcctcccgagtagctgggactacaggcacacgccaccatgcctggctaattttttgtatttttagtagagatggagtttcaccgtgttaggcaggattgtctcgatctcctgacctcgtgatctgcctgtcttggcctccgaaagtgctgggattacaggcgtgagccaccgcacccagccatctttgacttttgaaagtttggctacaatgcaccacggggaagaccttgaattttatttgtgtgagtttctctgagcttcctgcatctagatgtctaaatctctttttgttagacttgggaagttttcacctataattttgttaaacaggttttctgtcccttttattttcttttcaccttctgggacactgaaaattcaaatatgtcatgcaagctttgttcattattattattttttatgtttttagtgttcatctgactgggttatgtcaaaagacctgtcttcaaattctgattctttcttcaacttgatatagtctattgttaaaacttttgaatgtattttgtatttctttcaatgaattcttcattccagagtttgtctttggttctttgtttttatacctgtctctttagtaaatttctcattcatattatgaattgtttttctgagttgtagtctatctcactgagataggctttaatattgttattttgaattatctgggatttcaaaaaattcttattcattggaatctgttgctggaggattattttgttcatttggaggtgtcatattttcttgctttttcacatctcttgtgtctttgcagtggtatctgtgtatctggtgtagcagttgcttgttctaatttttttttcttttctttttatttgagacagagtctcgctctgtcacccaggctggagtgcagtggcaccatcttggcttactgcaacctccgcctcccgggttcaagcaattctcctgcctcagccttccaagtagctgggattacaggtgcccgccaccatgcctggctaattttttgtatttttagtagagacggggttttaccatgttagccaggatggtctcaatctccagacctcgtgatctgcctgtctcagccttccaaagtgctgagattacagccgatttattaaattatcttttgtcagggtaactttttcttgaaggtgtatctatgctgccagttgggtaaagttccttggctttgattttgggtgcaggcagtagcatagtctctatgatttatttgactgtaaacagtatcagtagtatctatgattccttcagtggcttagagtgtggttattagtggaagcctgttgtaaaattttgctggggacagggatgtgatgtgaatcagtctttagaccccagtggtggcagcagtgggccacatgtgcctctcctaagctgctcaggacttggtggatatgtgggtcctggtgtgagctccctctctgaagcaatgccatcacatgatttccaggcagctctctgtatcagtttcagagaccacatgggttgacagacttccccaaggctaggactgcaggagtacatggtgggaatgtggatggctggattcattcacttaatctttcctcatattttagggagcctctctaggctcatagatgatgctagctgagcaggctgccttacttctctcttcttccttaccttaggcatttcctgtaatttctctgttgaattcaaaattatattttagatgataagtctgattacctactcactccattggttcttctctgtggagcaggcaagtaccagatgcctctagcctaccgtcttgaagacaccctccaagacaagtttcttaaaggaggtatgctaaggtagaaccttttttttgttagaagttataaaattccaatggaatgagtatatacaaaaagagaacattattggttcatgtaaacatgatgttggctattatcagtgcttacttgttcctgcgtttgtctctgcctcacctgcctaacagcttgttctttcagccttgctttcttcatgaagctggaactgtagccagctctaagttcacttcatgccagatgcataagcaaaggagaaaggatctccaattacacctcgcaaaccgacattcattctgtgcaaatgagaaatatctcaggggaggactcaggcccgacttgggccacacacacacccattggccagtcactgtgaaacaattttgtagactggttgtgagggcagaagtagaatttaacaaccttttctggaaccacataattgaaggaagggggaaaagttccccctaaatgattttggacgcacagttaccagaagaagagataaagataaggagaagaaaaaggaaaaaataaaaacagaaacagtatatactctaggaggtacatatggagtatcatgggaatttagaagaaagagattatttcttagaagaattcagtgaaatctgatggagtctttaaaaaatgaaggaatatatactctcaagtggttgcaaagaacatttcaggatagacaataccagcttgaaaatatgagttcagtgtagatgttttaaaaataagaaaagcagagtagttaagtgtagttaactacactttgaaattaatttttagtttattttatttttttgagatggaatctcgctctgttgcccaggctggagtgcagtggctctatctcagctcactgcaagctccgcctcctgggttcacaccattctcctgcctcaacctcctgagtagctgggactactggcgcctgccaccacgcctggttaattttttgtatttttagtagagacagggtttcaccgtgttagccaggatggtctcaatctcctgagctcgtgattcgcccgccttggcctcccaaagtgctgggattcacagacgtgagccactgcacccagcctgaaattaattttttagtccacatgaagcagatgaggaacatcaaaaccatctttaaatatatcagtcttgtagatgtttgtgaattaaattgattgacagagacagactaacaagaagttatttcagtgatctatgtggaaagtcttgagagcctgaatgtaatgagaataataccaagatataagcagaatcttgcactgaacattgccaaatattaaatactgtccctagttatttgtcagtgatattttaatgattattgccatcttcctcttttttccccattctccaaaactgcattattataatatacagtattataatatatatattatatatataataatatatatataatataatataataaggttatggattaactcctcttaattatctgaaaagagataacgttcatgtgctcagcacacaactaagtagtctgatttggtgttttttattttatttattttagaaaagaagactttcaaaaggagaaaaatctactgccaaataactcagcacctcttacagaaccacaagatgtggaagaaagtcattgaagaggagcaacggttggcaggcatagaaaatcaatccctggaccagacccctcagtcgcactcttcagaacagatccaggctatcaaggaagaagaagaagagaaagggaaaccaagaggcgaggagataccaacccaaaagccagaccagtgacaatggatagaatgggctgtgtttccaaacagattgacttgtcaaagactctcttcaagccagcacaacatttagacacaacactgtagaaatttgagatgggcaaatggctattgcattttgggattcttcgcattttgtgtgtatatttttacagtgaggtacattgttaaaaactttttgctcaaagaagctttcacattgcaacaccagcttctaaggattttttaaggagggaatatatatgtgtgtgtgtatataagctcccacatagatacatgtaaaacatattcacacccatgcacgcacacacatacacactgaaggccacgattgctggctccacaatttagtaacatttatattaagatatatatatagtggtcactgtgatataataaatcataaaggaaaccaaatcacaaaggagatggtgtggcttagcaaggaaacagtgcaggaaatgtaggttaccaactaagcagcttttgctcttagtactgagggatgaaagttccagagcattatttgaattctgatacatcctgccaacactgtgtgtgtgtgtgtgtgtgtgtgtgtgtgtgtgtgtgtgtgtgaaagagagacagaagggaatggtttgagagggtgcttgtgtgcatgtgtgtgcatatgtaaagagatttttgtggtttaagtaactcagaatagctgtagcaaatgactgaatacatgtgaacaaacagaaggaagttcactctggagtgtctttgggaggcagccattccaaatgccctcctccatttagcttcaataaagggccttttgctgatggagggcactcaagggctgggtgagagggccacgtgtttggtattacattactgctatgcaccacttgaaggagctctatcaccagcctcaaacccgaaagactgaggcattttccagtctacttgcctaatgaatgtataggaactgtctatgagtatggatgtcactcaactaagatcaaatcaccatttaaggggatggcattctttatacctaaacacctaagagctgaagtcaggtcttttaatcaggttagaattctaaatgatgccagagaaggcttgggaaattgtacttcagcgtgatagcctgtgtcttcttaatttgctgcaaaatatgtggtagagaaagaaaaggaaacagaaaaatcactctgggttatatagcaagagatgaaggagaatatttcaacacagggtttttgtgttgacataggaaaagcctgattcttggcaactgttgtagtttgtctttcaggggtgaaggtcccactgacaacccctgttgtggtgttccacacgctgtttgttggggtagcttccatcggcagtctggcccattgtcagtcatgcttcttctggccggggagattatagagagattgtttgaagattgggttattattgaaagtctttttttttgtttgttttgttttggtttgtttgtttatctacacttgtttatgctgtgagccaaacctctatttaaaaagttgatactcactttcaatattttatttcatattattatatatgtcatgatagttatcttgatgtaaatatgaagatttttttgtttctgtagatagtaaactctttttttaaaaaaggaaaagggaaacatttttataaagttatattttaatcaccatttttatacattgtagttctctccaagcccagtaagagaatgatgattcatttgcatggaggtcgatggacaaccaatcatctaccttttctaatttaaatgataatctgatatagttttattgccagttaaatgaggatgctgcaaagcatgttttttcactagtaacttttgctaactgaatgaattctgggtccatatctcccagatgaaaaactgttaaccaataccatattttatagttggtgtccatttctttccaacactgtttgttatgattcttccttgagtacttatatacagacctgctcattatctaaacaatcttaccttctaagtaaaccttgattgtgatttccagtttttattttctctgacgtagtagaaaggaatgtttacattaaaaatacttttgtttctcataaatggatattgtactcccccctttcaaagcattattttacaataattcatggcattttaaaaaataaggcaaagataatacgacaaaaaatatacatggtttcaaggcaaattctccaataagttggaaaatgtaaaaaggatcaagtggatgcagcctctacctaaataattaaaatatatttcagtatatttctgaattaacaccaggtcttcattatttagaacttactaaattgttttcattttcttagttttacctgtgtatctccatgtttgcaaaaattactataagtcaaattttgccagtgaatttaactatttttctttccttgcaattaaggggaaaaaagcatttatcttatcttctcataccccttgcatctaagtacttagcaaagtcaatattttcccattttcca

SEQ ID NO: 13540 - DNA, 34031 bp, Human
  misc_feature (1)...(34031): n = A,T,C or G
agcctgccagaggctgcggcctacagccggggagaggccagcccggcctacagtgcggacacaggacagaggggagccaggtgagccaggtttttgggcagggagggactgggagaccccagaggagagggctgcccccatgatgaccctgtccgcagctccgagagaccctgagcaaggctttcttcactgggcacctcctgcaaatcaggccctgcactaagtgttagggtcacggcatgacagtgacaaagatcccggccctcttgcagtttctgtgttagtagcagggagatggaagtaaacaaaaacatatgaaatgagtaaatgatctcaaatgtcagaaggggataagtgaaaagagaaaaaggagagcagagtgaggaggacagggaatgccgggggagggggcttggggttttaaagagggtggcctctttaaggttaaatgaggttcaatgcaaaaagccctagtgacatttgaagaaagggtgttctgggcagatggagatgccctagcaaaagctggcagtggcagggaggcctggagcattcagaacagcaaggaggcagtggcagcagagcaaggaaaagaggtaaggcaggacgagaggagccgcactaggggcacttgcaggactccggggggcagaggatggggccccttgccagcacccccacagccctgctgggggtattggtttgaaagcctcatatgaatcatttgctacatgtggttgcatgacccttataaagtctcctccctttccaaggcccacatcctctccataaaatggtaataacagcagtgcatctgtcaggttgaggtcaggaaggaaggggatcaaaagcatggcagcctgccggagagatttacaacatacctgctgcaagctaggaaacgcagagctggcctcccaggccttgtgggaggaacatgtaagcaaataagaacttgtccctaaccctagagcacccagggaacgagggagctgaactttgttcagagagaacagcaggggcaaagggtaggaagagaatgagtggaggccagggatgagggcagtaagttgacataggagagaggtgagtggagtagggttgggtagacacagcaaggactccattccacaaacagtgggccccaaggagcagattccaagcaggagaggaaaacaatgtgatttgcagttcaagagttcacctggcagctgggagaacaaataagaggaacactgaggccaagtaagagataacagtggcctggatgctagccaaagagatagcaaggagcagatggactcaagagacttgtgaaataggatggactgcacctcatggttgcctcactgtggaggaataggggcttctcagaggccaagcacttgccatgaaggagacagggtccaacctgggtatgaaagacactcaggggctccaggggaacacttcacaggcaggaagaaggcttcctcccttcagttccacaatatacctgcagggctcatagaaatggagctgagtgatcctagaacttatgagcagtttaatgagaccaaggtgcccccagcaatcctccacagtggagctgtagtatggacaagtcatgtgctttgtggtcagaccccatccaactcctggccatctccagctgtgtggctaggggccactcaacctctccaggattattttcttcaggtgtaagcttcactgacttttttgtgaagatttccctaggcaattcatgtaactcaaactgcagtggatagagcccaatctttggggtcaggccctgtccaatcttggctaacaagtattgaacaaacatgtaccaagcaatggctgcataccatgcctaccatgcacacagtgcctggtccacagccagtgtccacagggggagtggggaggtggagtggcattcaggtacttagggatgtctttcttctaccaaccagccctggctgacacccagccctaggcagttcctcttgcacacaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttggtaaggggaagctggggaatgggacatctgttttatgccccatgcttctcttgtaagaagagtccttcattagcagttctgcttccaaataacaaactttgcccttgaaattccactgttagagattcattccttcgaactgtaaagacaatcttcacatgtcaatattgcctgagcccacctaggggatagaagagtcctaggcagcagaagacctggattctggtcctaaaattctgccactgcatagctttgtaaccttgggcaattcactttcccaccttggtcctcagttttgtcatctgtaaaataacaataatgtctgacttcctttccagatccatgaagcaagtgggtgagaagatttgaaggtgccagaaacctcacccaggtccctaagccctctgttctctgtcctctgcagagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacaggtgctcactcctcgagcagccccactagagagggatctacctgggatcacctggaaaccccctagccccatgagccatttcccccaacaaagggaagacttgttgggaaaccaggatgctaggtgccctttatctcctgtactctgctcaggcagggggtacctgggcccctgtctccaataagctactcaactacagcatctctccccaacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatggtgagctaggactgctgcgtgtggtgtttaggttgtgcactgcaaaactccagagggcccatttacatctaggtagtcataggttcatatgctccgagggacatatgtttaataagaaaacattccagcagctggcagtcaagggtcctgaggaaggggtgccaccttctaatttgcacgtattgtatgagctcccagtggggcaagtcattccttctggaaacatcagcagccaccccttctcatggactggctataggggactgtgtgtcccacacacagcccacagatgaaaggggagaactgcctgcaagtacagctgggagctgggccccactccatactgcgctgatgcctaagagttcagacccacctagaagcagcttcacaggtaagaaccccacctcaggccaatgtctaacacctctccttgatcctaagggacatatcttcagggcctggagactgaagccacctatgacgcagccacccaggagtttgtgatacacagccccacgctgactgccaccaaatggtggcctggagactgtgagtatacatccaccccccttccttaactctccccaagtagaagaatgttggagggcagagtagcactggctttgaggtccaacagacctcagattgattttctgttctaggctgctgaccttgggcaagtcagttcaccaacctgagcctcaggttcttactctgtaaaataggtgggatattaaacatttcattagtgagtggctggaaagtccccaaaggaactttgaagtagaggagacaatcgatccatgagagacaaggcctcactcacacacacacgcacaaacacacacacttggtctagtcctaggcactcctcacaaccccggttcctctcatctcccgagttagtggcagagcttgccaccagccagagcacaggccctgtgatgacacagtggaaagaatacgcctgcctgcccctgctgcagacacccaggaaggctcacgcccattaccagcccccatcaggccaccaacgccgtacctcctgctgtggccaccaggtggcggccacatcaagcgtccctgaggcttggtgatttaccaagccccaacgagggatttccccttcctcaaacttgagaatttcacctccaaggacacatctgtggcacttggggacccacaccttgtgtggaaaaaattaaaacaaatatgctgagcccaactaaagcaggagagtgacagagatgagagacacatagagagagggagacacaggcagagaccagagacataagagagagacatgagccgggtgcggtggctcatgcctataatcccagcactttgggatgccgaggtgagtggatcacctgaggtcaggagtttgaaccagcctgaccaatatcattaaacctcatctctactaaaaatacaaaaattagtcgtgtgtggtggcgggcatctgtagtcccacctactcgggaggctgagacaggagaattgcttgaacctgggaggcagaggctgcaatgagccgagctcaggccattgcactccagcctggcgaaagagtgagactctgtctcaaaaacaaaagaaagaaagaaagaagaaaaagaaaaaaaaagagagagagagatgagagagtgatgacagaaagagagagagaaaataaatgaccactgtcaaaaatgaagacaaaagaaaccagccttttagatcagacagaccagggtacagatgaatcctagctctgcccctccaggccaatgaccttcagtgtgtcactctactctctgagcctgtttccttaactggaaaatgggactcatcatcctctctcccctgcaagaactggaaagcatctatcacagggtctagcgccacctagattttgataaatgataattatctgtattcattattataaggttgatgacagagtaattcattaatagttggggggggcaaaaaaaaagctggatcatttcacagtgcctttgccaacgctgctaggtttgcttggttctttgggggcaatcccctctctctttgatcagtgacttttcagggccccagaggtacccatccaaaaccccagccccaggaggctgggttggttgggaaaagcaatgcacaggtcttcctgtgacgggccgctactctctctgccctcagtgggacggtcagccacccatgccctggtccaggcccagctgatctgctcaggagccaggcggggcatgcacgcttttattgtgccaatccggagtcttcaggaccacaccccactgccaggtaagcccataatgctccctcaaggaaccctgccaggaggagagcccaggtggcctccctgacctggggccccagagggccacaggagtagctaagacatgtctcccttgggcagggagcggtccagttggacagacttggtgctaactggctaggtgaacttgagcaagatttagcatctttctgacctcagcttgttcacctgcaaaataggtacaataatcccagtgtcacaggctgctgtgacctggaatgtgtgtatgatacctgccacatagcaagcactctctcaactgataggtgtcctcatctccatctccttcaaggaatcatcattggggacatcggacccaagatggactttgatcaaacagacaatggcttcctgcagctgaaccatgtgcgggtccccagggagaacatgctgagtcgctttgcacaggttacagatctggggaggccggggacttgtacttcctggagaggggacctgcgctttgtgcaggctgggcctgggtcctccatagagcttagtttgggccacataacctcctcccccaagagaggctctgatatcccacagattggggtgaaacccctgcttaggagcagtatgatcttgggcacagagcctcagacctctcatgcagaaatgctcgtcacataggctgacagagcaatcgtggggtggggtggcagccccaggagaggatagggctgaggtgacctgcataatatttacccacagtgaggcctgacacagccaatcgcccaacagataccagccagaatgccagcaggagttctgaaggtcccaattctgccaggcatcacccctttagttatgggtcgtggggaggtccggggtgtcccaggagaggcactgtgaagcagggcacttggggaaatggcctggtattttaacactccaactccagatgcgccggttgaggggcgaggtgccctccatgtgtggagccccacagctctggagaagcgagggcatcctgggaagccttggcccagaacttgtgcccgtccttgttccacacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccaggcaaggggtgcccagtgactgactaccgcagatatgctgcctcttggtcccacagtgcctccccctgacaccacccttctgccagagccagagtgctgggagcaggcaatgccccccaccacatacacacacacaaacacaaaatctacccagcctggccccatctgggcatgtcagaggagtctctctggctgcctctaacagggctgaccagccggcctaacctgcatcctcagtgcctggcccccatcgggctctatgtgatagtgtctttggccctgtagcaccaggtctgtctgactctgtgtctgtccgagtccagccgtgttctgtgcggctgtgacgggttggacgggtctgggtcagccagttgccagctgcatcagactatggctggctgagttgattctgtcaggccgagcctagcaaaatccaatatcatatcgactgtgtgtggctgagctcgttctgtccagctgtgctgtcagcatcccactggtatgtctagtctggatcccttttgttgtaattggttgtgttgctaccactccctccacctcacagcacagaatagcaagggctgcctgaaccctctgtgaacactcagctcggccatttcacttcatacctcagcttcctcagctacaaaatgggtgtggcagaagtggcctttcagtgtggtgtggagggtgaaatgcagtaaggcacattaagtcctcagcccagggtcctttcctctggcaagctcacagcgccctcgcctggcctgggcttcagaatctgggctgcaagagttctctggaggacagggccactgggaagaaggggcttctgctgctgtcctgcccgaggcccatttatctgggctgcagaagtgtccccagggtggttataagaaagatgcgccaggtaagcagctgctgtctgtagaggaggcttcttgtaatcacatcctctttcaatccagttactgcgagctcctaaatgccggacatagccttgggcactgaggacatagcagcggataaggcagacacagtcccttccttggggttccatcagacctgagtttacatcctaagagttattgtttaggcttgacatattcctcagcgcgcggcaagtgcacacgggcagtggaaggtcacaggttcaaatcatcacaggtgcagggccacaactcttcacctgaaatcttgggaccagacgtgttggagtctcagaacttttcaggttttaggataatactgtgtatatgctggaattctataagcctcccttaacaaggggcagtacccaccaacaaatgtgtcagtattcctgcagtgaaatgtgtggatgttcatgttagatgggatttttaaaggattatcaatggcctcatgtcagttcaagttttgcaatgagttctaaggaactgtctgtttttaaggtttttatggtgtcggggataggggaaggtggacacaacaggtagtgatctaaatcttctggttcttttcccttcagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgaggtacctgctgtctgcggaggggcaggcgctggcaggcgctgggagctaagattgttccactcactggggagcagccacagccccatccccatgggcactccccacccccacctctcccagctttcagcatcccagggcgtctgggtgaacggcaccctggtatataaatttacccacaaccagcccccagagagctacaaacatactaagagaaaacaatcacacctagcgtagagaacacaggtccacaacccctgatgtgtatttgaaacctgaaaagctccgaaaaacagttgtttggaactcatttggtggcatagtttgacctgaactgacctgatttatccctctgagtgtgaatacattttgcagtaaaattattaatgtgtttaatcactaaagctgccccaaaccccactggggctattatataaaatgcactttaaatgccacttggcctctctataatccaaaagttactctgattcctaaacacatctggctcacaggtctcaggtaaagcattgtggacttacatatatagtaaaattcagtctgtccaggctaccatgctttataagcactgctcattaacccttccaactgcaatgaggcacagagagatcaagggacataactttcctcccaaggacttgaaagctccaaagataggcagggtcttcaagaaccaaaatctgaaagcagtcctgctgcccagcagcctctgtcctgttggggccactgtaacaaaataccataaagcagtggtttataaacaacagaaattggcctggcatggtgacttacacctgtaatctcagcactttgggaggccagggcaggaggattgcttgagcccaggagttcaagacaagaccagcctgagcaagatggtgagacccccgtttccacaaaaaaaaaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctcccaggttcaagagattctcctgcctcagcctcctgtgtagctgggactacaagtgcacgccaccacgcccagctaatttttgtatttttagtagagacggggtttcactatgttggccaggatggcctcgatctcctgacctcgtgatccacctgccttggcctcccaaagtgctgggattgcaggtgtgagccaccacacccagccagaagcagcctctttcatgagggcactgatcccattcatgaggcctccaccctcatgacttaattacctcctgaaggccccaactcctactaccatcataatacctcctaatcctagtcctaatcatcaatacctcctaatcctagccctaacccttgagggttaggatttctacataagaattttaggtggacacattcagaccctgtcaccctcctacaacccagtaagtgggcttacagtggacacccatcctcataagctagctttctaaaacccaggccagcaaaatccgtaactcctggaggtttgtgggcccaatccaggcagcaccctcttcccaatcctggagacactggccaggccaggttttccttcactcttatgcccctacagctacattgcctaattgtgtgcctctgggtgagtcacataagctgagtacccgccttctcattcataaagttgtgagcagaggaaacacttcttacctcagagctgagctgggcatgagtagatgctcagtaagtggtgcacagggttggtccctatggtggaggccccctaacaccgcccaacccccctccatgttctcacagctccacgcactgagcacgggcatgaaggccatgatgtcagaattctgcacccagggagctgagatgtgccgcagggcctgtggcggacatggctactcgaagctgagtggcctgccatcactggtcaccaaattgtcggcctcctgcacctacgagggtgagaacacagtgctctacctgcaggtggccaggtaaggtccaggctgacccaggcctttgcccaagcccttggggacccaccaagcttctgttgggtggagggttccgtctgaggcccataaaaagagcaggctttgcgaagtgctatttgggagctgtccaattccccagtatgactaacctatccacttctaggccaccatcctctctcacctccaccacagcctcagacccctccctggtctcttgcttctatcctgtcctgcttctccacaggcagccggagggatctgttcagagcctagggaggatcacatctttctctggtttgaaattcttcaacggcttcccagtgctcataggaaaatgacatattctatgctgtggcctgcaaggtccatgtgacctgacccctgcctccccgtccatcctgctctcaccacctcctgcctctgctcacttcttcttcttctttttttttttgagatggagtctcactgtcacccaggctggagtgcagtggtgcaatctcggctcactgcaacctctgcccgccgggttcaagcaattctcctgccttagcctccgcagtagctgggattacacaccaccatgcccatctaatttttgtatttttagtagagatggggtttcaccatgttggccaggctgctctccaactcctgacctcaggtgatccacctgccttagcctcccaaagtgctgggattacaggcacaagccaccgcacccagccacctctgctcacttctgccggccacacacttctttctgtccaggaggcctttgcatttgatcccctcccacccaacatggccttgtttcctttggagcagtttcacaatctatcattgtctcatttttttgttcacctttttagctctactctccaactagattaggagctccctgagggcagggactacccctaccttgctcgctttagcatcgcctaagcttggtgcagagcctgcacacagaggctccaagcaatggccaagtcagcttcctccacacaggcgatttcttttcatccctcttaggtctgtgggccctggaggccgacagagcctcatcctcacctattctcaggtgaacaaacagggcaaatgcttccctatgcaaggagaaagaagttcactggcaaatatgaaaaacaacatttattatatttttaaaaatatataacatcccttggtttttttccaaattagaaaaggagtacaatagcacatattatgtactctgcactgtgccaagcactctacaaatatcatctcattccatttcacaaaccctcaatcagatgagaactgtcctccccacctagagctagagaaacagagacttgggaggtgaagcttctttcatcacacaggtctcggcgaggctgtatgggaatccagggctgtctaagcccagaacctgtaaccactggattatcctaaagcagcagttgagagtcacctataatcctcctactcctgttagcattcttgcctctatccttcttttttcagctaagaaaatttaatttccacccagtcactgtacaagtcattataaatcccaaaatcacagtgttctgatggaaaattctgtttgctcagatcacagaagggtttatgttcaggatcagagagtgtctggcccagctccacaggtcctgggatatgcctgactgagggcctcgaggcaggacggcccgagggggaaccctcaggagggaggccaggcagaggcctggtgacctggctctcccacgggaaggctggaacctagcatgagcttgcctgtctctgggagtgaggggtgctgggctgtctcacagagtctctgccctctcacctgcctcctcttccaacccccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggtaagccagtgctgagaaatcagccatcccacctgggcacaggctccatgccacactagggcctttggattggttgggtggacattcgtggattcagttctaaaaaccaccccatgcctagcctccccggtcctctcagttcctgccaccatgggcagagagaggggatgtcccccccatcagccatggacccccgtcacttccccatcctggtcacagtagtagaaggacatcacacctctggccagtgagatatttttaaaatctctagggtcctatggtgatttgcaatacaacgaatgtacccatatgtaaatactccaaatgtattgatatgcaaataccaataaataaagcaatactcactcgtacgtttgaaatatcccataatctaaaaataatttttgaaaatatgactacaccacgggatagaattcatttatttccagggtctagtaggctccagggaacatggacaaaaccaaggactcatccattctgtcattcaacaaatattgttcagtacctactatgtgttaggaatgaacaaatgtgccaggggctgggaatagagaggtcctgaccaaacacacataccaccatggaaaagatggaggtttaactacctaaaaagaaaacgttctgaatgctgcccccaaattaaaacaccgaaaacaggctgggcatggtggctgacaccagtaattccagcactttgggaggtcgaggtgggcggattgcttgagctcaggagtttgagaccagcttcggcaacatggtgaaaccccacctctaccaaaaatacaaaaaattttaataaaaaaataaaaaggaaacaccaaaaacaaactggaaaaacatattttcagtatataataagaggtcttatatcccaacctgtggtcccagggatggttaatagttatttcaagatcacaagcaacttggaacattcatttatttattccaaaaatatttattaactgcctataatatggcaggcactgttctaggcattagggacctatcagtaaataggcctgataaacaccccaaactcatagagctaacatttcaattgggagatttgaggaggggaagataaggctgctcgaggtgattaaagtgtcatggtatttctccttgcttgaaactcagtgtgacatctgcttatctattccctgacaaagcaaaaaacatattgcttaataaacagtttgctttacacacaaattctaagggtcatggatggatgggcagggaatagaaaataagaggggattaaaggttatttaatgactaatttagtggtttgcaggacaaaggttggttttctctttttgtttttaggtcccttgggtagaacctgcagcaggctaggtgaccgacgggcctctctagcctttacagaaaaaccattctccttgctcaggccacaggacgtcagtcaacaaaaaggcctgaacatactggtgtgaggctggaatctgcattagaaataggggacagctcctggcctgtggccctgaggctttataacatggcgattaacaacaagtcaaaatcctggctccactccttactagctgtgtgaccctggacaaattggttaacctctctgggactcagttttccccattgcaaactggggggtgcctgcccttaaaagagttaaaaagataataaatatcaatcatttagctttatggcacataagtggtcaataaacaggcattatttctacttctgagggaccacaggaagcccatcagttgtcttttccactcagtcaggaagctgaaccttttttgctttggctttcaggctcataaaggactcagtgcagcatttacagaccctgacgcaatccggagctgaccagcacgaggcttggaaccagaccactgtcatacacctccaggctgctaaggtgagcgcctgccagctgaagctgaaagggatccattttgcttcccaggcaggctaccctgctgggaaaatccgggctctgccattattccccaactctgcttcagtggcggctgccctcatttcacttccaaggctttagtccagggtattttaattaaaggacttaactccaaagcaatcttgctggcagctcttaggggaaaaggtaatgaggcagtgttattggatttgcttcaggttgttcaaatatttcctcccagatagaaaagcaggtcaagtctccccttagccccacaggcaatccttggatgtctgattccatttccactcgttttgtgtttctgcataattcacagtcggtcggcaaatatttgagcacccactctgccctgggcactgacctgggtgctcaacagtgaagccactgcccatgcacggctacaatcaaggaagcaccatgacagggaaatacaggctgctatggaatcccagagcaggtacacttctgcccacctggaggagtcagaaaggcttcccaaaagaagtggcatatcagctaagacttcaaggataagctgaaattagccagctaaagggtggggtggcagctttggagagaaaagtttccaggcaaagggagctgcgcgtgcaaaaggaagcagcaagaaggatcctggtgtgcttgggaggaagtgcaaatctcccaaggaggacctaaggagaaggactgagacaaggggagaaggagagacaggcaaggcctctgaccttttgcaccactgtgaaaagttggggttttgttttcattgcaatgcctttgctgagtttgtttggaggtggggtaaagtgatcagtttcattctagaagaatcatgcaggttgcccaggatggaatgaaagggagcaagttagaaaggagcaagtctgaaccgggactgagggtggtcctgaccatgagcatggcagaaggcctggagacaagtgggtagatcagagatgctaagggggaagaaggcagggacaggcctcagagtgctggggtgggaaagaggtaagaacaactcctgagttctagcttaggcagctgggactctggcaccgccaataactggaaaactaaagtgatcacgccaatcctcaggcctcagacccagaaaatggcagccttggaacaggagagccctgaagggctgcagaggccctcgtgggacagggctggtcaggcaggctggacgttgagcaccaccacgtgacccaccacctccaccacaccacacgtgatgggattacctctgcagccctcagttctgctcagcctacagcaggggcaccccctgctgtgctaactgtcctgtcaacacagaaggtgagccaaggcttcctgctttcactggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagggtgaggaaagagaactcaggacttaggtcccagaggtaggaaatagctgagtccagatgctttcccttcccacaccactgagggtgtgatgagtgactgaggtgagcaacaaattctggggggatggagggtgacagccagccagcctgcgggggaagaacacgtccctgacagcttcctggggaggtggtgccccagctgagtctccaaggtcataatggatagggctttctgtactctctgtgctttgtggggttatttagtctacagaaagcttcagcacccaactgggccccatctagaaaccataaatgtgcaggtagagataactgcaacttgagggaagaggggatgatactgccagaagagtagacaagggggagccacgggctaaattctggtcccagctctgtgtgacctcaagcagccccttccctctctgggctttaacttccctgtctgtagacaaaggggcatggaagagccctttaggctctgtcaggccgtggtcctataattcagactctgaccagaagagatgtcagtctccaggaccatgggaacaaatgctggcctcattataatccagcctcagtctcctgtggctttggccacacagggttaggaatacagccctggtgtggatctcactgctaccacttcctagccatgaccttgggcaaaaaacttaatctttcagagcctcagtctcttcgtctgcaagatagagctaataacagtacctactttgtaggattctaataaagattaaataagtaaaacttagagaggcagctagcacccccacccccaaattagacaggaggcaagatttaaaccaacacacacaatgtaaataatgttcactgtgctcagagcgtggggccaaggttcagctcagcccttccccaaagtgtagaggtcacctctgtctctgatcctcatcctgctttttaaggcccaggcccctgggcagctctccatcactccactcctcaactcagagccttgagcatttgaggatgtggctctcagattaggacaggaaaaggagtgcgggtccgcagttctgccaagctggacccagtctgagcaacaaaggctactggagccagcagaggcaacacagcacatctgctcaccttccacagccaaatgctgcaagcccagcatggctgtgagcacaccatgtctgaatggcaaagtggagttgtcagcacctgtgtgagggccccctaggaaacacaagttctttccaagtgagaaagcggatcgggtcactgcccagctgaagactcccagtcccacagagcaaattctgaccatgttattcacagcccttcactgacctgggccccaggtatgagtccaccctaacctccatggttccccatcatcacctcattataccaccacacttcagcctcattaaattgcctgcagcttcctgaaagtacagccttttgcacataaagctccccctgcctggaatgacctttcccccaactcatgtccgcctgggtgaactcctttgaacccccaaggcactctttttttttctatgatagagtctcactccaccacccaggctggagtgcagtggcacggtctcagctcactgcaacctccacctcccaggttcaagcaattcttgtgcctcagccttccgagtagccagaattacaggtgtgcaccaccacacctggctaatttttgtattttttgtagagacagggttttgccatgttggccaggctggtctcgaactcctgacctcaagtggtccgcccacctcaacttcccaaagtgctgggatataggtgtgagccaccgcgcccagccgaacccccaagacactctaagtcttgctactgaaaatcactacagcagcatgggcatcacaggggaccttgttagaaatgcacagtctcaggccctgccctggaatctgcattttgacaagatccccaggtgatctatatgcacataaaaaactgagaggcagggcggggtccagaggctcacgcctgtaatcccagcactttgggaagccaaggaaggaggatcacttgagctcaggagttcgagaccagtgtaggcaacatagcaagaccctcgtctctactaaaaatacaaaaaaaaaaaaaagccgggcatggtggtgtgtgcctgtggtcccaactactcaggaggctgaggtgggagaatcacttgagcccagtgggacagaggttgcagcaaggcaagattgcaacactgctcttcagcctgggtgacagagtgagattctatctcagaaaaaacaattaagaagcactgctttatactttctctcttccttgctctcccttatagaactcatatatcctacctgacaaaataattgtgtgtgcttgtcttgacgagatgcggactgttcaaaatatgttacaaccagtaggacaaggcaccaaccaatcaaaatggactttagccctaggggaagcaaggtcctgaaggcctcctgctgagtcaaacattaatcctttagttgctgggctgtggagagaaggagggggtcttcgggaaggagtccatctggcagaaggggctctcacagggttgatggcagtggacagttgccagctggtattaaagtattatttttacaactgccacagccagaccataacatatgggctaaataacagcactgcttaccttaaggagtttatactctagctggaataaatttcatatatatcttgaaactttctcaccccatggtgcacacatgtgcacgcacacacacacaccactgacttgaacacagcagacaacaaatagctattttcttttcttttcttttttttttttttttttttttttgagatggagttttgctcttattgcccaggctggagtgcaatggcatgattttggctcactgcaacctccgcctcctgggttcaaatgattctcctgcctcagcctcccaagtagctgggattacaggcatgcaccaccatgcctggctaatttttgcatttttagtagagacagggtttcaccatgttggtcatactggtctcaaactcctgacctcaggtgatccacccaccttggcctcccaaagtgctgggattacaggcgtgagccaccgcgcccagccttaaaatagctaatttcttaagaacagtggtgctgtcctccaccttccccaggccagcctccaatatgcctgtattctttccttctactttccaacctacttgaaaccgctccaagcaaaagaaaacaagggccatgtttcaaagcccaccagtcccccccgtccccgctccccccccacacacacacatatacacaacatcaaaacgccttgatcagacccagagctaggagaaaaggcagctgctcatcagcctgctgggaagcacatcatgcctcaagtttaattccagccatcttgccatgctttccagggtgacttctggagtagaaaaccagaaatcaggagaacatatctttgtgtctttgtaggtgcactgctactatgtcactgtgaaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggtgagtggcagagacttcaaaccatgttagtcttcagagaataaccctaccccttgttcacaggtcacttccaactccaaaaccttgctaatgggcagagcagcaacagccctggagaggtctacaccctattatcattacaccagcataaagcattatgaattaatgaaagaaaaaaatgggaaaaaatgggaaaaatactgaagaataaatgagctacctcatttgaactctttacattgtcaaggaaataggaatagtatctaaggaaaatcaataaaatgaagcatgctacatatgaatgatatgtgctaatgtgctaataatagtctcaaccatagctaactttttttttcttttctttttttttagacagggactggctctgtcacccaggctaaagtgcagtagtacaatcttgtctcattgcaacctctgcctctgggttcaagtgattctcctgcttcagcctcccaagtagctgggattacaggtgcccacccccatgcccagctaatttttgtatttttagtagagatggggtttcgccatgttgaccaggctggtctccaactcctgacctcaagtgatccacctgccttggcctcccaaagtgctgggattacaggtgtgaaccaacgtgcccaggcatagccaacctttaaagagcacttatgtgacaggccctgtgccaaaagcttttacatacatctcatttaatccttacagccctttgaaatgggtactattaatctcctcattttattggaaaggaaattcaggctgatgggagttgcccagtatcacacaatcagccagaggaggggctgggtacaatctcaggtctggcccctgggcatgagctcttaacctgtatgttaaggttaaggttgaggtattatatactttgaacacatcctagtctttgttgaatgtgcttaagcaaattcttaccaagtttagtaaacttaccttaatcttccctcagcttcaagatgaaaaattttttttaactctgtaattcatatattgatttataaaataataacannnnnnnnnnnnnnnnnnnnattattctataatctaaacgattgctttaaaaacatatcaaaaccaaagcccaacctgatcagagtcctagaaaaaatagaaataaaaacaataaagtaaaaaaaaaagcctgggcaacatggcaaaaccccacctctacaaaaaatgaatcaggcacacacctgtagtctcagctactcgggaggctgaggtaggaggattgattgatcccaggaggttgaggttgcagtaagctatgatcacaccactgcactccagcctgggcaacaaagtgagaccttgtctcaaaaaaaggaaagaaaagaaaacattgcaaattatttaccattgtccataagattaaaaaaaatggactaatttgagaatataatctttttgagacctcactgggcagaaaatatgatacctattgcatggggttagaggcgactcctagaatctccaacaattcttatatcaacaagactaataaaaagaaaaaaagaggctgggagcagtggctcacacctgtaatcccagcactttgggaggccaaggtgggaggatcacttgaggcaaagagtttaagactagcttgggcaacatagtgagaccctgtctctaaaagatttgtaattttttaaaaataagattttaagacaggtttttaaaaaactagaccaaattccttttatttctcacaatatgcaatatgttacatgccctttatgactactcatagcatgtaacagatagctggtggtcaaaaaaatgtttgttcaggccaggcgcggtggctaatacctgcaatcccagcactttgggaggccaaggtgggtggatcacctgaggtcaggagttcgaggccagcctggccaacatggtgaaacccggtctctactaaaaatacaaaaattagctgggtgtgatggcacatgcctgtaatcccagttacttgggaggctgaggcagaatcgcttgaacccgggaggcagaggctgccgtgagccaagatcgtaccactgcactccagccttggcgacaagagtgagactccatctcaagaaaaaaaaaaaagtttgttcagttaaatcatcaaaaactgtcaaaaatacgtttgacacaattatgtcccaggtataaaactttccctaatacagggaatccagtggtgaaaactattaagagcataattaagtactgcacagttcaagcccaagggtgtccatctttttgaaactctcagaatttaaaagcacttgaaaataatgttctagccccggttgtcagtgatgataaaatacaaaagattaccttaacaccctataagcatgttttttaaatttgcaaacagcatttctaagtgcttgccttggctccagaaacttacaattcaagacaagacagacagcccagatgcaatctgccaacttactcatgcgtcaaacccagaaattgatttacttccatgatggttcctaagtagccttactactgcagggtaattaggcacataacagattctatgcatatcactgtttggtgtcacagttccctgccttgattagtcactatctccctaagatttctgagatgaaaactgaagggcggcatagtatgctatggatgccaagaacaagctctctgcaatgttaactgacccaaacagtttttagttgtttaagcggtcataaaacctcagctggggggacttccaggtaaagatgacagattaaactatgcatttacttctgttctttcccgaaaccctactaaaacatcagtgaatggactgaaattttttaaaaggcataaacccacaaagagaaagagatgttgtctctgtgttgtccaggctgctcttgaactcctgggctcaagggatcctcctaccttagcctcccaaagtgctgggattacatgcatgagctaacacacctagcctctgtgagtaattttaagactttccttgactctgccctggcagaagggtaaatagaggatctgtggactagggagcatcaggtatagttgataataaggctacccttcagaaaacacagggttctttataggccaaatactgacacctccctcccccagaccttttttcccactggttcctaaaaaactggcagccagactagtaccctgcaagaagatggtaagatgatccttctctggagaatctgaccagcccaaggagaaggagctaaagacactgacatcagagtcccccaatggtccacccaattcactccatagtgaaccccatactagcaagcatagccacaagtttgtaatcagctagttaaggctttgcttttagctatgatcagacactcagggatcaccaaacacctgaagaatgcccctaacataaaagatggagaccaaaacaagcaagaacaaggcaattcagaggacataagagaatccacagggagaagaaaacttaaaaaaaaaaaacagtgatatctcagagttaagagacggtattgcaaccacaaaataaaaacctgaatgccattatttaaaactaatattcagagaacctaaaaaaagagctccttgaagttaaaaaatgataatggaaatgaaaaactcaatgtaaggactggaagataaagttgcagaaatctcacagcaagaaagcaaaaagacaaaaaaaaggaggacttttaaaaagtaagaggaccaatcttagctgttcatcatctgaagaacaggtctagaaagaagacagagaaaacagaaggaagcgaatcattaataaaataattcaagaaaacattcctcaaatgaaggatacgagtttcagatgaaaaagggtcacagatgcctacagactagaggagaggagacaggcacacacatgcacaaaataagtcacactgtataccatgtgaaatggtaatacctaccatgaaagaaaggatagcaggaagtggaggaaagaatgctgggggtcagtagggaggaggggaagctacaattttaagtaggccagagaaggcctccctgggagggtgacatttaaggaaagacctgaggagaaggtagggagaagctgttgtggctgctagggaaagagcattacaggcagaacataagtacagtcatgcatcacttaatgactggaggatccgttctgagaaatgtgtcttcaggtgagtctgtcatcatgtgaacatcacagagtgtacttacacaagcctaaatggtatagcctattgctcgtacagtcacacctgcaaagcatgttgctgttctgaatactgcagccaattctaacatcaatcactaagcaataggaatttttcagctctatcataatgtcatgggaccgccatcatatacatggtccatcattgaccaaaacatcattatgcagtgcatgacagtacaaatgttggagaccagagtgtgcttggcatatccatccagagaacacagaagaggccacaggggcaggaatggcatgactgcagtggaaaatgacggcagagggcagagagttaagggagtacagtagggggtgggaagagacggtaaggtagatcattgcaaagacttaagagaatgcgagggttttgagcatgggatagaatgggagggttttgagcattggatagacacaacctaaaagaatctgatgtgtatttttaaaggcttgctccagctgccatattaagaactaagagtgaaaagcagggagatcagctggatcgctaatgcaatcatccaagtgagtgatgatagtggattggagcagtgacagtgctggaggtggtgggaatggttgaagtttgaatatatcttgaaggcagaacaggatttgctgacagattagatgtatggtgagaaagaagagaagaatcaaggtttttggtcagaagggcagagctgccatttactataaatgcggaagactacaggaggcccaggtttgggcagggtggacgggaaggagtttgggttcagatacattacttttgaagagcctatcagaaatccaagtacagatgttggtaagcaggggacactggagggataagtttggaagtcattggcgtatggttgatatttaaagccttgagaagaacatcacaaggagtgcatgaagagaagaggtccaagtactcagtcttgagaccctcgcaagataataaggaagtaaccgtggcaagagctatttctgtggagtggtgggagtaaaaacatgaacagatccagttcaggagagaatgtgaaaattggaaatcataagcataaacacacataacactttcagggagttttgtcctaaacgggagccaaggtgatggagaaggaaatagagtcaaaagcttgtgtttaagatgggagaaatgattgtctgtttgtatactgatggaaatgatccagtagagaggggatttttttttcttgtacctttctttgaacttgatcttggcctcccatcacgccttgtgtttaagagcaaggtctttgaggagatccttgttgatgacagtttgtccaagaggatatctacagagtaccttgtgggcatgaggtgattgcagttataagcttttgcaaaagacttgatccttgacctcttggagatcttcttgcctatggcagctgtcactttgtgaggatagcagtcaattccagctaccaaagcatgactgtaagaatggactgaggtgccatcatcaatgtccttcatgataatggctttgcgtccagagtagcatccagccaggaccagcaccactttcccactttttatgaacttgcccattttgacagcaaccagccaggcctacagtaaaaagaaagaagggcatttccactaactttttacccctgaggggaattttgatgttgttggagaaaggcaggagaatgttgttctccagtatgcaagaggaaaagacatctagtagacaaggagggactgaggcctgagctgagagcctgaagagagaaagcattgtatgtataaatgcaagggtgggaacttacacagattctcttactgcttccacttcattagtgaaatacgatgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttgagcgggagtcttgctctgttgcccaagctggagtgcagcggcacgatctcagctcactgcaacctctgactcccaggttcaagcgattctcccacctcagccttcccagtagctgagactacaggcacacaccaccacacctggctaatttttgtatttttagtagagacagggttccgccatgttggccaggctggtctcgaactcctgacctcagctgatccatctgcctcggtctcccaaattgctgggattacaggtgtgagccatcgcgcccggcctgttgaatgtatttttgagagagtaatagaacatggaatttcagctggataaggaatgaagtgagaccacaagggggcagggggacattaaattggcggtagggctcatatgatgttggggatcatcaagaaacgattacattggatacagtatcccagttaccaccaatgctttaatgacacacaatcatcataatgtcaatactaaatattggtctggccaaaattataactatattgggaggcccgaaggccaggaggaagaagaatgggaacaaggggaggtaggagtgaagagagggggtgataaatataaatctttaccttttgaatgaagattcaacagataatatctcaaactgaaccatcaacaagcagcaatataaacaagatattttgacattcagataaatactgaaatatcaactaaaagattgaaattgccagccgggcatggtggctcatgcttgtaatctcagcactttgggaggccgaggtgggcagatcacctgaggtcaggaattcgagaccaacctggccaacatggtgaaaccccatctctactaaaaatacaaaaatcagccaggcatggtggcaggcgcctgtaatcccaactactcgggaggttgaggcaggagaatggcttgagcccgggaggtagaggttgcagtgagctgagattgtgccactgcactccagcctgggcaactgagactctgtctcaaaaaaaaaaaaaaaaaacagattgaaattgcttctgaggaaaaagaagtggaaatcagacaggtatatgctcgttatttatttatttatttatttattttgggacaggagtctcactctgtcgcccaggctggagtgcagtggcataatctccactcactgcaacctccgcctcctgggttcaagtgattctcctgcctcagcctcccaagtagttgggactacaggcatgtgccaccatgcctggctaattttttgtatttttagtagagacggggtttcaccatgttacccaggatggtcttgatctcctgacctcatgatccacctacttcggcctcccaaagtgccgggattacaggcgtgagccaccacgcatggccggatatgctgtttttttaaacaagccttacggaaccctttgactcattatactatgcacatataactgattaaaaaataaaaactaaaaaaaaatgctgaattgtttgaaaagcgaataatcatgcaacctctaattaggtattgttattcaccatccaagactagtttgattcataagagcaatctaaaatacttacaaactcttgtttcctatcccaggaaggatgccatcctgttaactgatgcttttgacttcaccgatcagtgtttaaattcagcacttggctgttatgatggaaacgtctacgaacgcctgttccagtgggctcagaagtcaccaaccaatactcaggtagttgagtggaacacattataaattatgtaagaaagcagagaacaggcagtgaatacaccttcatgttctcccattttaattgattcccgttaggttggcaatcacttggcgtagcacgtctgtttaaaatattcttagagaacacataaaagaaacaaggagtggcagtatggcctggcaggaactctgagcctggattgtaatcagcaaaatgcactgctcggaacttagtaaagggaattaagaggaaggcccaagctctaaatcatggcttgacagacccaagtgcatacacacagagtggtaaactggcttttaagtaacaaaaagaaggagataaatcactgcggtaattgaaccaccttattttcagccttttaactttcagttttgtgtagataaaagtaggtattcagaagtggtaggaagcttgagggatgtctctcttagacctgattgcctgctagagatgataccctctcctcttcactctaaggaatacaatccaaggagcaaagaaagctgctgcactgccattagtagcccaggaaagccatatgagtgacaattaaaagggtcatgccaaaaaaatccccagccatcctaggagagcacaccagaactctacatcattaacagcgagaagacggggaggactcataaggtcccaacactcaagggccagggtatgctcgcagctctatgcttatgagcctctttgggaaaagttgtaaatgtcaatgaatatgttaacaggagtgaggtaataaaccctgtagttagaatatgaggaaccaatatttaatagcagattttacatagatgatcaaaacaaaaagtctataggtacaaaacagattattttaaattttatagtgcaaatacatgattcaggtggtgaagctttcttttttacctctttggtccaatttcagaaaaggtgtcttaacaccacatcaaattggcaactctcaggctttcattcacacccagcatggtgttagacttgctcttaacaatttgcagcctgtcataccacatggcttaatttaacatgattatctaaagttacaacacaactaacccatcttggtcactccctgtccccagaaagacatccttttaactcaaggaaatataaacaatatatgttcactgctttagtacagttaacctacttccagtgtgttactttttctaatgattagatctaacatttcaatcttggcataaaaatacagcagtcctcccactccagactagcttccatggtctaaagataaatgtgtgccctttggtgctccacagaaaaacccgccctgctataacacctgtcagaaatgctgacatatatagcccaaacctgttatactggcaacacaggaaacattctggtttctctagagagaatggagggggctttcttgtgttttagttggttttaatatttattttaaaagactttaatctggatactacatgagaacatgtttatctaaacgagaggaatgactgacccagagggtcaacacatttgggaaaacattgatgcacttcatcccattcacttctatctccttccacttgactgtgaacaacgaaggagtcttcaccttcccaactccaagatctatcacagagtagacactccacgtctatggaataaatgaacatggttttacaacctgcatagtgagacaaaggaatctgctgcatacacagtgccacacactcttgtcatcctagcttatattaccttcctaaaaaggtgacaggtatagcattgtggatctttcacgcatgataatttgggaatgtgaagttacaaatgaccttagtgaactgtttccagtcagttaaaatgacatgaggctgcctgctaatgtacatgatcttacatttctggctccttttagagatcaccaaaatagcacttttaaagtgtattttttaatgtgctgtggataattttttaaccctactcttaagatataatgctataattttgaagctgcaataagagacattttcctcatttgcactaatagaaaaaggcacactacagatattttatgtatttttatttattattatttttgagacagagtctcgctctgtcgcccaggctgaaatgcagtggcacaaccgcggctcactgcaaccctctgcctcccaggttcaagcaattctcctgcctcccaagtagctgggattacaggcacaagccaccaaacccagctaatttttgtattttgtattagtagagatggggtttcaccatgttggccaggctggtctccaaactcctaacctcaaatgatccgcctgcctcagcctcccaaagtgctgggattataggtgtgagccaccatgcctggcagatattttaaataaaacagcagctatgttgaaacacaccctgtagacataaaagtacagacaggaatatatttcactgacatttttctaccaaaagaaaagtgctatgctaaggtaaacatcttagaatcataggagaagctctcttctgtctggggcagcgttgagctttattcctggacaggatgatgtgctttccttggtttaagggaagaatcattggggataatttcaaaacaaaaatcctgtttttccccaattattctattgtaaaaatgtgtccaagtaggagttagatgcattaaatacatctactgattcattcattcaacaattcaacaaatatttactaagtacatgctttgtgccaaaaactattactagatactgaagatacactggagaacaagannnnnnnnnnnnnnnnnnnngagtttgagaccaacctggccaacatggcaaaactccgtctctattaaaaatacaaaaattagccaggtgtggtggtgcacccctgtaatccaaggtactcgggaggctgaggcacaagaatcgcttgaacccaggaggcggaagttgcagtgagccaaaatcgcaccactgcactccagcctgggcaacagagcaatactgtctccaaaaaaaaacagtcaaaagcccagtgttcgaggagcttacagttttagtgtagacaggcacacacacacacacaaagtaaatattataaaagatgagactagaactaagaaacaaagaatcaagacactgaattacagcataatgaggataacctagtcggacctagaatactgcttatatgatccctatctggttccttgctttgtgattaatgttcagtttcagagagcctcaaagagtcaagccttttatttgtatgaaattccaaaagcaagtgataagctgtgtttttaattggccacctgcatccacaatttaaaatctgcatgagaaaaggaaggatgccctttggaaaaaatgtttctccatatgttcacacaaaatgagtcttagaaataatttttaaaattaagaatcttacgtaatgttactttttgaagctagagacttaatttgaaagtgaaagtcattaatcctggcagaaatgtactgtgttaataatgcgtttctttctacaaacaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatatttatgttttagagtcattatcttttagatacagtctgaagtgatatatgtgaaataatatctgtgatttacttcaaaataatccataggagaaaaaagccaaagtgaacagttgttgaagctggtcaatgggcaggtacatgagtgttcattacactatcctctctacttctgaatgtgtttgcaatttccagtagggcgtggtggatcatgcctgtaatcccaacacattaggaggtcaagatgagaggatcacttgagcctagaagttcgagaccagcctgagcaacatagagagatgccatctctacaaaaataactatctcacgcctgtaataccagcactttgggaggccgaggcaggtggatcacgaggtcaggagatcgagaccatcctcgctaacacggtgaaaccccgtctctactaaaaatacaaaaaaagtagccaggcgtagtggtgggcgcctgtagtcccagctacttgggaggctgaagaaggagaatggtgtgaacccgggaggcggaggatgcagtgagccgagatcgcgccactgcactccaacctgggtgacagagcgagagtccgcctcaaaaaaaaaaaaaaaaaaaaaactggccaggcatgggggtacatgcctgtggtcccagctatagggaggctgattgcctgagcccaggaggttgaggctgcagtgagccgtgatcacatcactgcattccagcctgagcaacagagtaagaacctatctcgaaaaagaaaaagaaagaaatttcccacagtaaaaaaaccgtaccactgtccatttatagcatctatttggttaaatacaaggattttgctgtagatctagcaaaagccaataggctcattagttagtgtgtttttcgcacacatttatccttgggtttaaaaggacacacatacatgcacacacacaatcctcctaagtgcgtatacttgctgtaatctaaataaaatacagctctaagaatgcaactatcattttttaaaaatcaactcttccacagtgatgatttaaaatttcattaaaagacataactgtctcaagttacccaaataaaatgaagctacatttttcatatcattttcaattgcccaattagacaaaacactctaaatgtcactagacaagtaaaatggcaaaaaaaaaaaaaaaaaaaaaaattcagctggctacttttcctaatttactcatataaacaatcatttcattgttaataatcagtaaatttgagaaaatttaccaaaagcaaacttatctccagtaaacaggacaaggaagaggcctcataagtttttaacttttaaaaacttgggatgggcgcagtggctcatacctgtaaacccagcacttcgggaggccagggcaggtggatcacctgaggtcaggagttcaaaaccagcatggtcaacatggtgaaaccctatctgtactaaaaatacaaaaattagccgggcatggtggcgcacacctgtaatcccagctactcaggaggctgaagcaggagaatcacctgaacctgggaggcacgggttgcagtgagccaagatcgcgccactacactccagcctgggtgacaagagtgagactctgtctcaaaaataaataaataaaaatcatttaaaaataaaataaaaataaaaactggaaactagtattattcctatttccccacttgttttcaacccaaatcattttatttcatattgacctcagctagctcaacaacacgtaactggttgggccttttttttttttaaggtaactatcaaatcaattttaaatacaagataattttccaaaatgataaccttgtactcgtatattgatttactgaaaccacagcaacctgtcaataacatcaaaggatcttagtttgaagatggtgaaaatagggtaattacaggtttctggatgtgggtcatttgtcacattttaaaataaattttcagagacgtgggcaaaaatagacata

SEQ ID NO: 13541 - DNA, 8681 bp, Human
agccggtacattttggaggaggaggggtttggccagtggtggcaggagggaggttgtggaagccagggttcttgttacatatgtgaagcctgtaatatgcttcagaaagaatagatggcatatgtacctcaaaaggtaaatgaccttaaacggtgtcagactcttagttaaatctctcccggatcagagaaagacctggaaagggaaggagattgtccacagaacacaaatttccctcgcaaaagatagctttgcacaggaccattccaaaatatgtcagaaatatattttggggtaaaatactttgatcgcccttagggctgctacctgtcatgtgatgctataccagaatcaggttggaatttgttttgagacaggttctcactttgttgctcagattggagtacagtggctgtgatcacggctcactgcagcctcgatctcccttgatgtgggaggctcaagtgatcctcccacatcagcctcccaaatagctgggactacaggcggccaccaccacactgggctaaatttttttaaagtagagacaagttctccccatgttgcccaggctggtctctaactcctggcctcaacctccttattctctaggattacaggcgccaggctagacctcacaggtctttagacttctacgcaccaggtacctggtagggggagggattatagtggcagaagagcagtaccagtggcccacaccacacaccctggcctcagctggctggggcacacaaaaccaggtgctaccgtcaacgactaggcccatagggtactgctgtcaaaacctgctgccaacaacttccacacactccccaaaacgctcggtaggcggtggtgcgcagctttcaatgcatccgccgccaggcgctcacaggcaagggagaaagaagccagacggagctcggagatgtggagggcagacgcaggcgcatttggaaaagggactggcggtgggaggcgcagagggaaaaaggaacgacacaatcgggcttcctagccgctggcggacccgatggggcgtcctgcgagggttcggcgagggttctgccaggatagtagcattgcgcccaaggagtgagaggcacccggggctactggagccagaccctcaacccgccctagtgggaggcgaagaacaacgaaagcctcgtattcccatttctctaatggctaatgacattaaaggttttcatatggttatttgccatctgcatatcttcagtgaaatgtctgtttatgtcttctgactattttctaattggatttttaaaaataattgatttttgagttatttacatattctagatactggttgtatgccagatatatggcttgtaaatattttctcctaggtaaaccttttcagtatcgttacagggtctttcacaaagcaaaagttttaaatttatggagtctaattcatcaacatttctttttaccggtcttgccactaatgtcaatttaagaaccttttgcctagccttagacaatagtttgttgttttttaaaaccgttttgtaattttactcgtcacagttatatctagccacttaatttttatgtaagggttatttttggcgggggggaatctatagatgtcctgtcttttcagtatcatttgtggaaaagattatctgtcctgcattaaactgcttttggactttcgtctaaaatcagttggaccggtttttgttggcaaagttttgcctgaagcttattccaacaggtgagaaaaagtccacagtttaacagttcctccccaacctgtaaccccgccttgaacttctggactagcccctcgattgttgtagatgccaagcggacctcgcgccgctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggtaagtctttctttcgcttttttaggggtacttgaaaacaacaagtgtcagacaaagcagcagatgctgttgcgcagtagaagtttatgggcgagttgtccctgaaactggaaccaggtctttcttggcgcgattacgcaagaaccacccgcagccctgcgggctcctggcaggtcctgcaactgcactttggatagtcccgttgggaagctagcactttttaatatagaagaacgaggtttgataagtgtgcgagcttaaaggttgacacagtgtccactattacagctgcgtaggtagctagtgttcaggaagtaatagtggagtcatgtagtgtgaaagtaagattgaaatgggcgaggagggtagcagccgccacagccaccagagagaaacctgaccttgcaggtgcgtggtgatgtccatgagccaggctggtgccgcaacagcagcggcgggaccttgagctccgcacggccgctgggtttggacgccctctggttcctggaaactttcacctccccctcagcctgaggccaggtggcctgggaaggtggaaggagtgtggaggggagtggggggggggggggtccactgcctgagaatgagaattctcttcacatctggaaacttcagttatcacgtgtgtcctttaccaattttttttcttttattttctttttgatagagacggcggtctccctatgttacccaggctagtcttgaactcctgtgcttaagcgatcctcccaccttgacttcccaaagtgctggaattacaggcatgagccaatgcgcccggctgctttaccaattttctatgaatgaatttgtacatacatcccctagagcaggaagtaatgtaaaacagaataattagtaatgcacatttcctaatgtgggatgttggtggccaagagatatttggtctttactggaactcttgatactaacatggagtttataatagttgtggagagtgcagacaaggctaggatttctgtgactagagaactcttagtgcgtgaagacctaaggaaagctggattgttgatttttgttaataaataagatgtgaaagattgcatcactgtagcagaaatctcctagttttttaagctaaattctattaaaggtcatcattgctaaaggaattgtgcccaggatttggatagctgatgtcattatttaatattagatgatatcaactaaccacatctcatagactggaataaagtgctagattttacctgaaagctgcaaaaatgaatggtttagatatatgtatgtatttattttatatcaatttcaaatatttactgtattaacctccctggccccctttaatcaagaatataaaatcatctacttaaattttgccacttaagtttagaacactcttagaatcacactatcttaaagaagccagactagaattagaagcaagttaagtctgaagatataacaaccagcaacaacatttttttttttcaaatgaaaactctaatatggggtgggtatgttgtgtcacacctgtaatcccaacactttgggaggctgatgcaggaggatcacttgaacacaggagttcaagaccagcctggacaacatagcaaaaccctgtccctacaaaaaataagaaaattagctgggcatggtgtcacatgcctgtagtcccagctactcgggaggctgaggtgagaggattgattgatcccaggaggttgaggctgcagtgagtcatgatcgcatgactgcactccaacctgagggacagagcaagaccctgactcaaaaaaaaaaaacaaaaaaaaaaaaaccaccaccaaaactctaatatggacatattactctctcatgggacttgcacattctaaaaagggtccttttccccagtactgggagagtatgtgttcaactacgcagccagcaagacaggctagtttatatagggagtgtgctattcacaaaaagcctctcttctctttctggtattgtacatgacacaatcatagctgtacctgaagagaagtgcattttaaggaccatcatcacctagaaacatgtataaatttctatacctagtgccacaggaatgacattgccttgtactattcctacctctgtccagaggccagctatgtggtctgtctgcatggtgcctagaactttttccatctgacctaggatgcttctgaagcagtccccctgggcagctgtctggtatttaggatatacctgtgagaaaagtttcttacaaacctaatctactatgtttattcctgaactcaaaaagttcattgactgttcaaatcctgaaattttctctatttccataaggctgaattaaaagtactttgttaaaggtagtagccatggcaaaagaaaaaccactgttctgtagaaaaactcattcaatatttacaatcttttctaatcagagattagatcctgaagagaaaggttcatatatatatatatatatatatatatatatatatatatatatatttttttttttttttttttttttttttttactccactgtcattgtgactaaggattcatgaactaagacccctccctcagctcttggtggcacatggtgacagcatgctcagagcaaaggtgctccccatgcctcttctggggctgcactgactgcaggtacctcccctctctacatcccacaccactgataccaaaaaccccctcctttctcctgtactgatgactctgtagctttaaccagggcgacggtgtcactctaaatgtcaccttggcattcagccccatagagtggggaaaattccctcacctgtttctctttgactgttcagtcctcttcaattaaaatcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttcctaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaatcagctgtaagaatttgtctcaccagaaaacaaaacattgcccattgtattaaaatttaaaccatatctgttaaaagtttccaataagaacttcacacatggatgtccttgccatgttgaaattatccaatatgggaggggggtgttttagggaggtctctgcaatacagagctgttttgtgtctttcctgaactgacatcccgaagaactccaggcatctttgaggaagatggtcacagtgttgctgtctcagaggaagcgggtgaaaagcaagcctctgccttctgcctcttcctatattctgaaatactggatataggcaatagggagcagaatgaaagacaaggggaggaatgatatttgagagactcccccataagggagtttttaaagagattatatttgaacataattttttgagcgagggaataaagtatacatatccttgcttttgagagttttttttttttttttaaattgggagaggttcaggggaggctcttaatctagtgatttttttccccacaaaatattattgaacaaatatctattgaacaatgtatgtgtttctagacgagaagcacattgttgagaaggaatcgtaaacatgattttttttttttttttttgagacggagtctctttcgcccaggctggactgcagtggcgctgtctcggctcactacaagctccgcctcccgggttcacgccattctcctgcctcagcctccgagtagctgggactacaggcgcccgccaccactcccggctaattttttctatttttagtagagacgggatttcaccgtgttagccaggatggtctcgatctcctgacctcgtgatccgcctgcctcggcctcccaaagtgctgggattacaggcatgagccactgcgcccggccgtaaacatgatttcatggtactatagacattttcaagcttagaagatctattcagtggctcgtttttaaataattattttaaaatttccctattcattttcatagcaattattctcaaccacttggaaaatacccaaatggttctaccatatagcttcttatgaattctgttcctaaaaaccaattctttgctgaagtacctaatgtagtaaatctacttctaaaagaaactactctaccttggttattctccagggtaattctccttcaaaatgtattgcatttattgttgctcctaataggtgagcaaacggattattaaattcaagtggcaaatactaaccttgagaaaaggaagaacatgtttttaatgttacaagtaatagtttaaaaaagaatttttgttcctggggtaacacctttatataagtaggtagttgagaatgattttattttccattaaaacttgtgctaaatgacaggattttacccctctacttctatctttgcccaaataggaaaaatataatcagaataattacatttttaaagacaatctaattacaacgtttttccctcccaataaccaactaaacacatcaaaggtctcttatgtttcagttcaaatcaaataacatgcattaactttacagttctctgacttctaaatacctttgctcttgctacttctgagccctaaacacttatcaacaggttggatttcagccagggaatcagaatatttttggatcatccaatatcagctcgccacctagacatacttagatatactataatttctttcttcccaggatgcttaagaaacagtttcattttcatgaccagcaaggggttcaggaagcatcctaccacagggtccctggaaatgaaacctgaatcttctcatggctgaggtggtctccatgttaaattcggtcactggcactcccttggcagacatctggtgggcaaacacagctgcggggtacaccacagggggagtatgtgccactagacatagtcacaagggtgagctgtctgtcaacctcctccagaaaggcgggatccaagtttttgccaaaccacagggcgtga

SEQ ID NO: 13542 - DNA, 57280 bp, Human; identical to SEQ ID NO: 11796

SEQ ID NO: 13543 - DNA, 57280 bp, Human; identical to SEQ ID NO: 11796

SEQ ID NO: 13544 - DNA, 57280 bp, Human; identical to SEQ ID NO: 11796

SEQ ID NO: 13545 - DNA, 57280 bp, Human; identical to SEQ ID NO: 11796

SEQ ID NO: 13546 - DNA, 163664 bp, Human
  misc_feature (1)...(163664): n = A,T,C or G
tgagatgtggctgcaggtgacaggaggagagaggttcaatggcttgtttgctgatgaggacgatgacacaactttcacagggttccttctgttcagcagccagtgacagaggagagtttataaatctgccagaccatccatcagaatcagcttgggatgaacttattcagatggttttactttattaattcctccaattattacaataatcataaaaaggtgaaaacggaaaagttattcccaaaactgattctatgtaacttactatttttccaggagtaaatatttaaaatagctgcatggtttattctaatttatttcacatttcttattcctattatctgaagaatcctttgtctgtgcatttcttgtgggaagagtgttttgatatcattttagtgctctgaggagtcatatgaagatgtatccctcatctgtgtttctgaggacattaaggggaaattagagggaaatgtttattccatttagtactagtaacagctttaagctggtgatgctgtcacactccagaaagctgtagacactgctcattttgtctttttttaaaaaatgtatttttaagttctggaatacatatgcagaacgtgcaggtttgttacataaaaatgtgctgtggtggtttgctgcatctgtcaacccatcacctatgcaggtattaagccctgcatgcattagctatttgtcctggtgctttccctcccattttgctcattttctaacctaggttttaatcaccattctatccaacaaatcattgtttgatcattatttgccagacatgaatctctacttgttttctaggatcgccctaataaagtacacaaactgggagtctttaaacaacagaaacggactttctcacagttctgtaggctggaagtttgagatcaccgtagcagcagggccatcctccctccaaaggggatacaggaggatgcagccttgctgcttccagcttctggcagctggtggcagcatcactccagtccccgcctccatcttcaggtggctgtcctcctcctgtatcagccaaattttcctcttcttacaagaacagcttccctaatctagtatgacccatcttaatcataattgcaaactccatattttcaaataaggtcacatgtacaggcaccgagggttaggacttcagcatctattttgggagacacagttcaacccaatctgccctctggttcccaaaattgatttccttctcatgtgcaaaatacattttcgcaccatgtcaacattaccaaaagtcttaacactttccgcatcaactcctctcaccatctacatcatttaaataagctacagaggagacttactgtgtgattcatcgtgtggcaaaatgtctctccatctgtgatcctgtgaagcgagacgagttaatccacttctaaaagaccgggggttggagggggagacaggcatagggtagacaatccattccaaaagagagaaaggggaaggaaaaaagggttcacgggtcccaggcaattctgaaaccctggagggaaaatcccattagacttctttcactatttcccatctaaaatttttaactgagctatgcaagagtaaaaagttaccggacagagacaccaaacagagaagtgcaggataaatttaccaagagagtaggttaaaagggaaacttctccttcaggcctatggtgggcatttcttgtttactcaagtacctgccgtctctcaaagaatatctaatgtccactggaattcgaatatgtcatgattttactcgcgcccacccctagtcaacttgggagggaagcgcaaccctagccttttcttactctggacacagggggcggtaaaccgggagggcggccgagaaggcgagggggagcgacgctcttgctctctggacgacaacgtgcccacgtcctgaggccgcgcccagacccggaagcggggccgtcacgtggggcggcgtgggctgctgccttggaaacgcggagcgcgcgctcccagcgaaagcagcagggcagggatctgcgttggaggaagggactgctctggtgctagaatgctgtgcgtcggaaggctgggcggcttgggagccagagcagcagctctgccgccccgccgggcgggccggggaagcctcgaagccgggatccgggcccgaagggtcagcaccagctggtctcccgtgggcgccgccttcaatgtcaagccccagggcagccgcttggacctgttcggcgagcgccgggtgagcggcgcaggaggagctcccctcagtccccgagctaagccgacccctgctccgcgcggccagcaacaatcagggcgagattgtttgggcctgggaggaggcgagcagcgaacccaccttttacagtggcgtcttgtgtgcgctctcgatgagggcaaggtcacctctgctttgaggggccgggtttagtggtctcctacccagagtgtcgggtccgggaactgcttctgcatgagccccttgctccacgtgaatctgaatagttcgttctggcagtggcggtgaattcgtcctgccaggacccgccctctgcatacactcaggcgcacccctgctaaagccctttagctccagcgctacagtcctgccttaagaggcctatccctgtgcgttcacaggcggcatcacatggtctttttgcaaggacacggctgcctgcagtcgagtaatggtaatttcattaatacctgaaattccatcatctattaattaatttatttcaaagctttgggctttcttgttttaaaacacaaaactctgttgagacgagtctcacttcccatagtgccatggaattggtcactttgatttcttaccccaggaagtcactagcctgcgttgtctagtgaaaggtgagaggaaggcaaggttggaaaggacttacctgatgcctgttctacttggagtttgtacattttgtccgttttaggttaaggattacttttatttttgccttttaaaatttcgttatactgtattgccttataaagacaagtctagggtattgttgcactgagctaaagtgtgtgattcttgttttatctccattatcagttttgtctatttaaaaattattttgtgtgaaatttgctacaccaccttccttaagggtatgtagtgttggtattaacatagttggtgtgaagagacctacttgtaggcgctgagcagaaagacgtgaggggaagcctgattttgggtggatgagatataactaattttagcttttatttttccctttttgtatcatgatattcggcactgatagcagattttcaaattttagaattgatttttgccttgaaaaaaaaaaagccttattcagttttttagcattatggtcactggtaatccgatagttagaattcccgagagcaatatgggcaggttgtactgggaagtggaagtagtctgtgcttgaatcaaattaaatcagtataaagatgacatttgtttttggtcctgattttcctttgtctcccactgactttcttttattttattttttatcttgtaatatattttgaagagagattactagcttaacttcatccatcccttcttgtagaaacagtagggcttgtcaggcctgaaggtttacctgttcgtatttctgaaaatctatgcgttaagcacctacaaagtgaattaacaaagcctagcatctgctccggtcacttgtttctttcattgagttcccccatgtgttagacattctattggatagctggttaaagaaatgaagggcagggctcttgggtctggaagctcaccttttcaggagagaagactttcaaacagataaattgtaatagagaagtatggaaaagtgtgggctttacagatgtacagagcgggttcgagttctgtctttcccaatattaatttgtgacctcaaacaagttttttctaacgtcttaaagcatgtgtcctgatctgtaaaagaatgatactctgttctgtaggattgtgtgatttaaatgagaacctatgtaaagtagcaggcacacttcatggtatgcagtaggtgcatattaaatgctttttccccctgccttcctgagtgtgctaacaagtgtgattgaataggtaacaagagaatggtcattaccattagatcagtgatttttgtttttatcaagatattgaaatgtctttgtaacgtataaaatttgctcccagtttcagcctatgattttaatatgttcattacatttttctaaaatatctattgcttcatagtcaactcatcctccctatttgatagttatagaataattggtactatgtactgagatctcaccttgtcagctgctgctgttagtactttacatatacttattacctgtatccatgctgtaaggtatgtatcgtcattcccattgtacatgatgaaaaaaatatttctcctaggaggagaaataacatgaccagggttataagctaataataattatggctaacatctataaatgctctgtgccaaacactgctttatgtatatatatatatatatttacatatatgatctcatttaatctttgcggccactcttaggttctgtagaagtgacagctggattttgaacccataccattgttgttgttgttttttccggaaaataattaaaaattgaagaaaaattatgttctgaaaacatttttagtgtaatttatgtggagtgatatggggagtatgatagtggtatctgtgatcacaggtataacatgatacaccaatgaaagtcaagatctcctttgtgataaaagtaattttagtaaatataaaaaaagcacaattttgaattttggttataaatcagacgtattctttggttctaagggtctttttggagttcctgagctgagtgccccagaaggatttcatattgcacaagaaaaagccttgagaaagacagaattgcttgtggaccgtgcatgttccaccccacctgggccccagaccgtgctgatcttcgatgagctctcggattccttatgcagagtggccgacttggtaaggtgctttacctcagacttgaagctacctctctttcaacttgttaaaatttaagtgaaatttatcctttgttgtttactattaatattagattataaagttaaaaatgtctgaaactgagatccattgggtataattttttatgatgaaatatgtcattaggaatgggaaaatattataggaaaaggtgatatttagaacttgtactttaatacgtatgtttaataaaatatacatgtaatatataatgaatgaatactaatatagcaaatatttgctatatttgggtaatatatatttacatatatattcatttgacagagattcttcatttatgaaagtgtctcccaaaattctaagaacactttatgtgtacatttacaacaaaattcccctttttcttttttttttttttttaatagagacagggtctccctgtgttgcccgggctgatcttgaactcctagccccaagtgaacctcctgcctcggcctcccaaagtgctgggattataagtgtgagccacttctttttcataagaggtgtgaaaaccagttttaataaaccttttcaggaatgcttttttttttttaattaaaaaccaagttttgacatcaaaatgattgtaaagactttttttttttaacattttaaatttgaaatagaagtgtatacctagatctcttcagcaactaggaaatccattgctgagatagcaaaattttcttttttttttatttttaatttttgtgggtacatgtatatattcatgaggtacatgagatgttttgatagaggcatgcaatgcatagtaattacatcagggaaaatggggtatccatcccctcaagcatttatcctttctgttacaaacaatccaattatactcttctggttattttaaaatctacaattaaattattattgactgtagtcaccctgttgtgctatcgaatagtaggtcttactcaatcttcctgtttttttgtagccattaaccatccccacctcccccatgccaccctgctaccctacctagcctctggtaaccatccttctactctttatttccatgattcagttgtatctatttttaggtcccacaagtgagtgagaacatgtgatgtttgtctttctgtgcctgacttatttcactaaacataatgaccatccatgttgttgaaaatgacataatctcattcttttttatggctgaatagcattccattgtgtgtaagtaccatactttctttatccattcatctgttcatggacagttgggttgctttctcatcttggatgttgtgaacagagctgcagcaaacatggaagtgcagatatctcttcgatatactcatttccaggaagcagggtttcctatcagcttgaaggagctgactcttggttactcttgtcaaggaaagcagcacacacaatttaaatagtgatcatttatgatcctgtctacatggtatagaactgcataggtttttccctcacattcagtcaatgttgagcacgtactgtgtgccagacactgtctaggcatgagggatacatgcaggaatgaaacagacacaatctgttacttcatggagtttatattctggcattaacttgtttttggaaatttaactagactgtaggccctttctacagcctagttagctgaagaagctttccctggatgagctgaggtaaccttctcagcatatctccattttcacaagagggaagaaaggcactgggtgatgaagggatgtgcccgctgtcagctggccagcgtgtggtgcagctgggctgccagcccaggcagggtatctgtcgagctcttcttctttctcctgttccaaccatttcagggctggctggctgctcaggtctcatgaatccttacctggaaaggttgcaaagtttgttagcctctccatctttaaaaaaaatgtatacttgtttttaaaattattatacagtaaaattgacttcttttggaggatggtacagttctatgaattttaactcgtataaatttgtgcagccctcaccacaatcaggatacaaagctgttccatccacccccaaaaatctccctgtatagccacacccccccccgactaacctctggcaaccactaatctgttctctctccctatagctttgccttttctagaatgtcacataggtggaatcctgtatacctttgactgacttctttcacccagcataactcatccccatctttattttttttccttttttggaaaatttccttccacccatacaactgatttgagcattaacacctttcagatgattatatgttcaccacaagcctcccgctcttaagaaaactgataaagtatcttactgtaaagggtttttccctggagtgaagttgcaggctctgagtagttctgttgtactgggtttttgttctgtgcctccagtatgtgcataggaaatgtgtctttgaatgatggggaagctgtggaaacgcactaccaaaaggaggtttcataccctgttcacctaattgtgtcacagaaatcagaaaaggaaaatctgtgtcagtgaatttcactgtatcgtcaaccctccagattgggggatctgtggagtcaaccaaccttggatcaaaaatatttggaaaaaaaatttgcattcatactgaacatgtacagactttcttttcttgtcactgttccataaaacaatacagtgtatcagctatttacatattgtttacattcattaggtattacaagtaatctagatatgatttgatgtatggggtgtgctgtgtgtcggttatatgcaagtactacaccattttatatcagagacttgagcatctgtggattcgggtatctgtgggaggatcaaaccattgtccattgatactgaggggtgacttggcgtggctgtcacaaatcccagaattcactgtgtatttgttgtcttagtcttcatcttaatcagtattctaggatttttttctacatttttgcttttgatcttcactaaaagattttaacttctctgcgctatatcttattttgacatttttagtatttatcatgtataataatatctcattttgaaaacttaaaaaaaaaagatgtgatttgtatatgtagttctctgggtataaaagaacctttctctgttctgaatttttaagatattacctgccagtaagattatctgaatttttaatatcttaaaaatatctgaatttttaagatattacctgccagtgagattagtactgttataaggcaatcgttttataaactgtttttcaccaaatagtcattttattttgttttcttttttaatacagtttttatgtaacaactgttttcctcatcactattacaaatcagtttttaatatgtatgctagtgttttgaattttaatattgattataaattcacaacccgtagattagtaatttgtaaaaaaaaaatgttgtaaatttacataactcatttttcaggtactttggtactaatgttattttatcgttaccaattgttacaacaaatataccaaactatggatttaaatgttttggcattaaaaactatttgataataaaattaagaaattttatcttgtggtgattttatttcatgttatagtcacattttcttggcaaataaaatatgtagtgttttgtagtttctctgctttttgttacagttgacatgaaaacaaaaatttagttttacatcattttatctttttaaaaaagaactgtcactcattttaatgtctaatgacttaagtagcagcagcagtagtagctgtatacagtattacatggagactacgaactcatattttattgaaaggactatgaagagaccgtgcctttgttttctgcacaaagactaccatgtagttaaatcaaagactagaatgtagttaaatgggttttgaaactatactatgtgtcagttaaaaaaaaaagcctttaagagttgttttctggagataagttaacatgtgaaaaccatactgcaaagaattttagccagaaagttgtagaatatttgaaaccagtgtctgctcttttgaaataaagaattagagggcgtggtggtgggcacctgtagtcacagctacgtgggaggctgagacaggagaatggcgtgaacccgagaggcggagcttgcagtgacctgagattgcgccaatgcactccagcctgggcgacggagcaagactccgtctcaaaaaaaaaaaaaaaagaaagaaagaatttgcttggtgtttatatttgaaagagaaaaacttttctgaaataataaaagtctttttttggagtgaaacaaacttggtttcaaggaataacagaattaaatgttcagaaagaagctgctttgctttactcgcttaggaaaaagtcagtaatggaaatgcatagggcaagccaatggcacatcttaaaacccagttttcattttcaccctcagatcctggaagaaagcttctcatcaaattcccttttggttttgtctttcccctttattaggctgattttgtgaaaatcgctcaccctgagccagcattcagagaagctgcggaagaagcttgtagaagtattggcaccatggtagagaagtatgtgctgttcccctccccacctccatgccaagtcctgggtgatccggtttcatggacttgtgccgtaggcagttttgtccatagtgcttgtcccccgcccagcagggtgggaggtgtgtgtgaccaggggtggccggagggaggtctcaggacaggccattggctcaccttgcaggcaggcactgggcctcagggctggttgtctgttctctcagtcatttccttctctgtaaatggggtcataaagttaaccctgcctcagggtccttgtgagtgttaaatgagatcaatgtaaaggtgtcacttgataatctgagatgacagacacccaggattcttgtcatcaccattatcacttaccttaaataagggctttttagtgtcctagtggcaagttggacttactagattatcgcttgattaaattgctgttgcatcaatggctgtgggccacggggcgagaagccaaaatgctctataaacagtgtccttgtggtccctgttgagttggaattaggggagtctagggaggctgtaaaagtctgtgggagggctggagcatgctctggctgaggctgtgatagagtgaattattttaaagtgattttggggtaaatgtgagtatttttaagccacttataagagctccataatgcttgttaaaataactgaatggtggacagcgctgtattccaacacacttagctgcatggcaccatgccaggcagtgtatagagctagggagagccctgggctcgccagcgtggatttacaacagggaaaagggggtaacacgataagacaatttcatatgccagaaattgttggaggaggagagtgatggcttctctggttagacgaggcttccttggaagacccaacgcttcaggatgtgcagctgctgcttttccccaggtcgccaacatttgttcactttggcacaatcgtgtgtgactttccccatagccgctgaaaaccaacttgcgtaatgggacagaacggggccctgcagagtgcagatactgggcatgctgacagggctgaaagtggggactcccctgggagaaagctttgcctctcggggaaaggcccctgggaaggagtcagcagtgggctgcctgctcgaggctctctgcatgctgtgtcctgccgaattagacgtgggctggtctcatggacaagcactcttcattttgtcggaggacaaatacagactgaagtatgggctttatctcagggtcttccaacataaaacatactactgggagatttccttaaacctctgcagtgggggcagtgcgggcagcctctgagctactgttcctttgccatggagtggctccgtgggtgagcaggttgggaggaggtaggcctccacactcactctctccctgacttctgggatccgtgtgtgggagtctggcccttcttggtgagtgtttttttgatgggtaatgactatctacgtttcactagtatttgggaaggcccatgagaatggtagcagaaacccttcgattcatataaatcttaagtgtttttttgtgaaccaactgaggaacaggagtatccttgagtctctgagtagcgactggtgagtggttcttacaaccttatccctccttgaagacctacccagcagggtgcagattgtatctagacccagctcactatttagttttgagggggccatggcatttgcatttagggaagaggactgggttcctgctagtggtactatggggtgggttgggaccactgcccagcattgggccctttgctctctggatggcacaactgctcaacagtggccatggttcattcacataggaaatgtgtgctgcacacatgatctcatttaatcctcacggcagcctaaagtctaaataacgtgtccaaggtcccacagcagtaacaaggccagtcttgcatcccagttgggtggctctgaagcctgtgtcctgagctctcccttacagtgtttttaaatttaaaaattagctgggcgtggtggtgtatgcctgtagtcccaactgcttgggaggctgaggtggaaggatcacttgagcccagaagattgaggctgcagtgagctgtgattgtgccactgcattccagcctgggtgctgggtgacagagtgagaccctgtctccaaaataagggaaagaaagaaagaagggaaggaaagaaggaaggaaggatggttacactgttcctggtaggttatgctgttcagcttctgggcatgtgtgtggtacaagctgacaccattcttttcatgtaaagttaaaaataaggtattagaaaatcatctaattttttaaatttctattttttctaggttgaacacaaatgtggatttatatcaaagtttgcaaaaattactagctgataaaaaacttgtggattcccttgatccagaaacaaggtactcactcatttctttgccttgattgtgactgtgactctagaggtgaggttgggagactctccctcagggcctctgtacttgcagcctctgttgtctggaatgttcctccccaggtatctctatgactcctgcactttctctaggactccactcaaatggtgtctcctccaaaatctttgcacagggtcagactctaccctctgatcctgatttatttttcttcatagccctcgttccttccaacgtatcctgtttgtttatttgtctatcatctatctcaccagactgcaagctccttgagggtagggcttggtctgttttgttcccagctgcatcctcagtacctacacattcatggcatgtggtcagtgctcaactaatgagtggactcctgtagacagttaataattacacttagctttatgctcaaagttccataattgatactatcagaaaatgtaagcaaatcgattttatctactgggaggatgtcaagatccttgtaatgatttgctttggttcattaggctacatttataaatctgcatcaaaaaggccttacttttaaatcaacatgttagaatatttgatataggaacctagatatcttatttctttgctcaaatgcaattgtgagtggagtagggtttgtccttaacctgcttataatatgtatgtcataacacagattaattttttttctcatttgtttgttcctgtttatctacgttttgttggtgggacacttcctctgacaacttgattctttctgatcctgtttccttctattttgtctccatatgtggcttattgaccccaaatgaagccattttctatagggaccaattgatcatccagtttgctgttaatctaatacatgagcagcatggtatgtgagtaactcagtctttgaggggttattttcatctgcctggcaggtatgcaggtacctagtggtgtttcactttatcagtcctgatgctcaggacactagtgaagctagctgtgtcatcacagtagtttaagctttatcgttatattgctttcattagcaaagcaaggaaaagtcgaatgcctattaattgtgccagatttatacggaactggtactgactttacataacaacaaacaatgttaaaaatagaaggttattcataatctctatttactgaagatcgacatgcccctgtttgtgtataaagaattgtagtgggctagcagaccattttagatagaaaggacttgtagtgataggatacataccacatttctagatattattaaaaatgccaatagggctttttaaataataaaatgataaatatattggggaaaataaactgggtagaatatcaacagtctagaaaagaaaagcaacttggaagtaggagagaagaagaatttgaagtaataattattgcagtatcgtggcacttagatatcattgagtgttggctagcacccagaaagaactatattttagaaccatgcatatggcaaaatataagacagtggctaaaacaaagaattaaagatttaataaagtcttgtaagttaatgtacagagggaatgatttaaattgagtaactcatcatgttattcttagattcagtccttgaaatactagtctctgagatgttcagaacttttctcagaatggttccttcagtcagtaagtttggaaatctgatgtatcaatgtatttccctgcttgaagaattttagtagtttagagtctctgagaagccaggccataaagaaacctgtttaacttggggtttttccaaagccattaagagctttcatgtatgcaaagactataataagcacattctccagaaaatataatggagggaaaattctagttgcaagaacagccaaagctgtaacacacgttggaatgaacttgggaaggtagagtgcagaaccgcaacatacacaacacctaggaagcatgcaagcgaccgaaatggagaaacatgctgtattcttaaggaagaagaaagctcagtaatgtttattactataagtttaatgctatccaatttataaagaatttttttattgttacttaaaatgattttgaagtcatagagaataaatatgccagaataggcaggaaaactctcgtaaggaaaagtactaaaaagggacttataccagatagtagaacatataaaaatgctgtatttaaagagcgttatacttaaaaatgccagaatagtcaattagatcaatggaagaatagagaaattttagacacagacacagatacataaacagtaagactatttggtatgtgataaaagtgtcatttcacatcagtagggaaagacttggttttcaggaaatgatgttagaccaatggataaccatttggggtaaaaaagtagattgattaaagatttaaatatttttaaaagaaattataaaactagtggtaatcttgggatatggaaggtctttcttggcatgatacaaactcatacaacagaaagattcattgatttttattatataaacattgcaaactttggtaaggcaaaacgcttccacattcaaagtcaaacacacaaatgttgacaaatggttctgatatgacaaagagttaatatattatctatgttaagagacctttcaaattactttaaaaaaagaacaaaaaccccccttatagaaaaatgggcaaaagattctgtttgtgaaactctcatttcacaaaataaggcatagcaacagatggcccttaaattgatagcagtgtgccacagctgtaacagtggcaccaagtgtgaagtgggtggaactgcatctctagaatggaactgcggggttggactttggcttcagggctcactaaaccctagttttctcctttgtaaaacggaaataaaaagtacttcataagaatcatatgagatgtaagggaaataatttgtgtaaagtgctctgctctgtacctggcatgagacccaccaccattaaggaaagatagaatgaagcaaaactttttgtcagccagcagctgacaaagttgaaacagaataagaatagtagttctggtttgggatgatggatcctctctagttacgggtaaattgataagacttcatggaggagcatttggtaatatatatcaatgtgcatactttgtgattaatttcttggaatttatcctaaggaaacaaacaaggattaaaaactgtaacaaggatttttattatattgtggttcatgggagtgggagagtaaaaacatttgcagtctatataacaacacaaaacaagcatcaaaagccaactttttgaagaacgtttaaagacatggagaactgttcaatgtttgtgatataattttacaagaaagagcaagatacaaaagtatatacagttgggccttaattattctaaatatataatataacattaaaagtagattgaaaggaaatacaagaattttaatagtcattatctttgataggattagtgattttaaatgtttcatatgtttctgcattagttttgttacataatagacctatattgtgtaatacgataaacgtacactataaatttccattcaaggtatatttgatgtaataatcaggaaggtaaatatatctattttgaaaactcaaggaaagccaaaagagtagatcaaatatttgattatttccattcaatgttgttggttttttttaaaaaaaataccattgacaaaaaaaaaaaggtgttacacttgaaattggttccaagcatgaagcaggagtaaaaagaaagaaaacaattctcattagccaagaaactcagcttccagcacagcatcaaagaatttaatattctaaatagctgctactggctagaagaaaaactaaaaatctcatgcagagggcctttgaaaaattgtccaaatataaaactgttttatgtttttaattattgggatttggattgagttgaaataaataattatttattacaaacctgtggtactaaattatttattacaaacctgtgtactaaataaaattattattattatttagtacaaacctgtggctttcacaggtttgtactctctgaataaaggaataagctcttacatgacaagccaatcataattgtcagtcagataggtgttttgcctgatgtttgccttaatatctgaggatattaagctccttgtttaaaacaaagtgtgtgtgtgtgtgtgtgtgtgtgtgtgtgttttgaagaaacttttggcagtgaggctgaaaaagacttatttatttaacaaaaaaccacaatttttttgttagcaatttttattacctgttataacctggggctcatttcatttataggcgagtggctgaactgtttatgtttgattttgaaattagtggaatccatctagacaaagaaaaggtacatctttctgctgtttttttgactcttccagttttactaacatttagttgataccattattgctacagtccttgtatatattgcttgaatttgcatattgcaaaaacgtgcaggtcttttatctgttatgaaattcttctttagattgtatttgaatatagtcccctctctggaagttgacctatcacaccatgataattcagaattaagacaggcttgagccaagtggagtgttttagataatcatggaattaggatgagataggcaatatcaggaaagactggcaagtgaatgggaaagctgatgtcattgaagattggtagtacagggaatatcacataagaccttacataagtgtatttatttatattatacgtgtgtttgactgatggaacaagcatagattacacagtgtttacactgggatggaggccttctacctagtccatccccttcattttacagatgtggaaacaagacaaagtgatttgttcaagttgccatcctaactaacaaatggccagtgttcttaaaatttctaacactggccactgttctttctagcacataacatcctgagaaaccaagtgcctcatttcagttgtaaattcagagttggaagaacaggagggacttgacaccattggaagttcagcctgccccacagtctcccccactcacctgcagtctagactattatggctttttgtttatttgttttaaacagtaatacatttttcctagtaaatatggtagaattaaaccacttacctatgaagagattaagttatcaaaatatctggaaaagcagaaggcagggccttggaaatatgtatcacatacaatagatgttaccattttgataggtgctgagtttgagtaatgctgtaacccctcacacatctgatgtgtttgtgtggcattaaaggttcagcatgtgattcctggtctgaccctgagccaggacgtgccttcccagcagcccatgaggcttatgggctctactgtaaactcacattgcctaaggtgaccacgtttgccgctttccacatcaattcttcattaatacttctctgtaaaataaaatttgggagttagttgtattctttcccttcctaatattgtcatatcttctaaccaagtccttgcattgttcctacagtcctgcatctgtctgcatcccaaaagcaaatcaccttgattcttatcaccaaacacccgggctgttctaaaggcctctgtcttcctaacagtgatttaacatcaactgagtatttgctactttaaatcatatatttctcatcaaatcctcacaaaaattttgagcttggtgctactattattcctggctttttttagaccaaggctgtagaggttgtgggacgttattttgtaagccagacagactccagagcctccatggccagcatgtcaccatcctgctggtcagtcttccccgtctgtgaacactggattagttttcataaagtattgatttgttactttcctgcccagaatcctcctgtggacttcccattgtctagtgaagttaacatgtaacaaagagctcacactcgtggctgtgctccggctgtcagcccctcatacacagtgtcctcccccatgtgtttgctgtcctcctcctaggcctgctcaccaggtttccctggctgaagtccccatgaaggcttcatcctcacgccacattgcgaagcttttatcagtcccccaggtggaattttgtattcatccgaacgtattttacttatttcagtcatgtggcattcttctttaccttttgttgatgatgatgctgttattgttgtgttgcttatctaacttctaggcttacaaaggatcaagaacgtggatcatgttttttaatgcatattagttttggactcagtaaaagtattgagtgaatgtatgacaaatcatgataatgctagctatcatcaagtttgatatcttcagaaggaaggttgctagtagagaatccatgtgaatagttttaatgtatcctcatgaagggtgcttttgaaattttgctgacaaatagtatatgttcagtttcaccagcatagacattgccgcttttatctaacatatgattacagtgtagctcctctttccccgggagcagctcccagggaacccctcaatattgaatatgcaactaaagtaaacctgctcagtttttcccttgtaacttccatgtttgttctcagaggtgctccactaggacaggatataaagtagacatgttccatttttcaaaagagagaccatgaaataaacccaccaacaaaatctataaatcatcaaagcctatgttctttccagttggtttcttatttatttattattattattattttttgagacagagtttcactcttgtttcccaggctggagtgcaattgggcaatcttggctcaccgcaacctccgcctcccgggttcaagcgattcttctgcctcagcctcctgagtagctgggattacaggcatgtgccaccacgcccagctaattttgtatttttggtagagacggggtttctccatgttggtcaggctggtctcgaactcccgacctcaggtgatccacctgcctcagcctcccaaagttctgggattataggcgtgagccactgcacccggccttaatttttaaggtctcatacaaatataacttataagtttaaatgtaatagaaatgtttatttttaacattatttaataacacagaaatttcatagaatttttcaagagttcagattattgtacatttcattgttaccacagaatgatgaagtgatatgcctggcagatcattgaagttggcatgaactcagttttgatttttccagaggttttatcagtagataaaatcttcaaagtagttaattttatcacattttttttttcaaagtaaaagttttgaagacaattttggaactgtaatgtgatttcaaaatcttgttcatcttttttgttattccacttgttaccattaggtggtgataaatggccatatcaaacaaaataagcaaagagaaatctggactgtaaggaaatgggagtctcctaaaacttttttccatgaaatttgaattttctatattgaaattctggggatattgatatatactcaattttttcagcatcttatcaagcatgcctctacatcatctatgtttatctttaaaaagtatattagtattgtggcttaatcattttttaggagcatagaacagtttagaacttgttaattgctatctcctctcccagaaagatttgtgtacactttcacctgaagcccaacatgagcccagtgcggagcctgtctagttttttggtaaccagtaactgaaaattcatatgcagagcctgtctagtttttgagtaaccaataactgaaaattcatctgcagagcctgtctagtttttgagtagccaataactgaaaattcagcccttctcctccagtcagcctaattatgtggtttctagtttatatttaatcttagagcatttatggcaacccctttgctaatacacgttttctcaggttattgtgtattacaaagatatgactgcaagattaaacctaagcagatgtgtccgcaccatccacgtcctcatcactgaccatttgaaggcctggcaggagcaaggaccatgtgccacatggcagggacacagagtagaagaaaggaccatgccctggggttccagtctgcttcttagacttcactgtatcattctgtagcagctcaagcacatgcaaaatcagaactttattcccccctgagacagggtctcgctttgttgcccaggttgcagtggtgtgatcgtagctcactgaagccttacctcctgggctcaagtgatcctgctgcctcagccccacatagggctgggactgcaggcgtgtgctaccacacccaaaatcagaacttttaaaatgtgcttcccccttctggaggctcactacacttttgcaaataactgtttttttgttttttgtttttttttgagacagagtctccctctgtctcacaggctggagtacagtggtgcgatctcggctcattgcaacctccgcctcctgggttcgagcgattctcgtgcctcagcctcttgagtagctgagattataggcacgtgccaccacgcccagctaatttttgtatttttagtagagatgggatttcaccatgttggccagactggtctccaacccctgacctcaagtgatctgccctccttggcctcccaaagtgctgggattacaggcgtgagtcactgcacctggcatgtgtttttcaatgttgttaatttcaacaattagttatataacctagacataaaatagaactagaagttatgtaaatcttaaaacatagaaacatcagaaaaccataagtatgatctttttgttagaatattaaatatctgttaaaagtaaaattaatatattatttataatatagtaacaatatattcattttactaaactaatattttattaagtgataattcaacaatatatatgttgatttgacatatttatattttgtttattaaattgtgaaatattaattcaaaacgcctttaaataacttttactcctcctgcatacagcgtaaaagagcagtggacctcaatgttaaaatcttggatttgagtagtacatttcttatgggaaccaattttcccaacaagattgagaagcatctcttaccagaacacattcgtcgtaactttacatctgctggggatcatatcataattgatggtctccacgcagaatcaccagatgacttggtatgtatgtttcattctctttgttgtttaggtcccatttgtgtgttgctactgttttaacccaaaattcagtgataatataatagtatccttaaaaactttttagcattactaagccctaaaaatttaacttgtggaattattaatgccataaacactttaaagaatgaaaatgatttaattacttatatttcatacaagactccttatttttaaagtatgattaataacaccattaactgacattctagactacagagacttttaaattcatgcagccttacttctcctggttaagacgctttatagcatagagatccacgcactgggtagaggtttgccccaccgtacctcagaacagtaccctagagctgcagtcaagtatgctgttgcatcccatgctattttatgactctggaagctttatggcctcgtgtagaccattgctttattttgaaagcagtgatcatctgcagatcaagtggtgagcatgagcctgtgttattgttgcataggactgtgtgatgatatttatagccttcaccatttactttttaaacgtaggtgcgagaagctgcttataaaatttttctttatcccaatgctggtcaattgaaatgtttagaagaattgctcagcagcagagatcttctggcaaagttggtggggtattccacgttttctcacagggctctccaaggaacgatagctaaaaatccaggtaagcctgtttatccaacatttaagggcaaaataggatttttatgaaactgagcttttgattttaaatagctgtaaattagtgttctatttttaatacatgtagagaaccatttattgagattttctatgtatttttataggaaccatttttaaatagagctaataatttggcataattctgtccaaccaaagaattttattttatgtgaatgttgagagtaaaatcataacctaaattttcattttgatgttagtctaaattgttttcattttaacccagtttctgtgctgaatttgacaaattggttagaattagtgtaagagaatgaaagatcagtatgtttactgaggtcaaggttaaatgtaggttaggtcatataaaaaacacacagtcagataagcctccttttcagagagaagagtactgcttaggaaggtttgtgctaggtgaggtgttacggaagtgtgtcgttgggtttgtcataaacttgccttgtgctatgttgagttccttatgattcataatgtctaagagaaaatgttacacaataataatataaatgtacataatacgttttttcagaagcatttattaacttacagttgtaatttaggtggtgagtcaggagtagggtggccgtgatgatggagctgcgtgagactcaaggtcttggcagtgaagttgcaagacttagtgagggtgagagggaggaggaggcattgtggtgggccccctgggtttctggttgtacatctggttagacattccactcaccgacagaggggacactgggggcagatcacaacctgaatcctcgcttgtctttattccttctgtgcttatcccttctcaccctagcatgttcctctcttctccaaagttctctaaatgcactcaatcttacttcttactctttcgtaaacaactgtttcccttgacctgtcagggctctcggttaagctacaggcgtgtcacgctcattgcggcctgggttcccttgctcgtgtcactctcctatggagagcagcttttcttcctggtctgcctgttaaaatcttaccccgtttttttagtgctcagctcaaaacccacctctttcatgaagctggttaaactttttcactttccttggactcctttgtccccgaacccttaaaacacttacaatttttttcatataatcgaagctcctaaacagatataatatgtatgttatgtattaaatgtgtgtttttagtgtatgttttttctttttttgtaagtatcagtttggtgaaaagtatgtttttctgtagtcgctgttgtcaacagtttgattataatagtaccatatttttattttatatttatataaaataataatattagaatatcattcagtgcttatcctgttgttatctcatttccttcctctgcagctttgtgaggtaggtatttgtattcatgtcacagataaggaatctaaggttaggttatattgctaaaatgtggcagaactgaagcctaaacacatatgctacatttatggttttccacaggctgcttgagacctaatgccctatgttttatatcatctacatcccccttttgtttattaattcagcaaatatttactgattgcccactgtatgtcagatattattctcggtcagggaaataagtcagtgtacaaagcagaagaaaattcctatccttatgcagtttacattcttgggagcaagggaagaacagtaaagaacgaaataagtagataaagtatgtggtatgttattagttaatacaagccatggagaaaactgaacagggaaggggataaggtatgtgggcatgtaggctggtgttggagttttagagagcattgtcggaaggctcacttagaatgtggaatgtgagcgtgctcttgacagacacaagcatgaggctgtggctcttgaggggagaaaggtttcacgcagagtcactatcaagtgctaaggtcttgaggcagaaaaatgcctgccacgtttgaggagggcagagtggctgaagcgcagcgtgtgcaaggagagtggcgagaggtgggaacagactgacaaggggcggcattaagtagagacttgatgcaagtgcagcaggtcactgtgggggttggggcagaggagtgagatgatctgactccagtgctaatggtgagtcagtgctgctgttcctgagagaagactgcagcagggccagggtagaagagggcctgtttagatgctgttttgcagtaaccatgatgagaagtgttggcatcttgaccaggtggtagcagggaaggtggtaagatgtgatcagattctgggtacagagtatttggaagagggagccaacattttcgacctaagcaactagaaagagagtgagttactactgttaactaagattgggaggaccggaaacttggtttgtttcaagttaagtttgagataccaaatgaggttcaagtggtgaagttgggtaggcagttagatggagtgtggagttctgagcttcatatgtaagtctgaacctctaaaatgagattctgataccactaagagagtgaacttaaagaacaagtccaaggactgcgctctggggccttcaagtttaagaggccaggcatgtgaggaactgctagttaacgctgccagatgtaacggccactaagggaggtggaaagtgattacagggtgtggtcctggaggccgcgcagaaggtctgtctacaggagaggggagagatcagctgactcatgctgtggccaggtcagatgtgaggagggctgggcatgaccactggctgtagcagcgtggagctcactggacctgcagcacccagctccagattccgtgactggcaggtcacccttgtgcactaagtgcttggtgtgctgatgtattggcagggggctgttgtgcacatcatcacataagatgtgctctgggtccttgaggatttaaagcttagttgaggagctggatatatgcatataaaaagataaataataatagaggttggcacgttttcggtgtcgatggagtagtacagacaaaacaatgccatgggatttaggagctcggggcatttgtcagatgcatctgtggctgtggaaggcgccctgagggaaatgaaactgtcatgcacagtgatggagtgagtcctcagcagagcagaaggaagacagagaggctgactgaggctaaggcgggcattcatgtggctagtgaatgaggaggtaactgcggtgaggcacttagtggggggtttcaaactgaatcttaatatgacaattctctgggggcactaattgaggcaggccagatgtggtgtctcatgcctgtaatctcagcactttgggaggctgaggcaggcagatcacttgaggtcaggagttcaagaccagcctggccaacatggtgaaaccccatctctactaaaaatacaaaaattaattgggtgcagtggcgggtgcctgtaatcccagctactcaggaagctgagacaggagaatcgattgaaccctgggaggcagaggttgcagtgagccgagatgggacttctgcactccagcctgggcgacagagcaagactccgtctcaaaaaaaaaaaaaagattaattgaggcagattcttcacatgtaaaatgactggaagaataagatgggtgaatgttaaaacacggttattaagaaataaaacgtgtacaagcatacatagggattcatttgaaaacagtttggtatggtacctggaatataatcctaaaatgagatttcattgttgactaaataatgtatttgttccccaaaaattcctattgttgtttcatatggcacatgagccagtgttttcagaattcgtatacacaggacttgttaagtattgacagtggcaagaaacctcatggtttgggtttaggttaaccaccattatttatttccttagtcttttatttcactcaaaaggagataacttaaattgaagagagggcaggaaacttaaaactgtataaaagattatctggaaaatacaaacatagtgtttgtggtgaactaaaatacatatgaaagctctgtacacataagtcagtgataaaaagtgctacattcagaaatacttgcaaaacatttcctcttgtgggaaacggtgataattctactgcactgcctttatgggtttgtaaattatgacaactatggcagaagtattttaataaaaatactttaaaaattctatcagaagttatatttatttttcttattttgctatttttttcatatttatcctgaatagattattctacagttgtatataacaataaaattgttatcaagaaaaacattgatcttaaaaaatttatttcagggaattatacttctacactgcacctatttttatgaacaaagcagtctagatatctctttaaaactctgaaaacgtcagacatgtctcagaacttttttttcttacacatatgaatagatagaaacaccttgaaattttgtacttttttctttagcctcccattaactctttttttttttttttttgagatggagtctcactttcttgcccaggctggagtacagtggcacagtctgggctcactatagtctctacctcctgggttcaagctattctcctgccttagcctcccaagtagctgggactataggcatgcaccaccacgcccggctaatttttgtatttttggtagagacggggtttcagcctgttggccttgctggtcttgaactcctgacctcaggtgatccaccccccgccctcagcctcccaaagtactaggattacaggcatgagccacctggtcccattaactcttttaattttgggatagaatctgacgctgtggattattagtatgccaatttaatttttttctgattaaaagatcgtcatcacctagaagcatttactatatgtttggtatatgttggtagctctacttccctttgaaaatcatcactttaagggaattgtgggatatagattatgatcatcacataataattttaacagatatgttcattttatttcacataattgaagatattttcttttggatttcgttttagagactgtcatgcagttccttgaaaaactatctgacaaactttctgaaaggttagtttttattctactatttagttttttggttatatgttatttagtctttttaaagaagacttgatttataaaaaattaggaagtgacctagaatataagttttggcatattggaccagacctgtctcactatgagacatactttaaaaggccatagttgtcttccttatgtgccattcttgaaaacataagctgtcccctttcattaaacaattgtttttagaaattcatctttcatttgcactttaaaaatctttaccaaaatgtttttgaaactatttattttaacttgtaccatgaattttatgacaagttcataaagtagtatttctcttcttttggcctaaatacaggaggctcatggatgtggtgtctttttaattttgtgtagtattttaaggatgttctatctcaacatttgtaatttcaagctgaagtgttctactgcctttggtgtgtccgtttgttataacaagttgagtgtcccttatctgaaatgcttgggaccacacatgttttggatttcattttttggggggaatttggaatatttgcatatacataatgagatatcttggggatgggacccaagtctaaacacgaaattcatttatgtttcatatacaccttatacacatagcctgaagataattttatacagtgtttttaataattttgtgcctgaaacaaagttttggctgcaacctatcacatgacatcacatgtggaattttccacttgtaccatcatgtcagtgctgagaaagtttcagattttcagattagggaggctcaacctgtattcctgcctcccctgcccctcccctgctcagtgccttcgatcatacacttgcccttcactggccctcttctaggccttagttgagaggcagcacacctttaggtactaaggattctaggaagaagcagtcaccgtttgtaaaaaaggatgatgttttctctttttctcttgtaatgctgtctaaaattttgtttgcctgttgtggctacaccaacacattggatcttggctcacatttctgttttggactataaactcatgccttagaactcattcttctctagtttggattatgtttataaattctaaaattttcttttaatgatcctggtgaaccactgtgtctttgatacaataaagaaagagggttagttatgcacttattgaggatttatcctgctttacttagttaagtgttagtagtctttctctacatagctatagattttagagcaagcatagcttcatcattttacaggtatatataggaattaattccaatatacatgtcatattctacaaatattaaatacctatttaattattgaccagctagagtttttccataggggaaaaatgactagaaatcttaaatgtagccaatgataaaattcctttctaggagttaatttgttaagtctcttttaaaggtatagcaaaaagtagtgatttaaagttggtgattaatgctttgcatatttgtaatgacattgctagtttttccaagctttagtactcttgagacatttatccaccatgatgctttttaaggtagaaattgcagtaatatgctgctttatatattgttatttctcatgacacttaggtaaaatttggattaatagtgatttatgtgtgcactactaattgtatctaatcttatgaatattggaatgtaacataagcaaactagtcctttcataatgtaattgttaaaattttgtcctaacaagtaatgataaacctgttttatagaactctgaaagattttgagatgatacgagggatgaaaatgaaactgaatcctcaaaattccgtaagtatgttggaatatttttattataatatagacagtctgtcaactgaaatcaatatcttttgattcaggaactttcttgtgataggctacaggtccatttagtcttgtttctgatcctcggttttggtgaataaagatgttgaaatatttgattcttatgtcccaaactgatgttgcctgtacatacagcatttttgttgaggagtcaacatattttatgtatatacactaacacaatgtgtatatattcatgcaaagactgctttcattctgtggaatgttggcttctcagtttgaagcagactttaaggagactcagtggaggcttcatctggcaggtggcaattttaaccatcagtgttaatgttgcagttcatttgcttatttgttagctaatttatggtgcccaattgagtatttgactaacaaagtataccacattctaaaaacacttaagtgttgttttcaatcatatgattatatgatcttccttatgtgatccaagagtatagacaagtattgttatggccagaatgctgcccaggtgattgggggagtgccctgaaaagtgtcgagagtccagatattaggactcattcccatttggttctagggcactacaggattgccggggttgtctacaccattcttttccaaatgctgttattaattcttgacttagttgctgctgccagagccatagtcataaggaagatttagggaaatgggccttgcagatttacaaactgtttactagcttcccagatacagccactaggaaacagattaatcccattaaactcagcgatgtgtagagtagcatgtcagtctgttaatttatggaaggagctgtgtctagcaaagtaactactggtagtcatctgcacagtcatctgcacaccttgacctggtaggtaggcttatttgggaaaccagataataggtaagaatttagtttggtgactatagaaacagaaaaataaaaaacaaaatgtgttgccaaaagctaattcagtaaaagtgaatatgactttaaactgttatctgtagatatttgtatatagcttatggatacaattattctgcagatatttgtgaaatgcccaatctcctcatgaagtccctgctttggtgaatggtgccaccattcaccctgctgctctggtcaggacctatacttaatccagaccagtggttctcaaagtgtggttcctggaccagaagcagtagcatcacatgggaacctgttagaaatgcaaattcttgagccccacctcagacccactgaatcaaaaactggggtgagctccacaatctgtgtttcaacaagcaccccaggcactgcacactcccctcccccataatcatttgttaggtcctgcagattctccctccctgtgaactcttgtgtcttctcctgtgcccattgccatagcctgggttgggatcattattctcacccagatggtaactgggattgcctaactggtttctagccttttgtttttgctccactcgaagccgtcttggattcagacagtttagccatgtatttagcccagtgttaggcatagaattggttgtcaacacttatttgaactatgaatgaataatgaatgaatgaatgaattgccaccagagggatttgtctaaaaagcagatctgatcttgtcactctgttgtttaaaattattcagtagctcctggttattctccagtttcccttcctactaccctgctgctcccgccaagccctcatgatttggcccttgcctccttctctagcttcatcttctgctgcccctccaagccgaggctgtgttctttgctctctcctaatacctgtgtgacgctcatgtgatctctattcacttagttttgctttctttccttgctttgctttctttgattctttaatttgaattaatatttacgtgccggccacataaatatggcatggtgagcagcttccagtcatttacaaacaccacctacaggaatgcctttctccctttctcatctggattaactgcttctatcataaaactcaattcaggctttgccttcttgagaacatttcctaaccttccgctgtgatttaaatactcttcttgtgggctgtgttttacatggcacaatgtagacatgacatactgtcctctgattgttgagtcacttgcccttctactgcctaggctatcatcctcttgtttttgtctgattacagcctgcactctgtctgcatctagcagatagcaaataatcatctgttagagaaaatgtgtgccaggaccagaacactgtggggctagggttccatggacgcagtccctgcccttcaggcactcatgaggagaaagaaaataagcctacaagtatcttaggttgtcatgcatcccatgatataagtattaccatggaatatgggaaataacaccttgttattggaggagattatgcctaaactgaaatgttaaaggataatggtaataaggagagtagccaacatttgttgagcccttactcaatgccagatattctacttaatagtttaagtacattcagcagtcttctttgggaggtactgttgattctttcaacaaatatttactgagtgactaccctgggccaggtactgttcaggggacaggaatgtaatagggaaggatgcaaacaaagtccctgtcatcatgcagtttatagtctggtatggattggaaacttgagcccaggcagtctgtcttcacagcctggtctcttaaccactcttttgtccacctggacacctagaaggaaggacagtcattcaagtattcaagctttcccttctttcagtattatgtgccaatcatcaaaagcaactagtactatagtacttctttatgacatattttctttgccaagattagagttaattctgccttggttacattttaaattgctgctttcatttttgatatctacccaaagcttcttgcttagatttagaaagaaccttaatcttacctttagtacactcatcttacctacagtgtgttttatggattaatacatgggttacattttgggaaaaatttcattatggctaatataattcgttaatgtttacttttgttagataccacttcagaatgacatttgtttgtcttttccccagattctggggtaggtcttagttatacttcactatcccttgattacagggaagtcaaaataaggagccaggtattttctgccaagctatcaattttttaagggattctataaaattgttctgatttacatgaacagtagctggtttacattctataggctggccacgttgctgataaaaactatgaaagagtcagtagctttccttaacagtgaattattccattgtaggaagtaatgccctgggaccccccttactacagtggtgtgattcgtgcagaaaggtaagtttttcaagaaatacccgtacaggaaaaggaaaaaggaaactaatgtttattcagcagctactgtcatccactgagtcgcccacagtacaaacccttcccctgacaccattctttctgctggcgtggtctgctccactcatgtattcttcagctgcttgtatcatttccttgtttaaaattctacaatctggtccctctccagctctgcccttgcgtagctttctggttctcttcctaggctgtgagcattgctggaatccttgttgtatcccattgctggcccagagtaggggctcagcatgtgtttactgaaccagtaaaggaataaagtggtacatggcgtggtactacgttattttccttttttttttttttttttttttgaggcggagtcttgctctctcccaggctggagtgcagtggcgctcttatgttttctcatttttatttggacacatatattgtcaacacattattggtccatctggaaggatataaatgaaataaagatttaaggaacttaagttgacagaagtactcctctggcttctatatcctcctgtgtttattatattggagaaaagtaggtatgcccttctctccctacagacacactatttctgtaatttttatgttataaacccaagaaatagagctcttttcacagtgaacacactttaaaatgtttatagctgaagcaactttatatacccaataggagtttttaaaaaaaaatctcagaatcctactctttaacaacttattaacatttttcccttgtagttagtttttgagatatgctgtttaagtaggagagttaaggttgatttaggtaatagaagaaaatgtaagttttttgtttttttttcctcattaaagcataccagcatgtactgtgatgatatgtgtatttatttggtattaagctttaaaatatttttattactatgcattattgaagcatcaagtaaagcatagtaggtacttctccaaaataagaagtatttgcttaattatttatttcggcatttgtcataaaaacagaaaacaataactttctatattcttttctataccagcaggatgaggtagcctaagatcaattagtgttttgaagcacttactcacttaattttcatttattttcctctctttggtctccatctatcactgttgccaaaaccatttttacttacaaggcataattgtgtcctaacctttagttaagaatatttggtcagttactattttttatttttatttttcattaaacaactctttttagagacagggtctcactttgtcgcccaggccaaagtacagtggcgtaatcatgtctcactgtagcctcaacctcctaggttccagcagccctcctgcctcagcctcccaagtagctggcactacaggtgtgtaccaccatacccagctgatttttaaatttttttgtagagatataggttcttgctgtgttgcccaggttggttagctaccatttttttaaaaatgtatctcaaattcagcatcagtcttttttttagtgaaaacacataaactgttattcaaagtctataataatttggttatggtaaacaacgagggtttagaatatatttgttttacaaaattgttttctggttgcagaacttgaaaccctgctccctatagttgcattaaaaaataaaatgtctcttttaaaattctgtcaaagaaagatttggcttggttgtttcacctgttaaagatgtagcataaatcagtaataaaatttatttgtactttccatgtttatgtaaagcatttgatttttgacattggagagtaatgtaaattaaatatatttgatattaaatattctaatttttagaattctaattttaattctcaatatttagaatattaaatattctaatttaataaatattctaatttttgctactctcatttttatcaggtattcctttcatatcatgtccccgatacctgattattttcattaatgccttggccttaaatataagtgatagttttttcactaactatactctgtaaatatagcatgcccaaatggtggttccgaggtaggagatcagcaggacttgttttctggtcacaacctcctgaccagaacaggatctggtccaaacagaatgaagtaaagaaaccagcccagaccaacagatggcaaggaaagggatttctggctgccctcactactcattagcataattcactcccaccagcgccttgacagtttactagtgccaaggccaatgaccgggaagttagcacccccttcctagaaagttctgaataatctacccccaatttgcattaacccaccccttaatttgcatttaaataacagtgggtataaatatagctgccaacagcccacaagcctggctctgggcgcactgtaggatctgatcacaacctacttttgttttacagaaagaaacatctctactcacatttatttgttctgatttttcttccaccgctgctcttcctccacagtttatcccagccaaacccctttctgtctcaaaggcagaacctctgtcaggggagcagtgggttcccattgcctccctggtttgtcttacacatctgtgacatcttgccaggtgtccatgaagctgctgagtctgcactagccttgtgtagctcctggctccgctgtgcttaacagcctgtgtgctacacagttgacctgctaagatgttctggatgttaaatgtgtcttgtcaaccatattttaaagctctgcaagaacaaacattctggaccctcagtaaatacatactaattcatagcccctattcaaacttgtatctagaccagtaaccatgaaaagcaatccagtgatgaggtttttttagaaagagaatgccatgtttttgcatgacatgtttgcagtgctcactggttgatggagtcttccacctgcttgctaagtccttgaaatcaccaggtatgctgggaacacaatgtagtctgccagatatccatgtggggctttagcttattttaaagttttaatactaatttatttatttgactattaactcagtaaaagaaccaggaaaagggatgcagaaatgcatcagaaggggttgtaagaatcgggttttaaaaatctattttaagtagcttaataggctactgagttttggtttgaggcttcagtaatcttgattgacaagaggaggctgccgcacaggtaatggatgagaaaagaaaggaaaaatatcataggttgggtttggggttagaagagtggaacaaagtgaagatttctaaatccttgttaaattcatcacctttcaagtaaagacttaaatgtgtggcttgacacaaaatgaaatatagaaggggctttccttgattcgagcctttttttcaagttaacctcagggagtcttttgcttttatgttaaatacctcagatttatttcaagtttttaatgttcatctaaagaaaagaacctgtttagaagcaggaggagaaattaacatgttttaaaagtgccaaaggttgatcctggaaaataccgtagtagtataagtgactgtcagcaagtcttaaagagcagctcatttttcctttttaaagctttattgtaagattcttcatggaagagtaacattacgtctttcagatacaaaaataaattattttatttgaaattaaattttatttttgattaggcaatacattcacatggctcaaaaaatcaacaatgttaagaagtattaattgagaatactcatctctacctctgccccagaagtcaccacttttaagttgtttaatgtatccttccagtgtttggattttgtttttgatgctttggaaacactatttcttttctgtgagtaatgagtttcagtatttcatttattttggtgctatttttgtttgtttgtttgtttattgtttttttttctttttttttgagacagaatcttcctctgttgcccaggctggagtgcagtgatgtgatctcagctcgctgcaacctctgcctcctgggttcaagtgattctcctgcctcagcctcccgagtagcagggattacaggcatgcaccaccacacccagctaatttttgtatttttagtagagacagagtttcaccgttttggccaggctgatctcagattcctagcctcaagtgatccgcctgcctcagcctcccaaagtgctgggattacaggcatgagccaccacaccctgccaattttggtgctatttttaaattaggatatcactgggaaagggaattcagtattgtctattccttgctaagatatattcttaaaatctcaagcgcattcacataatgaaatacagatgttttgtgttttaaactattcaaaaaatgggctctcacagaaggactttttttttgatgtgagaaatctcatgctttgttagtataggattagtgatcttggtagttttaaatttttaaaaattaacctttattatgaaaactttcaaaataaacaaataggaaatggatggctcagtcaaaagaaaaagaacaaagaaaaaattgtttaagaaaaaaatgaattaaacaaacagaagtagagcaatataagtaacctctgcatattgatctcccagattctacaaaaaaaaaaaaaaaaaattagcccggctaattttttgtatttttagtagagacgaggtttcaccgtgttagccaggatgatctcgatctgctgaacttgtgatccgcccacctcggcctcccaaagtgctgggattacaggcgtgagccaccgcgcctggccaattaccaagatttttctatgtttgcttcatttgtctcttttttcagttttcttctttctttgctcttcttttccttcttccttccctccctgctttccttcctttctcttttctcattactaatgtacagtcatgtgccacttaatgacagggatacattctgagaaatgcatcgtgggctgggcacagtggctcatgcctgtaatcccagcactttgggaggctgaggcgggtggatcacgaggtcaggagttcaagaccagcctggccaacatagtgaaaccctgtctctactaaaaatacaacaacaaaaaattagccgggcatggcggcaagtgcctgtagtcccagctacttgggaggctgaggcaggagaattgcttgaacccgggaggtggaggttgcagtaagcagagataatgacactgcactccagtttgggcaacagagtgagactttgtctcagaaaaaaaaaaaaaagcatcgttaggcacttttgtcattgtatgatcttagagtgcacttacacaaacctaagggtatagcctacacacacgcctatgctctctggtatagcctgtcgctcctaggctacaaacctgcacagaatgttaccatactgaaaactgtaggcagctgcaacacatgataagtatatatgcatctaaacatggaaaaggtatggtgaaaataggtataaaagataaaaaatggtatacctgtatagggctcttaccacaaatggagcttgcaggactggaagttgctctgggtgagtctgtgagtgagtggtggtgagtgtgaaggcctaggacattaccgtacaccattattgactttatagacactgtacacttaggctacactaaatttatagaaagatatggttctttcttcaataataaattaacttttgcttcctgtaactttttttaccttataaactttttagtttttaaaaactttttgatacttttgtaataatatttagcttgaaacacaagcacattgtatagatgaacaacaatattttctctttttttaatccttactctataaacttttttctattaaaaattttttttgtactttttaaatttttttgttataaaccaagacacaaacatacacattagccaaggcttacacagggtcagaatcatcaacatcactgtcttccacctccacatcttgtcctactagaaggtctgcaagggaaataacaggcatggagctgccatcccctgtgataacaatgccttcttctggaatccctcctgaaggaccggcctgaggctgtttcacagttaacttagaaggagtacaccaaaatagtgatagaaagtatagtgtagttaatacatgaatcagtaatatggtcatttattaagtgttgtgtactgtacctaattgtgtgtgttaggctttcatatgactggcggcacagtagttttgtttacaccagcatcaccacaaacctgtgagtaatgccttgtactctgacatgacagctacaatgttactaggtgatagaaatttttcagttccattatcatctcaagggaccacccactgtagcatatgtggttcattgctgacagaagtgttgttacctggcttgtgattactttaaaggaaatcctagccctcatgtcatctcagtcttatacctttattatgtacttttgaaaaggatgaacatcttcttacataactcttgtatcattattacctaataaaaatttaatagcaatttgttggcatcatttaatatctagtctatattcgtatttccttggtagtatcaaatcagcttttttccccgttagcttgttagaattaggactccaacaaagcctccacattctcttggcttttctgtctcctgtctcttactttagagcaattccccatgcctcatgctcttcttactctcttttttgtcatattatcagcaacagttgttgaagagaccaggccatttgtcctacagaatttctaactttctggatttatctgtgtgcttccttgtggcatcatttcactagttcctctcttcctatcattcctgtaagctggatgttacatataataactcactgttaaacatttcccgtttttggcatggacacccataggtgatgttgtatactttgtgtcacatcacatcaaaagatgtgaaatagctgagcatggtgacacatgtctgtaatcccagcgacttggaggctcaggtgggaggatcactcgaatcctggagttcaaggctgcagcaagttatggtcatgccactgtactccagcgtgggcaacagagtgagactccatctcttaaaaaaaaaaagaaaattaaaaaaaagacatgaaatatcagttgcccacagagggtgatgtgaagatggaccactaggtagattgatgctgacaggatctctgcagtctgcgatgagggtttccctctcagctagaaagggatctctgtggtgttcccagcaacatggaaatgtccagtttttcctcagtcatttacccagtggctttaacacccattgatagtcttcatctgagtcagtcattctttttaattaccaattctcaaaataaggatttattgtaatagttttctgaactagtgacaaatgagtattatctggctttctctttgtaaagcgtcattataaactaatggaattccattgattcattgtgtttcagtctattacagtcattttggagggatgccaaatctgtcataacttggccaattgcactgaaaagtcagtcttttaggagcttgttgagtgagactcaaaatacctgtgtttattattcccagttgagtttgaaccacttgctgcatccctgcaggacagaaaaggggtggtgatttctccagttctgggccagtcgtgtctgcaacctggggagaggtctgagaatagggtctgttgctggactcagtaattcaaagaggcttggaaaagctccttaggcaaagcaaatggctgtctggccactttcctttcatcgttttccacaaggctctgggggagaaaatctctgcctatttcccttttgctgctgccacttgttccttctcactaggttttcattcctccctgttccagggctaacctggatcctctctcacgacatttccacaactcccattctgttcttcctaaagcaagaggcagcacataggtgttatttttggttattctttcctactgttcaattttagacatggctgtttgatttcacattttgatacagcttaagctgaatgagagaccattgcaatagaggtctccttgctgtagtgagatttggccccagcctctatggcgagaattctgtcatctagtggcacattggtgtggtgtcatctctcactgaagtcaggcctactggtttactttcctaatccctaggatgatgatggaattgtactgtctttctttagctttgatttctgttaaccacagttttcagtgaactgtgttgctgatctgcaccattaatgaaaattatttcctggttgccaggaagtttgactggagcaattttcttgccactagcttcagaagtcaagacagaaccaaattagcaatggtggattctttatagaacagggggaaaggtcttttcagttctatatagttacctaaagggcaaacaggtttccagtatcattcagttcctttactgctaccttctctatgtaaccaaataaaacagtagctctccctgtggttttcaaggcagcatttcaaaatgtcacccagctataacatgagaattatacttagtcattcctgatgccaaaaatacagtttcatttgcttttgataaagttaaaaatagtttctctgacagtactgtcacgtgctgtgtcctttacaggtgtccattttttcctcgcccacacgtgccctccggcaggccatcttgttcattctgtaacaagcctctgtgggcatttgccatttggtgcacatgttctctgtcacatttgctctcactcactgaatagaataaggtgagactgaagctgtgtttacctgtgtttcaacctggattctctgactgtacttgattgtgttttatattttcactaagtttgaggccatggtgtttggacgtaatatccaagttctttctttaccttaattccaggtgcgtcagaggttgaaatataagtctgactcatagagtgtgcttcataaatacagtgatccattgacttttttaaaattcagtttacaatgatgaattcttcagttgaaagtctcttcttgactgatatttctgtgctcatttcaatcataattagtgttggatgaagattagatgaagattttgatacattactaaattctattgttcttaatttaaaagacctaattataccattgtatcatgttgatagtggtatgttctggttctttgctgaaaatctgtaaactcatatgtaacgtattataaaccagaatagcagagtgtttattggacttattcagtcacctgtagtggataacacaattttcttccactttctttcttcagaggaatcaaagggttctagagatcccttacttctgggtccagatccatggaattctttacaaaaaatagtcataaaattcttgtaaaactgtagaagagtctgaggtggtgacagggatggcactgaagccaaatcctcaaaatgcatctaagctctgtctctgctggttgtggctctgctgtgctgtgaggtcctatatgctgcccatggtgctttcccactgtcttgggtctctagatgagagaggaaaatgttcttatgtgtagcatctatgcagataaggaagctgtggatggagatggtgcagttggttgttcacaggtcggcctcagcctcggagtgctctgtggaggcaggcggagccacatgatgagcctggcgtggagggctgtactggggcctgtgaccacccaaacaccctctgtgcatgttttttcactccgtgttgaagacgtgagctgagagcacagcagtcacgccctcctgactggctggtcatgtgggactgctccttggggcccctcagatgtgggttggagctgcgggaaacaccctgtagctttttgaatctcttccaccctctctggacctctctccttctggcttttcttcaggaaggaagtagcctgcatttggtgagagtcactgagggtgtggagaggcatgtagtctcgctctggatggctgaggcagctgagtgaggactaaggcactagtgcttgcttgagcttgtctgccccatttgcttgaatccccttgggcctttgctgccctctttcttcccctttgagtgccctccccctcttctaggagcctcatctttccaggtgtgctccagatgctgcctcttctttgtagttctctctgttcctcccattcccagcttctcccctctgccaggtgtaactgaccacagcctcatctttgagccaatgccttgtttgcagtgctcctctgcccctgatcatttggattggtcgtcattattgttacaatgtgttcatctttccacactgaggagttgtcatgcaggcacatggcaggtgattaatgaaagtttactgcatctacacagcttcttgacacagtgttgcatttctttttagaggtaaggtcagctttggggaatagaagggaactggaataggagtagaagaagggaactggaatagaagtagaaaccgctgggtttagtcttgtccctgtccgtgtctctgtctaacagcaataatagtggctataatttacagtgtgcctgcttttctccaggaaccatgccaggttcattgcatgtgtttctgtaattgttaatggagcctggaaagtatttccactttactggtgaggaaactgaagcttcagaaacctaagtaacttgctcaaagcatggaaccaatgagaaatagtattttcaaacccagggctctttcttgtattccagattgccttagactgtcacaagcctctttgagcctgagattcctcaagtaaaacgaacaataattctggtaataattcttgctccacctgtctcacagaatcatgtaaggaataaggagattcttgattcttgatgtgaaagtgctttgtaaattgtgaagcaccaagacaatataagataatattatctcaaaccactatagatcttgcttcaccagttattctaactttatcacaatcaccatctcttcctttgtattagcttcaaaccctttgcctgcagacctgctaagatatctcttatcttacaacacaaataattacccttctgtgacagttggagagactgtggtactatctcatttttttcctgccgaacttcccccagtcctactctctcctgatgcctcctctttctaatagctacagtctggtttataggcctgtcagtctacccagctagtgtttccaggttatcagccacctgccagcatgaaattcagtaatttgttttactgctcaacatccgtgatgtctgtagttttctgtttgggttttttttttttttttttagcttggatttgagatcctaatgtctgcagtttttgacggcgcttaccatgtccagtttcttaaaattctttcttcaacacataccctcagacttcctgttctctccttttttatcaccacactcatttctctttttacttctctaaattgatcgttctcaatctttgttcactgttaggctgccgtaggagtcaatgcagggatgtagtgttctcattgtgaccagtagctcctcactcttgaaagcattttgggaaatgtgtgtaagaatgaatgatacaattactgtgcttcctttagtacttgctttaacttgtaacagatatttgtgaaaaacttcagtacctcagcctaaacaaagatgtgccctcctgttgattttttttcaacttccatgctgttatcatgcagttataaaggatggtctcaggccttctacttagttgttgtcgtagccttgggaaggttacttactgtcttgtaaacctgttttctccattgtaacatagggtgatagtattaccttaaaggatcgtttttgctgttaaatgagatatgtataaagggcttagcccactgtcatagtgagtactcaccaaatgttagttactcatcatcatcatcatcatcatcatttggtagtgatagttttctgtttgtagattaaatttagggaaaaatgggcaacatatttgcaatacaggtcaagcatttctaatctgaaatgcttcaaaatccaaaactttttgagtgccaacatgacaccacaagtggatctcatgtgacagattgtcgtgaaaatacagttaaaattttgtttcatgcacaaaattatttaaactattctgtaaaattaccttcaagctatgtatataaggtgtatatgaaacaaataaatttcgtgtttagacataggtcacatccccaagatatctcattatgtatatgcaaattttccaaaatagaaaaaaaaatccaaaatccaaaacatatcccaagcattttggataagggatacacaaactatattgaacttcctcttgctataataatcatgaatctttgcattttaaactgacctacatgtcactgccagaataatctttctaaagcacaggattttgtcatgtctctcctcttcttccttactactaatagcagctattcccccattgtatgcattctggggagatccagtaaatgttggcaaaataaagggcatatctctattcttctcctctctggtgcctagcaaaattaagaaaaagagcatcaatatatctatatctatatgtaacaacaagacagatcaggaggtcaaggcaggaggaggggaatcagtaaatattatctaaaattgctaaaccaataaataaatgtttattttaaaaccaatagaggcccgtatctaccaaaagtatcaaaattaggaggcaggagaatcgcttgaacccagcaggtggaggttgcagtgagctgagatcatgccactgcacgcctgggtgatagagcatgactccgtctcaaaaaaaaaaaaaattaaaaacaatagagaaaccaccagagaagctaaaatatagactataaatatcactaatatatcaaattattagaaagaaaaaggaaatgcagcacacatagctaaagaaggaaaataaaggaagcattaaaagaaacgtaacagaattacattggcgagagtgagagcactaggtattttcatacactgcaggtaggaatgtaagttagaaacagctttttttagaggataatttggaaatacatatcaaaaaacttaagatcttgtactctttgcagcaatgccatttcttcagtttatcttatggataggcttgtgtgggtgtgacaaggacatttcactatggcatcactttaacagataaactaacagcagcttaccgtcagttaaaaggaacagaggcagaccaaggcagggaagtgagctctgggtgtggcctaacgggatgcattttctgtaaaaaagttaaaatcaataataaaactgatgaaaagtctgggttcctttaatatccccatatgtgggaaattccaaacgatgtcagtggtcggatacttcccccattgatgcttcaggctctcattgaccttgcctcctctgctcatgtacaacacaacaggagatgcatgaaatgagctttgtcatgtgtttgctgtggatgactacacccatgaaagaaaacaggctagagctttatatactaaactggaaagtattccaagttatatttttatgaaaaatatatgtgtaaaaatacatatcattgatatatttttatgttaaataaaattgcgagatagtgtgaatggtatgattctatttgtgccaaagtaggtttatatatacataaagtttacatgcataagcttctaagagtgtgcataggaaatgcctggaaggatacacaagatatttacctctgggggtgggcatagtgagccaggggacaagacagtatactttttgcccattgttaatatttttgaggtgtttttattttaaaacaggcagtttagaaattcatttgttcccaatcattttagggtaatattgtaatattatatgaacttatattctatacttaaattttttttccaagataaattgtttccttgaattttgcccaacacataatgattgtcatggtcattggataagacagtaaatatttttaggttatagtttagtaaaataagctgtgttactagctttactgtgtttcttttccataaaaataaatgttcattataatcttaagaagggtagaattttaatatgtaaagtttctttttattctcctttatttttgtgtttttattgtctggaaacaaaaaaatgaattgctttttataaccaattatagtttaaactttcttgccttggtagtaggttctatgggaggtttctgctctggtaagctgtgattctctatggctgcctgcctttctttccagttttgggggcagcagtttgctctgtggccttgattctctgctgaatctaagaagattcttgattttcagcttgttcagcttcctgcttgttaggatggagtggtgactttcaacctcctcatgtgcaggagtggaaacctcaagcctggaccacttccttttatagtttattttctcccctctttccatgcactcctttctctcagttcttcagtacctctgaactgttctgtgtcttccttcccacccctccctctggtagttcaggggtctgccctttaccttcttctctgcccgcatcgcccttccctaatggccctgtctccctctatggctctaatatctgtacagtgaagtctccttgttctccttagctttgggtcctgagtgtctggtatctcatgggcacttcacagtcggttcctccaaaatggagtttattttctgtgagccctccatcctcctcccatcattgcacctcaccctcctctcttctcccacaaacacacccagattcccctcttccttttttgtgttcattgtgccggctgattcagtgactctaccatccacttatttgtccaagccagaaacctgagtgttattctagattgttctgtctttctcatcaccctccaaatccaatcactcacacagtcctgagacgtttgcatctcaaaggaaaaacacattcatccctgaccccactgccctctgtcagagttcaccctctgaagcctggaagtctgtcctcctgtcggccctccctgcctcctgcattccaccctccatgctgtccactgtgcagcattccagaaaacatcagatgctcccctatggcctacagaagctgtctcccaaatggcatctgtaagcaattcattgagagtgtagtcataaaatattagaaattctatgtatatttatttttctttatctcaacttataaaaatgtctgcttttctttttgcaatgtgataaaacaataccacatgcatatactttatgagtgtactaatagaaggttgaatactcaaaagttattttagtgtgcattggtgaggaagcttagaggccatggcctatggtgcatggtcccagttcctcagcttagtggaccaggccctctgttttctggcccctgcctgccttttccagactccgctcccattctttctacatttatccctgcattggtaactgcttcatctttaaccacatcctttctagaagttaccaggctattttatgccatcatactttagttatactgttgcttctgcctagaattcctattatgattcccattttccattcctcatcccagccctgccttgcaaagtctgattccttttttttttttttttttttttgagatggagagtcttgctctgtcgcccaggctggagtgcagtggcacaatcgtggctcactcaacctccgcctcctgggttcaagcaattctctgcctcagcctcccgagtagctgggattacaggcacccgccaccacacccggctaatttttgtacttttagtagagacggggtttcaccatgttggccaaactggtcttgaactcctgacctcatgatccacccacctcagcctcccaaagtgctgggattataggcgtgagccacagcacccggccgattctttcttgattcctatccgagaagctttccctggtgctactctgcactccacaagtaaagtcatcatgctctcctttgccttcccattttgcagtgctcattcgttcatgcttcagcactgtctgttgagcgccagccgtgtgcccactgcaccaggcccaggacacagtgtagttggttcacttctctgcctctttcagtgccagctgcttagacacaaaggctcttcattcttctcttccagcaccccgcaggtttgctgacagcatgcttgagtgaacgaaccagggagcgagggcactggatcatgaacgtctctttcaacactaggattctgtttaaagaaaaatcagtcagaaattaaggtgtaaatttgtggatgtccatagccaaagtctcatttgttgtgcaatttatgttcacttactaaactcattcatttattagtaactatgtttttatatttttatatataaatttgttgtggggactcattttatggaacgaagtgttgtgcagttctagaatcacaaataaagccaattgaaaaaaaaatgtgtattttggtaatcctaaaaagtagacatataatgagaacctacaatattctagagccattatttttggctatggctatatattttggcttgacttaatgattcaaatgtaaacattcaaatcacgtattttggatttgctttggtttatattggaatatatagaacagaaaaagttatttttgggtgaagaataattcaccttactagttacgttgtctttaatttaagatatctaactataaaacagataagatctgattatttatattgcaggcatttttttcataaatgaatattttactggatgagaactttaaattcacttaatgtgcctcaggatttttattcatttaatatttatgtatataggtcacaagtttctagaatataattcataaggtaagagttaccattataactgaaactgatcatattttgcatgtaagtatgtataaggaatgtatacagtgagcagttgagactgcttaattgggttagtgaaagagtaaataacagggaagggacaaaggttagggaatgatatatctaccttaattactgacttataactaacactagtaataatcagactgtcattctgaagaaaactgtctgaaaacccctcaaatgatataaatacacttttatgttttgaatccttctttagctccagtgatcttaagtattaaatgaaaagttaattgaatttaccttcagaaattgaaataaacaaagatgctgttgaacctctcttccttctcttaggtataatattgagcccagcctatattgcccgtttttctctcttggagcatgcatggaaggcctgaatattttgcttaacagactgttggggatttcattatatgcagagcagcctgcaaaaggagaggtgtggagcgaagatgtccgaaaactggtgagctcctcctgctcagcctgcagttgcaggcatttacctttcggttgggcagttgagtcaacagcagtttcaggtttacatcaactttgccctgactgagtgtgtcccctgccttatttctgcttcacaaaaaaaatccaaattgcacttctgatttaagacactgtataaaggatccaaacataaaacagcagagttttctaaaaaagttttttggaacttgatagaaggttgaatatatatgcaccttcatatatccacaaattctatttataggaaaattgtcctttactttgtatataccttcatagctgtgtgtccgttttggttaattcccaaatccattggataagtgaccttttttctctccaacccccatcccatgttgtaggggcttatatttgcatcagatattaatttacgtccgtgttctgatttatttaacttctttgataataacttcaaacctagcaatcatctttctcctgtgaaggcccactttatatgaggcatgaatattttaaatttttcctcataggatttgaggctttgttgacctgtgtgtgtcactaaggctttgtattgttttgttgtttgatttttgctagcatgcttaccacactgctttcttcactatattttaagaaatgtaaacagtctcattgtctctcggccacgtcttgtgagtggagagtaggtgtggtggtgggattgaaaggagagtcagggtgggaggacgttcatcactgcattgatttacttcactatctgtattacaaacttccaaaaaagatagagattgataaaatgctgagatataataaaaagaaaaatttataagaggagactgagaggacaaaatgcgggtgatgaagggtttccccagaactgcagaatgtgcactccaccggggtccagcactgttgtcagttgcattcacttctgtatcctcagtgtcttgaagagttcctggcaccaagtaggtgcttaacagatgtttgatgaacaataaatatatacttgcaggtaattttaaagcacaaaatcggggttctctttgatggaatcattaaattctgaaagaacaaagaaggcaagatggagagtagtgattgagtctctcctataagctatgtctcttggagaggggatagatagtaatattgctgatttttaactcaagctgggagctgcattgtggtgttttcaaattcaagggttataatttgcttgggcgtatatcacgacattccaggatttgaaggaaaaataatttgctcctaaaattgtccagccagcacttcttcccagctcttgtgggtggttagtaaaggtattgtagaggataggcagtcaggacaaaaggccctcatgaggaggatttcctgtcctggacacagaattccaaaaccaaaatcattcaagagatggagcagaagaggatgcggggaaaagagaatctatctcgagataatgtggggtgtagaatgtaattaaaatgtctatatgtgtggctatggatgtttaatatacagattcttgtgttagggattttagagaatcagatggcctcatttaccaccaaatttaaatttttttttctaggctgttgttcatgaatctgaaggattgttggggtacatttactgtgatttttttcagcgagcagacaaaccacatcaggtgatcctttctttataaactggtctctctagaaccgatcggcatttcatttgtattgatgtgaactttgtatcattttttaaattccatgacatttaaaagttactaatgatggttaccaaatatatacatttgaaattaagatagaattttaaaattaaaaagtttatggaaataattacatcagtctatatttgtcacttttatctgggtcatggtattaattatagtaacaatgacaactgacattttatgaatccttatttgtgccaaacagtgcactgagcccgttatacacatcagccttttaatgttcacctcacccttttgactagttactcacattatgaggaaactgaagccatagaggttaagctacttggccagaagtgctaggacttgaaggcatacatcctgagcagatccccaacttttaactcttttccatactcgacaatgaacctattctaaaactgcggaagatactccatgtggaaaccttaccaaccaccaagtagctccttatgtggaagacttgaggcagctcatctccttttctttagcattggccgactttgacagccagtcagctttagcagtttcatgtagcttgatgggaaatgtcaagagtttaggttataagttataacagaaataatgtaccttatgtttgaatagtgattcacaatttccaaagcacagattttaacagatgtgagcttatgaattctggacagccactgtgggatttgacaaggaagcattttagagatgaggcttgcagaagcaaattattttccgagatgatttgtctagtaggtgtgaaaggtaggaacagggtgcaggtcaccagactctgaggccagtgttcttcctctttgcttaaatgggtgggtggtggagactcaactttagtgattaggagccctggctcctaatagtcagcctgggttcagatccaaggtgtggcagttctagctaggtgtccttggacatgttatttaataatcctaagactagttttagttttatcatctgaaaagtgagatacctgctacatagggttgttgtggagaataagtgatacagtgtatgtgagtctcagtgtagtgcctgtttcagagtaagttattctggctccggatcccttgctttacactagtttagatcccatctcgttcaagtgataaaagtcaagagaggctgggcgcggtggctcatgcctgtaatcccagaactttaggaggctgaggctggcagatcacttcagtccaggagttcaagaccagccctggcaacatagtaagactccatctgtacaaaaaaaaatctaaaaatttagctgggtgtggtggagcacacctgtagtcccagccaatcagtaggccaaagcaggaggatggcttgagcccaggaggtccaggctgcagtgaactgcgatcacaacactgcactccagcctgggcaacagagcaagaccctatcttaaaaaaagaaaaaaaaatagccaagagacatggaaagtacctactagttcattatctgacacatagtagggactcagaataaatgttagtgtcccttcgtaagttctttgctgactttgtttccagcttctggcacagcatcatttcaatgcatgttttgggaccaaagtaatgagttaatccatagaaactgaatgtgttcttgatgttttaaaaaattaaaattttagcagaataaaaaatgtcaagaaaaggtgtatatatgtaaatagatagaataagaatataattaagttaaagtttgcactcacacatttttggtgaaattttatattcattaagactgttttactcttcacattaccaaatactttcttttccttttatgttttctgattcttaaaggattgccatttcactatccatggaggcagactaaaggaagatggagactatcaactcccagttgtagttcttatgctgaatcttccccgttcctcaaggagttctccaactttgctaactcctggcatgatggaaaatcttttccatgaaatgggacatgccatgcattcaatgctaggacgtactcgttaccaacacgtcactggtgagccatgaggagggcttttatttactacagtcctttacaaacatacattttctttgaattgggaaaggggctttttatttggaaaatgtgatcattttaccgtgtcctgtggtctttatctcagattgcctcatcctgccctccccatggttgtgcagcctgatcttccatgcttttttccatgcttgctaacagctttcaccagggaataatctcagttgtctttcaagtttgtccctttttacattttacagtgttttatattgaatttaagtttgtggctatgtgtgtgtgaataaaaacgtatctccttaatacctcccacagagttaataagtaagtgaatgaatggtctctctttatattcaaaatcagagaagaaaataaagcatgcttaaaaagtatgatgaagtccttttaatttttcatatactttcccctgtataaaatcatagttctgctttgtagtttttatgctgctatgtggctatattttgtgatattacagacttccttcttcattgtcttatccttaagtcttaagctccctatcacatatggtcagcattagaccactagtgaattgttggcatccagcatttgttaactaactttacacacagtattttggacaaggagaaggtattgaaaagactgtaggtgggctgaacacaatcgttaaatgtcatctaaatttcttacaggatttgttactttaagtaattttgagtttaaaatatttcttttcctcactgagaattgactttgttacaaaaagcaataaatggataaaataaagtacttgtaaaacaaaggaaggataaaagtattaggtaatggaatttagtgaattaaatacaaacgctatattaatattagaaatgttttaatctgtttcatgtatagccagcatagctgaagacaggtttgtttgcaaaaggtgtgagccatggctttataaggtgttttagcagctgtgcaaatattttgttttaattttgatataaaggaaaatatataggattataataaacttttctgcaaatatgtacaataaatttatagaagaaaaatattgatttaatgaattaaaacttacagttcatcagaagtacaaataaaagttttaaagggcacacaaaaagtagataaatatattgatttgattcatgccaacttttttttttttcttgttttagggaccaggtgccctactgattttgctgaggttccttctattctgatggagtactttgcaaatgattatcgagtagttaaccaatttgccagacattatcagactggacaggtaggaacagtaatattgtcgtcttgtcctttgggttgtgatagttggcgtttatgacatcctggataaattgaactcttcttgcttttcagaactcaccctctgttagtaacaaaccttttattgcttctttttttcctgattccctatcttttcttttgccagtctattaaatcatagtcctagcatatagtcatgtgttgaaaaatagctaccctttattacatgcctggtaatctaccatttagtcctcataacctccccataaggaaaacactttatccccattttccagatgaagaaacaagttctgtagtagaataggcattcgagcctgtctcacttctaaaaagcctttgcttctgaatatttattctcttggtctgaatttttatgttgtctcattaaactgaatccagtgccatattttgccagtatgcttagcatctctgtgatgtttagtctgaaaagtccttaattttaaggcttaaatttcaatgatgcattctaatattaaagatttttaaattaaaatgtgaggtaccttacactaagctagctgtaagttgtcaacattgtgctgtttactgtccatgtgtacattggaagatgcgttctttcccttccctccaagtctgattatactagaaccgtattacgtgaggtgatgtttttccccctcagactgtatgtactcccggtacaaatgtaaattgtattcatctgtgaatacttagcacctagaatcaaaaaaaagcactgaaagaaattaaatgaggggacgaatagaattagaaacagaaggaccttaaccacctttatttgtgactcttcttctcattatgtctccagatgtgtaatattatttggtcatttttttttttggacttgattttatctgtagaataatctgatcttctggctggcacagtggctcatgcctgtaatcccagcactttgggaggctgaggcaggtggatcacctgagcttgggagttcgagaccagcctgggctacattgtgaaaccccgtgtctactaaaaatacaaaagttagccaggcgcagtggcacatgcctgtagtcacagctactcaggaggctgaggcaggagaatcacttgaacctgggaggcagaggttgcagtgagccgacattgcgccactgcactccagtctgggcaacagagtgagactgttaaaaaaaaaaaaaaaaaagaataatggatgatattctggataagtaatctgagtgactcttcaacataatatatttcagttattacggtggcagatttgtgatccaattaactacccatccattaatctacaaagaattgttctgggaattatgtagacttggccaataacatagagaggcataccctaccacgtgatagcataatccatctatggctgtgtattttgggaactgggaatgattagtagttcagtgattgctccctgcctgaggtgcttagagccctgtgcacaggcagggccacgagggccctgggggaactggggaggctggggaggagaagtgcaggaggaaggaggtctgggaaaaagagaagcggcattcgccagtcagctctcagcggtattcatctgttccaccaaaatacatttattgaggacataggacagagaggcccttcagtcagaaaacacttgctgagttttaatatttaccagtctgcattctcagcatccaagaaacagccaagaataagtcaggcaacatcccattgcccgcggtctttaattcctaggggaactgagacagagcctgactagggtgttaccgcccgaaggcaaagcccaggagaggggaggagcaacctctagactgctggggaggcctggccaggagctgggagctaaaggctgaggagaagttacacagggaaaaacacgggcatatgggttgggtcttctgctgctggagcagcagccagtaaaggctttcaggcgggaatcaaatttttacttcaagaaaatcacgctggtgtcagggaggaagcggatcgcagggggtgcggatagagcctgagaggcttcctggagaggcaggctccggctccgggggctcggcccctctcccctcatcccgggcgcgtggcctctctccacccacccttgctgggtggcctcagctctggcgacccagcaacccgcagacaagtacacggctggtgaaggggtcagggtgggaggcaggggacagcaaaggggcatcctgcttccgagggttccgcagggtcaggccaagggaggcgccacttagtgtgggagacgtggggagcatcactgccgccaggaggggtttctgcgagtttgaggagtctgaggtttcggaggtggccgctgccaaagtgagagcgcgtggtgcagggctgcggaaagagggtctggcgaggggcgcgaacacagggcgtgggaggacacacacgcgggggtgactacacaagaggaccaggagccttgcacagtagtcatttttttaaaagtaaaatctggagtggaaatttaccacatatacaaatgtcaattttttttaaattgccatctacttatagaacaaccaggagcaaagaaaggctggagtcactgctccaagtgtgatgtaaggtgcaaaaggagagagcttctcaatgcctgtattcttactaaattattctgtaagaagatgtattgttgaactagatgcaagaaaacaagagtaaacccaaaatctaatccaagatagatgagataggaagaaagcactaagctgctttgaattaattcaagtttcagacacagaagatggatccagtgcccttaagggacttacagacgtagtctctaaagaatctaaaattttgtgattctcatggagaatggaaagcgtgcccaaaggcaagagacatgtaaatgctttgagcttcacaagggcttgcctcttcttgtcactaatgaaggcaccaaggaggtttattttattttatttattttttttaaatcttaagtgcagtcctagccttaaggataagaagttaattctctaaaatccaagtctttgtaaataaatggcatttaatctcacaaggaaaaaataacagggttgcatgtttatgcctaattttctatcctgctgcctttcaggaaaggatttttttaacattatgaaatatattccagagaggtctcaggtagaggataatcagtgacttattaacacctacaggtattttatcagaactatatcatagcatagtcaaagaattccttgtggtggaagaattagaagtatgcttatcagatttgcaggtgtcatgcagctgtcagagatagcagataccagaggtgctcattcaagattcagaacgtcttgacaagctacaacattaaagccaaagtagaatttattgtaaattaatcttgaaatcaataccacaggtatagaaggagtacaaacttgcctctgttcaggtgtttagacataataaacttaacatggatcaacagtctgatgggttttcccataaatctccttcaattttaggctaccttagtggagctgtggtgcctaaggacccagaggtcattgtttctcttctcagtgcttgtagatttttaccttccgcgtaacttcttcgccgttgctccaaattagcacagaattatatataggtggcctcattctcctggaagcatgattcttgtccttcctaaacctttctaagatgcaactttcttttttttaatgttttgatcattctctgaaagtgggatccccttgttatttacctatttatatttaatagctatattagtctgttctctgttccttagaatacctgaaaatggataatttctaaagaaaaggaatctattttttacagttatggaggctgagaagtccaaggtcaaggggccgtatctgatgagcgccttcctactggtggggactctgcagagtcccaaggtggctcagggcctcacatggcgagggactgagtgtgctcacatgctagctcaggtctctcttcctcttcttataaagccagcagtcccactcccatgataatctcttaatccattataatcaatggatgaattaatccatttatgagggcagagccctcatgacccagtgatctctcaatactgcctggagaaggggtatttaagccccattggggcttaaatttcaacatgggttttggaggggacagatactcaagctatagcagtggcatagtgtgctctctccccaaatctgtcataaaatcacagtggctctttacaaatattgggttcttagattcaaggaaagaagacagtctaaacccctatacccagcattgaaaatgctaagcaccttcaccgtgcagtctaatagcctgccccttgacctctgctgtggttagaatatggtttgctccaccaaaacttatgttaaaacttggtccccaacatggtggtattggtaggtggtgcatttgagatgtgattaggtcctttagatggagtaatagctctctctggaggctgggttctctctggaatggattagttctcatgggaacagatcagttcccacgagagcaggttgttatgaagcgaggttgcctcttgtattttgctctttacatatgcatcaggttccccttccatttctctgccatgctttgatgcagcacaaggctctcaccagaagctgccggatgtgttgcccagtcttgaagttcctagcctacagaattgtaagctacataagcttctgttctttataatttacccagtctcagatattctgttatagcaacacaaaatgcagtaaggcaattcccatccacatccccccctcccgccgccatggggaagctaggctgtccccgacgcccagatcatttgggtactcagagttttcctcttctttctctcactgtccccagatcctgattcctaatggaggcaggatctatttgtctgtgccctagatttgcaatttcttcacatcaggttttaggtaaatttctgaaaatgagcaaaagtctgatacttttacctttcctttgcatttctaaggttctgttcccatcccactttctcagactgaattttccccagatgtgtgaatatatgtgtcctaattgacttagcccagcccctgagtagtccagatgcttggttgccccaccctttcccctgcttcacagtagctgcctctgttcccttttgtcctcaattcctcagtttccaactaactcctccacccctacagaaactgccactatccttatctttacccacaatatccctttgtcctcagcatattgcctggagctgggctgccagtcccagtgtgtttgatcaattttgaagggcctgttttacagtgatgctgatgaactagaaaccatcctgaggggtggctgctgcttatttgtaaaattggaagccacttcacattaggaggggtttaagaaaagacatttttagactagaaaaatgaaactcaagtctttcatataccatttgaaggataccatgtaaaggaagaaagtcattctaggaaaaaacaatattactaggaatagtggaagggaattctaaggaggctcatttcagttcaggagattcttctcgtaaatgattagagcagaaagagatgcctctccaagtaatgaatttctcttttatttaatatttaatgttataacacagtatttgtagaaagaacagctatgaagccattctccaacctgagaagtaaaacattaccacatgctcttctctgaacccatctctgccccgcttgcctcccagaggaaagcatagtgctcaattcttatcattttttggccacattatttattcctaagaagtgtggtgtttagttttttgaactttacaaaaatggtattttactgcttataatcttctgttatttaaaaaatatatattttatgcctaagattaatctgtgttgcatgtagctgcagtgtatttatttcaattgcagataatattccatcatttatttactcattctcctgtcatggagcacacgtggagcacacaggttcttccaggtttttgctagttcatgtgatactgctgtgaacatttttatactttcttctgtatatccatgtataagattggaactgctggatttgtaaggggtgcatgtctttaagtttatgagataatgccaaattgtttttcaaaatgtttctgctaatttatactcctctcagcaatggtttctatcgtgcagcatcctcattgacttttaattttgtcaaaagttttaattttgcccattttgtgattataaaatgaaatgctattgtggtcttaattagcagcagtgttctctgattacttttaaggtcttaattagcagcagtgttctctgattacttttaaggttttttatttatttattttctgttttgttttgtcttgtttagaaataaggtcttgctaggttgcccaggctggcccctcaaactcctgggttcaagcagtcctcctgcctcagccacccaagtagctgggactacagtcatgtgccactacacctggcttatttttcgtttttgttttctgtcagatgtctttttgtctcatgctcattttcctacttggaaatttgtctttttcttactgattttcagaaattcttggtagttgaaataataatcctttttaggcatatgtcgtgtctcagtttatggcttgtgttttcactttccttttaatattgttggatttatcaatcttgtctttatagttaatagtttttatattttttttctttttttgagacagagtcttgctctttcgcccaggcttacaggcatgccaccatgcccagccaatttttatattttttatagagacaggatttcactgtgtttcccaggctggtctcaaactcctggcctcaagcaatcttcccacctcagcctcccaaagttttgggattacaggcgtgagccaccatacccagcctcttcagttttcttctaaacattttaatgctttcttttctctttcaatttttaatcaagttggaaattctttctgggtttggcataagacgggaatccattttactttcttccgtgtgagtaacaaactgtcccagcaccatttagtgagtaatttaccctttcttcagtgccattactcatgtacatgcaattgtcagtttgtgggattctctttcattccattgtttaagctgtctgtcctaatatcaaagccatgctgtctgtattactagagctttggaataagttatagtaataagcttactattattaataagtaataataagccttgatatctggaaggataggccttcctcgatttgttcttcaaaatttcttgtctactcttggacctttgtattctttcatatacattttagaatcaggttatctaatttttgaaaaattctggtaagagtttgattgggattacattaaatttctaggccaatttggagagaactgatatctctgaatattgaatctttgaatccatgaatatggcatatctctccatttcttgggtcttttcaaaagtctttgaatacagttttaaaattttcttccagggccttggtcagcttttgttgggcttcgtcctggatgcccttcctttttgatactataagcagtatatatattcagattgtttgttactggtgtttaaaaatgctgtttgtccatttttgtatagtgctcttgtttacagcagctttgctaaactttcttattaattcacagaatttgtctatagacttttacaagcttttttaaccagataattacttctgctaaaaataatgacagctttatttttcctttccaaccacgtatcttttctgtttaccttgttctactccacttatgagagcctccttaatgttgagtaaaagccgtggtatgggcattcctgccttgatcctggtgtttaaaggaaatgtttttaatacgtcaccgtaaagaaagatgtttgttataggtttgttggagatatcaggaaaaggaaattcctttctatctccagtttgctactatttttttaaatcattaatgggtattgcattttatcatagttttttcctgcatcttttgagctgtcagattgttcttcacctttaatctgttaatgtagtgaatgttaatgttaaacattagccacctttgcatttcaggattaagccaccttggtcctaaataatagttattttttaatgcagagctggctttagtttgctaattattttatttatttatttttttgagacagagtctccctccatcgcccaggctggagtgcagtggtgcagtctctgctcactgcaacttccacctcctgggttcaagtgattctcccgcctcagcctcctgagtagctgggattacagcgtgtgccaccacacatggctaatttttgtaattttagtagaggtggggttttaccatgttggccaggctggccttgagctcctgaccccagttgatccacccacctcatagtttgctagtttactaatatttttatattcttgatttttgcatttatgtttatgagagagggattgcttatgatttttctttgtcattatttgctggtgttcacttaaatatatactatttcataaaatgagttggtgagtgtttctttttcttttctttacaagcatttatttataacattgttatcatttgttctttaaaactgtcggaattcatctatgaaaccattcagggtctgttgtttcctctgtgggaagattttttaaatgactgaatccttactagtcataagcctctttgggctttcttttcttctcagataaactttgctactttgaaattttctagacatttatcaatttgagccaagttcttcagcttattcacataaagttacttatagcattcttttatccttcaaattctgctataattgtatcctttttaatttctaattctgttttctcatttttttctctctgttaatcttggcagaattttgtccactttatcactgtaatcttctctcagtgtctaagcaggattggttcctgggccactactccccgccaacgtggctaccaaaatccttggatgctcaagtcccttttatgaaagggtgtagtatttgcatttaacctgtgtacatcctgctgtatactttaaatcatctctagattacttataatacctaacacaatgtaaacgctatatagatgctgtattgtttagggaataatgacaagaaaaaagtctgtacatgttcgatacagatgcagtttttttccaaatatttttgactcatggttgattgaatccatgaatgtgcaaccctcagatatggagggctgactgtattttcaaagaaccaatgcaaactttgtttatcctattttgtttgtttcagtttgttacttcctacttttattattactctctccttcctccatccttgtttttttcttctgatttcataggcatttatctaattcggtttctgttttatttaacataagcatttaaattttaatgctttaaatattaaatgatgtgatgaaatgttttagctgaattctgtgattttaatacaaaatatttttaaagttggtaatttccattgtaatttcctccttaagcaaagacttgtttagagctatagtttaaaagttttaaacctttgcaggggagttatttatctttttgtttctgatatctaattaattggtctatctggtattgattctttgcagtttgttaatatttattttatggcttcatgtgtcatcagttttttagaaatgttccatctgtgcttgagtagattgtatatttataattgttgggtctgcggtttcatactagtctggtaagtcaaccttttaattgtattgtttagatctttgatataactaattttttgatatagcaaaaatttagaggtataagtcttctaccatgagaatgatagatatataatttccccttagttctatccatttttgctctctatattttgagaatattttattagatgcataaaagcatagtttccccgatgaacaattcctttcttccttatatgttatcctcttaatctttatatgtttcttgttttaaaatcttttttttttcctggtaattttgcaaccccagctacattactaatcaccaaatatagccaattgatttttgagagaacctgatattttttgtatagttgtgtctattagccactacactaaaatgtttactgctctagttgtctttctcactgaatatttttaaagcgatgttaagagaagttaatactcactctcataattttttcttatttagtcctttctggcagtctgtgaagttgatggttggtacctagttgtccacactgtatggactaactgtagttactgtgattccttaccctggctaccttagactcagccagggtaggtaattttccaaagatcacacaataataatgaggggggcaatagatctattagtttcaccttagaatttccttaaagttcagttagagttgatcaagtcagtattataacattgtgagtattttctttttccaggtattttctcgttaaaaattcctcaatatgtatcgcctaaacttctgacaatgtgtctcataaaatggaagccccatatctactttaagtgttatttttagaacagtaacattctagtgctttcattgtagaatttttctgtcctgcatcattgtaagatttagtttctcgccttagtttgtgaaagtcagcccaaggctaaaattgcttaagttctatcttcaaggagacatacatacttgtaataaatcttctcctgtcatcctctttcaagagatgtgaaaaagcatcgaaggtaaacatgacagtgcaactagcattagattaactttggcagatttaggttgttttggaacttttcttactttcagtgttaatgcttctcaattatgtctagacaaaagcattgaacagggaagtagagatggatctgagcccggccccaccaccatacacagctggctttagaccagtcattgaacttgtctgagacttttctgctcctttatataaaataaatggaataaatatgtcaaaattaaaatttagcaagcctccatacctgcctcaaaatttttggacaaatttaataatggacgcaaactgtaaagcacagtattattggaatatttttagaaaaaatggaagttggatccctatcacacattaaaatgtttagtgttgaaccctgcaaaactcaaagccatctgacctatgtttctttaaaccatcggtgggtctgtgataaagtgtaagcatttttaaaggttttttaaatcttagatcatcttatttagtttgttagaaaacactacttaaaagtaagtgaaaagtagtatttcctgtggatttaggcttgaggttttgtctccttgggcctagccaacatttttattttattgattatgtgccatctggattactggttatatcaaaacaagctagttgagacatgcaatccagttgtttttccattatagacacgtgaggaaatgcagtgctgtgacacacagcttggggtgggatgggatcagctgggaaatcagagctgctgcttggcagcctggtgcctggctttatgccgctgaagtattttcttgttttggatgactatgtttcaacaagttttctgtcattagacctatcacgtgcccagggacatcagcagtaggagttctctgcttcaggatgagttgaattaccaccataacaaggacttgtaccagagattgtcttacctgttaatatatatgcagcttctcaccacagtacattttctcaatggtcataagtaaaaaaggtattttatcacagtgacttagctctgtaataatttgataccaaacttttaatgtaatgttatttaaattagactagtgagattgtgaaatgttagagaatacttagcaagtttatgagattacatgcttacaacttaagctcatgacaaaatattcagagaattcaggtgataactatgtttaccaaacatttgtattttttggtgttatttttagaatcattccaaaatgctgtgctagcttcatagaatgggaaagctatttgttttaatgtttttgttcctatgcgtggtcaacaaacattgccacttttgtttaccccaaggatacagttgacaccttcctctctttggtaaggcagtatagcataggctgtggacaactgatgcagtgtttggctcatatgaagcactcagtaagttagttattaatagggtgacaatatgatctattgtccaagccaaaccccttttttggtgagagagggacagggtctcacactgtcacccaggctagagtgcagtggtgcaatcacagctccctgaaacctcaaattcttgggctgaagcagtcctcctgccccagcctcccaagtagctaggactacagggcctgttatcatgcccagctaattttaaatttttttgtagagatggtgtctcgttctgttgcccagcctgttctcgaacattcagcctcaagcagtcctccagctttggccctccaaaatgcagggattataggcgtgagccaccgtgcccagctccaaatgctgttaagaaagaaaggagtgctattattgatcacaccaagatggcagtcataacgtaggactgtcatgcccacctccatgtgtggtcacccaagctgtgacagcattgagaaagtcagatgtttcagatgcagggacctgaatttcttctattcagttaatacattttagaagttcattaactaattgtcaccttattgaaccttcatactaattttgtggcagaggtatttttatcctcattttacaaatgagaaaataggatactctgagattttgttaggctaagaggcaaaagagtagcaacagcaggatgcctaactcacacccaagccttcgtctttcacacagtgctcctccttacagaccatttttctgcttgtaaaattagaacaatttaagtttgctcatctttgtttttcaagtcattgtaatgactgtttctttttctaagtcaggtatctaaaactttagcacacaatcacctggggatctggataaaatgcagattctgatttaatggatgtgaagtgggttcaggattctgtatttccaggaagcgcccagcggaggttgcagtgagctgagatcatgccactgcactccagcctgggtaacagagcaagactctgtctcaaaaaaaaaaagaagcgcccagatgctgctggtctctacttgctttggacttcacatagttgggtaattactgttcttacaatccatatttaggaaaaaaaaaaaaagttgcaattctgagcaagacacagatttttaccttcttaatataagaaggaggtcagttttatagtctttcattttccctttctggctgtaaatgtgttctggcattaacaaacaatagaataaatgagcactgggagtcctctcttgcacagctgtgtgtttgggtacacaaagagggtggggcccccactccctagtgtcctttaaggggacctttcacacagcaatggctgattgtgtctcacagtctagttggggctctagaaatctaagtttaagtcattgaatgcatcatcgggataggatgaatcaattagctaaatgcttgaaataggagcatttggttacccaaccgtagtacagccttgcggggtggggcaatgtgaggcaaccactccagggcttttaagtcagttctttttagtttataggcaactttagcatattagacaggctgcattgtcttgttatagtcatatagtcaaatcttgagtttttaaaaataaacacagaaattactgttttaaatacagtggtaattgtggaaaaattcaggttggattattacagtaagcacattaggtcactgtagttaattactggcatattatattccaatagtagaaacaacatttctaccattttcctattttaaaaaaccacccacgatgtttgatctctgcttttgaaataccactgttacggtagtacaaatggcaccatttattgttagggtaattgcttttccaacactgtgaatgattactctcttctaaattcctttattgctttatctgcacctcttttgtggctcttggtgcattttcccatgctttatgaatcctgaaatacatttggcccttctgtgtccacacagtcaactaaccatgggtcaaaaatacttggaaaaaatagtaataataacaacacaattattaaaatgcaagtaaaaaagcagtacagtgtaacaactatttacatagctactttgtattaggtattacaagtagtctagacatgatttaaagtatataagaggatatgcatctaggttatctgcaaatactatactattttataccagggacttgaacatgtatggattttgttcttggaggaaggtcctggaaccaacccccctcagatactgcaggttgtacattccttttctggttccaggtagcaggatcaggtgagattcattgtgtattacccagctgcttagtaggatgccttgcacagggtgggatgctcggtgaagatgagcccagagagtcttgtgacaggtctcacctgcttttcttgctctgtcttctcttacagcccatttcgtaagcacaggaggcagccagcttcaaaccagggctcatttggacttggtgggattctatagtgacaaaaaaaaatctgcagatatttttatgaaagaaactaggaaggggcataaattatctgaagtataaagttcactcagtaaaaattgctttgaaataaattcacattaacataaattctcaatccatgtttaaaatagtctgcccttgttaagggatacagattttatagaaaactgtttctgaacaactctatagtaagatagtttgtaaaggttgcagattgcaaagctttactgagggtataactagatttactattgtatttcaataaaatgcctccataaaaataatagttgataggtgatatctgaaaaaataacagagtgggaatctccctcttcactgtggaaaaagaaaatgttgcaggagggaaatgtggagcttgcagttggtattatttggcgtttttcagtatggaggcagtgttggatgctggctatttttcttctgttttggagcagagaaatcagaatgagttttgtggatctgctaatgcattgaggagaccagaacatacagcaccttctgtgctctatccatttgttccctggccataaggaaaggcaaattagtgtgctttcatgagctccatcaactttcattccttagaaatgcacactctgatggggcattggaactggctcaggcaccagagcggcaggacaccctgcaggcaagttcccagaatgtctgggggctgtgctggcctgggagaggcagagccaggtgcgatggagaagagctgaagagaagctttctaataaagtgggtgtaaatataagactggaaagaagctgtaagatagccagaataacagctgtatttattcctttatttctttacgatgttttatttataagaattctttcttttattagtgaaagttacatttaattgctttaccaagtcattttccaactagtgttgtacatattaaatcacctgattataaaagatgtatggggtggagggagcaggtgttctgtgctcaaataattttggaaaatgggtgtagcattaaatgggtttctataaaggtaggactacgtataatttaatatgctaataactggaatccccaagaaaggtgtttacttgagtgaatttcctagacaatctgacctgcttttattgttggctcttctaccacaggcagggcctctgttcagtcaacacaagcacgagagttggacaacatcaagggaaggccaagtaacttcactcaactggattctatagatacaaaattaagagtgctcgaagagtttctcacacttaacccattttttaaatgacacatctgtaaacctcattggggagacatgtacaatatactgtgtgtagaacacttggaatgaaaagaggtttttttccttttttttttttattgagatggagtctccctcttgtcacccaggctggagtgcaaggatgcaatctcagctcactgcaacctctgcctcctaggttcaagcaattctcctccctcagcctcccaagtagctgggattacaggtacatgccaccacacctggctaatttttgtatttctagtagagatggggtttcaccatgttggccaggctggtcttgaactcctgacttcaggtgatccactggccttggcctcccaaagtgctgggatcacaggcatgagccaccgtgtccggctttttttctatttttttttttaataaaaagtggagaatttacgctgtatttcagaccaaatgtatataacacatagagatttatagttctctatctaaaacttcgggattagatgttttggaattcagaattttctggatttttagaaaattaatatggtttatgagaagaaaaaattgcaacaaatttggttatagatccgtttgacttttatatgtgattcatgaattaggcagcctctattctacaaagtagaatgaaagctacccctgggcaatagcagaagagtgggctttataaggtgggaacaaggaaacagaacaccagaaaaaaaagccgattgattagcatcaggttcctcttttgtaagcgttaaagcaaagggagcttccatatgacactgactcaggtagactgcgatctcctattttcaggaaacaccggactgtatgggatctacctgcttctctaaaactttggtttgattgtgtggcatttagcatgagtgactccatttggtttggttttgtctactggggcccagtgtaggagctcagtataaaacaatggcctcccataatttttgtttaaccttatactgtggatgttgaattaaaagaaatgaataaacctagctagttctggtagagtacccagtagtgaaacacattcatatttctgcatattcacgaagtgtaagggtaaatatttttaaaagataaatactttacaaacttcacatttgtccaggtcaggtcttgccatctaatgttttttttggtcaaatttatgaaaactttccagtcttcagaccttaacggattatggaatttcaggtaagggatctagaccactactcacagaaattagaatgaggcacatcattgaatttccctctccgctgttacatttagcctaaagctgccttacatattttaaattaggcttaaagatttctccatacataatgaactctaaccttactagaggtataaacagcctgtaacctacccttgtaccaatcacagagtttcagccaatcacaggctgttcaaaccttgttcaaataaggcaaatgtgaactgtaaccaacccagctatttctgtacctcacatctgttttctgtaggtcattttcctttttctgtccataaatattatcagactatatggcagttcctgagtctctctgaacctattctggttccagggactgcccaatttttaaggtgtcctttgctctgtttaactctgttaagtttatttatttatttattcatttatttatttttattaatttttgagacagagtctcgctctgtcacccaggctggagtgcagtggtgcgatcttgtcacactgcatcctctacctcccgcattcgcgttccagcgattctcatgcctcagcctcctgagtagctgggattacaggcacccgccaccaggcccagctaatttttttttttttttaagtagatacagggtttcaccatgttggccagactggcctcgaacccttgacctcaagtgatcagcttgcctcagccttccaaagtgctgggattacaggagtgaaccaacgtgcctagccaaactctgttaaatttaatttgtccaaagtttttcttttaacgctgcttagctcactgcaaaacccagaactaagtgtatggcccaactgtgacaatgacacggagttacaggaaacatgttttaatgtgcctaacctcaattctgacctcattttatttttctgctttcatttttccttatctaacttcctcatctatcaattgtatgctaattgtgtattaaatatataaattatattcactgaatgttttattgagttattaagtgttcattcagtaaacactgaatgtttactgatccttttgtgggggaacttgttgaagtatcagtaaaacaaattttggatggaagtgcctttgccatcaaggggcagcatacctgaatcacaggatcgaattttgaggggtacacaaacaaattgaatcaacaagcccgacgttacacacctgcagcatgcctcacagactccaccttcttgtgatgcaggtatcggaattttaatgcttttgagggcaaaggatgatgttttattgttcttgttacaggaaaaattattcatgaaagttattaaagaacagtaaggcagactttatcggggggctactgcagtgaggtttggtagtgggggagagattctgctcaactccatattcaacaaggaaaagtggagatttatagccaaggaatgagggagtggagggagttggaggataaaaaattactaaggtgaggaaagggggattctcactcgactgaccaaactgcttgagacagtgctcagctatgctgtctgtcatacgtgccaaagctttacaagtttcttcatgatagtctctgatggtgtgtaattcctgacttaaaagcatagttcaccctttgtaaagcttttctgcctttgtgtttggtttggtttggtttgatttttctcctttggaggctaagcccaaatgatattacttaatgaaagtctgaactgtttgggatttgcccatccacctaggatgcagaaagctcgaaagagcagtgctggcaaccaaccttcctacaggaaaaggcaggtagaatgctaacttttctcaagctcatagggaagctgaggtctcagggccctcgaggtgtctgaatccaaagagatacagatggctcacctgtggcagatcatgggtggaaaggttgactgccgtacaaaggggtaagaagagatcagtaacactttagcgaattgttagagtcccagtgtggactggaatatcaatctggaatatctgagggccctgatactggaggagtttgcattcacttgtaggccattttctgtcggcctcctctgggtgctcatgagagcagggtgggaaagcagacaggcttcctccgtgttgtaggaagtgattggctgctgctgcagaaatagcagaaaaccctgactccctgctccaagataaagctaatcaataaaagcaaactgaggaacttgaaaataactaacaactagaataacttcaaagtcactgtctgtcagggacttaaacaaccattaaaggacaagacggaaaacatggataacatgtatgaacagataaggagaagtggaaactacaaaaaaaaactacagtcaaatgcaaatgtaggtaataaagccacgatatcacatatgaagaattcctttgagaagctcatccatacactcgatgaaactagggaaggaatcagtgaatttaaagatagattaggtcagtagaaattatttaaactgaaatacagagtggggaaaggagtaggggatgggaaacaaaaacaaaaccaagcatccaagaactctgggacaataccagccagtgtaacatacatgcaattcaagttccagaaaggaaaagagagcaataacaaggccggagaaatatttgatggcataataactgagaatttgccaaaaataatgaaaagcacaccagagatccaagaagcttcaagaatcccaagcaggacaaacaatcagaaagaatatacctggatacattgttgtcaaacggctggaaaccaaagataaagagaaaaccttaaaggcaaccagggcagaaaagacacattacaaacagaagtaataattacagtagacttttcgttcaaaactatgcaattctgaactatctagacttatagcatgagatacatttgatcgtcagaagagagagattttctgattagtgccagtattttataaatatgagctagaacctgcagatgaaaaactgactcattgtttgataaccagttctacttaaggtggagaaaatattttcaaaaagtgagttaatgaccaagttttatggcagatattgaaatatcgaagatattaatagattactagcacattactttatttcattgtggggtttttttgtaaaccttaaattaattaccaggttagagaaagcatcctcttctaaagccgggtaatttgaggaggcgtacattttgggttcaagataatcggctattttataaatgaaaaaaattaaaaataggcctggcacagtggctcacgcctgtaatcccagcagtttgggaagcccaggcaggtggatctcctgaggtcaggagttcgagaccagcccagccaacatggcaaaaccccatctctactatacaaaaattaggcacggtggtgcatgcttgcaatcccagctacttgggaagctgaggtgggaggtatcacttgaacctgggaggcagaagttgcagtgagccaagattgcaccactgcactccagcctgggctacacagcgagactctgactcaaaaaaaaaaaaaaatcaggaaactatggaagtacattccttatttagaacttgattgttaggtgctacagagagaaaattgtttagctataattcctgtcttctaagaatgtatagatctgaaacagatcacatttgcagagtatgtaaataacacagtaaaatgtaaataaagttcgtcaaagtcagtgattattgtattatatagtgcagcagtagtagtaaagaataccagctaccatttattcagtatctgtgttaaacctgatgtattaacattttaaaactcattatcttgcttgattctcatcctatgaaaagataatattaacattttgcagatgaggaaaatgtggcttcacagttcagtaagttgcccaacatccatgccacttagctggtaagtagcacagttgggattcaaactcagttttatctgatgctccttactgtgctacagtgaagcgcaatcataggaatttgaaatgcaggcagattttggtgttaaggcaggccatgctctcagttctactgtaatgggttaagttcatggaacgaatggtatttcttgattaattggatattgtgaagcagccatttcgatggtcaggagttagaatgttagaaacagcctgaaaggcccaaaagagctctccagtcctgatgtttcttgcacagttgttctttaccataattagctaatataaacgttcttgatttatagcattcttaatatgctggtaggattctttttaatttttaataagtatgggaccaggcgtggtggctcacacctgtaatcccagcactttgggaggctgaggcaggcggatcacaaggtcaggagatcgagaccatcctggctaatacagtgaaaccccgtctctactaaaaatacaaaaaattagccaggcgtggtggcgggcgcctgtagtcccagctactctactcgggaggctgaggcaggagaatggcatggacctgggaggcggagcttgcagtgggccgagattgtgccactgcactccagcctgggcaacagagcgagactccgtctcaaaaaaaaaaatttgtttttaataactatggtagtgtccatatcctcagaagaattgagaaattatatgtcagtgtgagataggagatttacagatcagtgaaagggagtattttctgccttggaaattatggaaattgaaatagtatctggtaaaacgtgcagctgataatatggtgaaaattatttatgatgcctcagactttggtaaattttcaaattcaatataatgaacataattataatattattcaaggcttagatgttttaaatgcattttcatttatacatagttgctcattacctatcatcttagatatgttaattctgtttctttaatgtagcaaatgtgagagtcttgtgtttaggagacaataatattaaacatctgtgctgctctgtagacttaattgcttttggaattacagcaaaattgaattacagtcaaccttctgtatctgtgggttccgcatctgtggattcaaccaacagcagattgaaattatttgggggctggacacggtggctcatgcctgtagtcttagcccctcaagatcttggctgaggtgggaggatctttgagcccaggagttcgaggatgcagtgaattatgattgtgccactgcactccagcctgggcaatacagtgaaagcctatttatgagagagataggtatattttatatttttttatagatatacataaatacgtatttatatgtatatatatttggggaagaaaaatggatggttgtgtcggtactgaacatgtacagactttttttcttgtcattattttctaaaacatacactataacaactatttacacacgaggtgatttcaaatatacaggaggatgtgcataggttatatgcaaataccgtatcatttcacagcagggacttgcacatctacagatcttggtatccttaggaggtcccggaaccagttcccccatgtataccagggaacactgtagttcaatattggttatcatggccgcgattggcaaagcaatatttacagaagaaaatcttgaccaggaaacatttttaaatttcagttttaattttgaaacgttgtttatttttaaaaaataactttagatacaactttaaaagaaaatcagtttgtatggtatttaagtttttttttcaaatttgttatgttttaaaaagcaagtattttctaagagaataagcatataacttcatttcaattaatacacttattaattccagttgactaacaatcaaactagtttttttaaaaagaacatttacttttctatgtatagcacacacaatatgtgtattttttatttgtgatttgatgagttaatgattctgtcctctgcactattctactaggattgtacttattctctacttatgtgtttctttacaagtgaatgttttttgtattacaatgtatagtagacattgaatagataattgggtacttaactttttattttgaaatagttataaattcacagaaagttgcaaaaacaaaaatgcagagaggtcctatgtccccttcacccagttttctccagtggtagcattttttgtttttttctaaatacgtattttctttttttagaggcagtgtctggtttgctggtagggaagaaagcctaatggcagtgagcgagggacggggagagtgaggcacgaccaactgcccatcccgtcatggtctggaactcaagtttccagagtttctctggggtccctttggccaacagggggtctgttcagtcagttaggggctcagaatttttttttttatttctcagggtggagatgggacccagcgtggctcagcttcccggcttctccaatggggacctcctttcctgtcctctgctggcttccaccttctgccaacagccctgttctttcctgccctttgcatgtgctgtttcttctgcctgaaatgcttctttccccttcccatccatccttctcttgtctagttaacacctattcatttggcaaatctcactcctacatccatcaagcctttcagggtcacagctcacataccgtcccctacgggccttttcttccctgcacgcgttacagttagtaactgtggaattggtgcttacgtggagaatgctagctgagaagttttgggggcagacacctgctgttgcccactgtttgtgccccttgtgcctaatgcagtgcttgcttacatggtcttcatatgtgttagttaaatgagaaaatattgtcacagctcaatgggttcttcttgcccactgcccagaaaagctaatgcaccgagaacagcaaatgttgcaacaaacagtttaatcatagcagggccagctaagtggaaaacagaaggcgtttctcaaatccacctccctgagaacttggaggctagagtttttaaagatactttgtcaggcaggggcctggggaactgaaacagttgataagctgtggatgaaatcacaggagtgtctaaactgcacagctgagtctgtttctggttgggaggtgggtctcaggaccgggtagcatctcttggtttgttgaaatgctaaatctgaaaaatatctcaaagaccagttctttaggttccacaataatcatgttatttacaggagtagctggggaagttacaagtcttatagcctctggctatgtgactctggtagtgagcaacttatagaaaagcaagcttagcagtggcaggtgattgtttaagtgtatctattgtttagcaaagtccaggcccctaccataattcaaatccagcctcaggaatgtggcttcagtccccaaacaagcaggaaggtcaggttttctagcctcaaagtttaactataaaccaaatttttcttatagttatcttggcctctgcactagaataagctaaagacaatgtagcctgagaggttagaagcaggatggagtcagtcatgttagatttctcttcttattacttacaattctgcaaaggtggtttcagtgtcattcttccacatatactttttttgtaaaaattattaaaacttggtgaagcatgaaaaatcttttaaatgtagcatgaatcctgtcaacaatataaaatatgatataaagtaaggtttaaagaaacgtgaacattttgacacaatctgttggcagatatgacttaaataaatcttgactgttaaaaatcctgtttgaggaagtatttctttcatacaagatgagcgcccctggtgtcagaaagccccaggcctgtgacctgtaccagaattcacactatgtagctttctcccatctgtgtcttagctctttaaaaatattgtcttttctgcctagtttacttctcttgctgccaaatggaaagagaaaaggctgtaggtttgtcatctgagcagtcagcagattctatgtctttcacttaagaagccgtttcctagcagttcttctattagttcattccttcacaaatctttcctgagtgtctgccgagtagactcctacaaagcagtggctagtttccgcttccagcagacagcccacgttctcattcacaggtggttaatttatacgaccataccactgagtaacttgccattggtctttatataatgtgtttctctttagaggggcttttagcttaattaggttgtaaatcggtatctttctttaataaacatcagtattaatgattttaaagtagagtaagattgaggaaagttcttgttcaactacattattaatttatttctaagaggatctgtatgttatagggttaggcctaattcatctcaaaaagaaagccttaaatcacatagggacattaaactaagtgtccaagctctacagttctttcagattcgaaaagaaaataatctgcaatacattattatgactatttgttaggatgtcagtttagctttaacactggcggacactgtgaattaccatttatttcttgacattttcatcttttagtcctattgtcagtgattatatgcacttaaaagtcaagagagtatttgaacaggcactcactaatagcaaaggaacagaaaaagtattccctttgaggttttaaatagatttttaaagatcggcgccagtgtcttagttccacgtaatcctgtattttcatgtacaaacccttatttgacaattaccactttttgaaattaaacagaatgtctttattcatgttgtcttgccaactaaaatatttaaagttattatttttaaactataatgaaattctattactcatgttacatttgatgttatttttaaatttcctggcttatacatagtgcagtgacttattacgcagtttactcacatatatattcttttgttttatcaagccactgccaaaaaatatggtgtctcgtctttgtgaatctaaaaaggtttgtgctgcagctgatatgcaacttcaggtatgtatgtacctttgttctgaagttttccggagtcattatcccaaataaatatataactttacattcttgccaatgatacctatttattataataattatgcttctaaaacatctttcatctgagttcaaagaacttgaccaaaattgactcatttagtcctcacactgcccttatgaagtaggcgttgaataaaattatttcctggccaggcacagtggctcacacctgtaatcccagcactttgggaggccgaggtgggcgaatcacgaggtcaggagtttgagaccagcttaaccaacacggtgaaaccccatctctactaaaaatacaaaaattagccaggcatggtggtgcatgcttataatcccagctactcaggaggctgaggcaggagaatctcttgaacctgggaggtggaggttgaagtgagccgagatcttgccactgactccagcctgggcaacagagtgagactctgtctcaaaaaaaaaaaaagactatttcccgttttcagttgggaaaaaatgaaagcttagaaaatttacacaacttctaaatcacacattttgccagctaaattaaggctcaaacttaattttatatatacatatgtttattcattttgtatctttttaaaatttttgtgtttttaggtttgaagtttagatagtaattgctgttagttttagataatattcaaaaccaacttcccaggttttgagatgaagaccagaaaactttcatgaaccatctggatgccaggtctgcatgacatcagatgcgtagatgtttgtaatgactgagattgttatggaattctcactcctcttcagatcttgagagttatgtaaacaccttaaacacccatctttcatcttaggcagtattcactttatgatgattcagttacctgtttaacaaagtaatcactatttaattgctttatagttttgtaaaattcagtccctagaaggtaataaatgtgctctgtttttctgtaccttcaaacatgaaatacatgtttcagtgaaggaaatctattatatagacaaaaccgtgaatctatatttgctttaccttactcagtatctattcatatcaatataatttttaaaggatttctgagttatttttaaaaattaacattacttggcaaaagtcttgatttgctgatatctttagtagaaggcctggcttttaaaagtctgttttgtggctttcttcttgaaaaagtgttctgataattttcttttaaaatggaaaaccaacctttccctcctccgccctccaaaaacaatagccccctagagacagagagaggcaaagtcctggtagaggagctgcctgggttcagcttttatattacacttggacagtggagatgaacacgggtggaaaggaagtgaattgtttcaactttctatggggacataaacagtgtttttaaggccagatgcggtggctcacacttataatcccagcacgttgggaggccgaggcgggcggatcacgagatcaggagatcgagaccatcctggctaacacagtgaaaccccaactctactaaaaatacaaaaaaattagccaggcgtggtggcaggcgcctatagtcccagctactcgggaggctgaggcaggagaatggcgtgaacccgggaggcggagcttgcagtgagccgagatcgcgccactgcactccagcctgggcgacagggcgagactctgtctcaaaaaaaaaacaaaaaaaaaacactgtttttaaaactgtacattttttaaaattattgttttaaaaataggctcttcatttttctgtgacttaataagtttcttggccccaggaatgcatgactccctgggtaggcagataggctcatgtctttggaattgtttagtttatcagcaaataagcataaaaagaatgcacatttaatttattttgctctgttttcatatttaatttattttgctctgtttttataattcaaaaaagttaccccatgtttatatcattttgtaaaaggcataattgaagaaatgaaactcttgaattctgatttatttatacattggggcaaaataacacctcagttgaggttagaatgtaagagtttcagttcctgataatttactctgttagaatataggtaagacattgagtaattttggcctccctgattatctttatgcatcgttactcattataaaatgtagaattgaaagagctatatttagctatatgtttagattaccagttagaagaaagcaatatttatatttaggaaatgtctgtatttttctagggaaggtttaaacttaactttataatttagaaccataattctatatctagatgcagccagaagccagaggtcatttaaattttctcttttaaccaaactaatcctcacttctttcaagtcaacagctgcacattctctacaaatcccatttctgaatcacaaagatacatatcagaagcataattgcatgtcaaaatttgtcctttaaaataaagcattttctacttgcctgcatgaagtcaaatgttcaagtcagtgttgaaaaacaatatttgagtcagatgttgcagtgaaaaaatgctttatgtttattttagatttctttgcaaaatttagttttcagtactttgtaaacagcagatttcatgtccaaactttctttaatgctttcttctcccactgtgtttcagtggcctatatcctctactcagaggagagtgctccttttcccctggtcatctagttgagccctccctatacagcagctgcttcctttgtacttcctgacaccaggtgtgggagtctagttccaacctctccaacagctgcatcagaattcttcgatacatctatactcacgagatgctgcattgctatttctttctctacccccaccacacctatttaattttctttcaccttttatcacaaaactagaattctgaccgtttcatttctctcatttaagatatatcaggattccaggaggaaaccaaacaacatttgttagatccagcgggtctaaagttgtaactggttttgtatatttctgcctacagatagatagatagatagatagatagatagatagatagatagatagatatagatttttttgttgttgttgttgttttttgtttggtttttttttttgagacggagtctctcccaggctggagtgcagtggagcaatctcggctcactgcgagctccgcctcccaggttcacgccattctcctgcctcagcctcccgagtagctgggactagaggtgcctgccaccacgcctgtctaatttttttgtatttttagtagaaacgggatttcactatgttagccaggatggtcttgatctcctgacctcgtgatcctcccgcctcggcctcccaaagtgctgggattacaggcgtgagccaccgcgcctggccttccgtctacatatattttggcaaaattccagttttgtgtcacatatttgatttgctgccattgtacataaagagtatcttatgggtatggttcaaaattctttaatattcttatttatgaaaaggttgagagcattccttttaatctttagcatggtcttaaatgtggtatgaaatacatttcaaaccatgtaagtttatttttgtgactgttttcaactgtgattggtaactgttgttctggtgcacttatagcatctttggtcaaccacatcttgatgtgaggatggacgaccaaaactaagtagatgtttttatctatctaggtcttttatgccactctggatcaaatctaccatgggaagcatcccctgaggaattcaaccacagacattctcaaggaaacacaagagaaattctatggcctaccatatgttccaaatactgtgagtccagcatttggcttctgttttgtgtattgagtggttctgctattacttctgtagcttgtgattatcttcccctttggagaacttgaaatccctacatttatgttgaggcttcacatggctcaaatgctggaaattgcctggttcatttaatatttccaactacccatttatatgttcttattttcctccctctaacagtgtttttgtacctttttggaaatgtgggggttaaaaaggccattggagttggtctatattcttctttttagttatttttctacaatgtgaaaaatagtgatgtaagatgaatgtgattaccagtcctgaatcattttcattgcaaagagaattaacatgtattgagtatcttacattgtaccaggaattataatagatgctttacatatcttatcttgttgagtaccatgtcaggagagagagcaggagtaatgttaccatttattggattctaggcgccagactctatctaattcctttgggaaaagatctctaatttagctctcaaaataaccttataaattaaattatatccttgtatttggggctcatttggaggcacagacacattatatgtcctgtctgagatcatctaggtagttaagtgattgtatgggggttcaaaacaaacaggcttttttcatcactcaaaggctcgtgtaaggagcagttgagcaccgtgactcctagtgcaattaacagtgtgattcttggtgcagttagcaatgtgactgacttaatgttacccaggcctttctcagctgcaagtgatagaaacgtggttcacacggacttaaacagaaaagggaatttattgagtcttgtaactgaaaggtgcaggggtgtaggggtgtttcaagtaagttggatttaggtctcccacaatatcgttagaaatgtttctctctctttctgcctctcagctcggtgtttttctgggttcctttcattctctggcaatccccccagactgaatggtttgataactaccggtaggttcaggtcgatgtccttctagcctagttggtctaacagaaggagagctaacttgaaagtgttttgtaaactataaaaagcagaataaatgtcaagtggttttatttgctctaagattggatagcagaatatgttgtgctaagagattaagttaatcaataaactacaattgtccactaaatcttcaggtcctaatgctcaaatatgcatgggaagagatcgtatttaccagacaagtgaagcaacaggatattttatcttcataatacctcttgtcattagttttcgattggcttagaaccttaattatctgctacaggtatataatgtcagtcatactaactaattttttaatcttacatgtaatttactattctaatactttctactgccaagctcttgattatctgtgttagtgaaaatttatagtgataagaataatctaactatttattcatggaataaataataacaattgcctagattttactagcattttccagttcacagagcattgcctgattcacctgcttttgggcttgtatgtttttgttctcatcttatattcttctttgtgaatatgagttaaacttcatgaccagtaagtagtaaagtcctaggaagactaacattaggagaactgggatgcttgccaaagctacaaaacttcagtttgactgagttgcttgccttctgcccttttttatcgtaggtctaataataaagtaattatgtctctttttaaaagaaaacttccttaccatccagatttcttctctgtaatcatttaacatacaaatatgaagtattagtggcaaccaaattctgaatcaacaatccataaatcacttttaatttgaaaggaagggtgatgctaagtccgtgtgccttgtcctaattccttttgagaaaatagaaagatgtatctctttactgggattagctccacaattcacgttcagtagccatcacttgctctttgtgtaaattgttttaagaggtctttaaaagaagcatagctatgtttagagaaaaaaagacattattttaaggcttgcctttaaaaaaaagtgtctgagagtttgtttagatttgtacagatagcctactcttcctacttagaaacttctgcatttcttcatttgtttgtcaatgcattcatcaagcctataacattcccgacatcaagttggtggacttgaccaccaacttggattcaaataaagctgtaggaattaagacagtctaacactggtgtagggatgcacagatatcagtgaaacaggagcaagagcccaacggcagactcagcaaattaatagactctcaaatataggttgagtgacactgtagattattggatgaagaaggaacaattttttaaagtggtgttgtagtgattgatctctatatggaaaaaaaaatgcagccctgtatcacactgcacacaaaaaatagagttaaagaccgagatgtgaaaagtaaagctttaaattttagaagataatacaaaagaattttttctttttgatagtgtttttgttgttgttgttgttgttgttgttttgagatggagtcttgctttgactcctagtctggagtgcagtggcgcagtattggctcactgcaacctctgcctcctgggttcaagcaattctccttcctcagcctcctgagtagctgggattacaggtgtgcgccaccactcctggctaacttttgtttttttagtagagacggggtttcaccatgttggccaggctggtctcgaactcccaacctcagataatccacctgtcttggcctcccaaggctgaggattacaggcatgagccaccgcgcctggccatgatagtgttttttatacccactctgagtatcttatattttatacagatgcttctcaacttacgatgcggtcaagtcccaataacccattgtaagttgaaactatcataagtcaaaaatacatttaatacccctacactgctgaatgtcatagcttagcctagcctaccttaaatgtgctcagaatgcttatgttagcctacagttgggcaaactcatctaacacaaagtctatttcataataaagtgttgaatatctcatgtaatttattgaatactgcactgaaagtgaaaaacaaaatggttgtcaggcacccaaagtacagtttctattgaatgcatattgctttcacaccactgtggagttgaaaaatcttaaagttaaaaaatctttaagttggggatcttctagatacaatggaaagccattaaacataaagcaaaagactgacaaattcaatgatatttaaagttaaataccacatagcataaaactgacttccccccctgccttcagatggagtctcactctattgctcaggctggagtgcagtggtgcagtctcggctcactgcaacctttgcctcctgggttcaagcgattctctcacctcagcctcctgagtagctgggattacaggcacctgccaccatacctgcctaattttttagtggagacagggtttcaccatgttggccaggctggtcttgaactcctgacctcaaatgatctgcctgcttccacctcccaaagtgctaggattacaggtgtgagccaccatgcccggccattggaaaaggttatatttttaaattactttgaataaacaaaagacatggatatgcaaaaaatgacgtaaaataacttaaatattaatcagggaatgcacattaaaaccacattacaatactcctaaaatattttactatcactggtttggcaaaaaataaaacaattgacagtatcagatgttggcaaggatgtggagtcacaggaactcttatacactgcaggtaggagagcaaattggtataaccactttgcagaacagatctgtgaaatctgaatatggactgccctatgacccagcaattcaattcctaatataacctagaaaaaaaaatgttttactttctctaccaggtatacttttctgtaccaggcatgaaaaaataggagggtttataacagcacttgttgtaagtagttaaaaaaaaggtgagggggaggattccgggaagaacccaagtgattgtcatcagagaaatggataaacaatttgttcatacagctggaatactgttcagctatggaaattgagggccccagttgatgagcctaacaagcataaggtaaagtgaaataaatgaataccagatgaatcaaactagtacatttatataaagttcagagtgatgcaaaactaagcagtacattgtcagataaatacatatgtgattagactataaagaaaagtgagggaattataagcacagaattcataggagtggattcacaggagtcttagaaatattttcttaaactgattggtgggtacatggttgatgactttgtcattctttctactaatagtagacatatagtcttggtagatagaaaacacttccaaggattaaaaggtgatctgggctacaaggtatggggtatgccaagaatggaccttggcaaagctgctggtggctcaaactaggacactgactgtggggagtggaagattgaaacagacctgagaacagtgcagaaggcataatcagtgcagtgggggtgactggatatatgggttgggatgatgagcaagatccacgggaatgggacaactgcaaggctttcaacttccatatcggatagaagatgactttgtagcgccttcccatgcgggccaaagagtgacagtgttccccctgtaaacttgtctccagaaattgtttctctgaaatgaatccttttattcccccaaattaaacaatgagaaaaggaaaatataagcaacgaagagtctttataatgcttatggagttgatacaaatttaggtacataatctggtacaaacttttagacagtgattttgcatatgtctatattagcaattctttaagtgcattaataactcatcttgggaataaagtgtcgcactagttatctttgagcaatactggtttaaacaacattgagctggcttctctactgaggaaccgcttggagtctgtaatatgctaacaaacattatgagtctctatcctcaaatgtattaaccctggaagtcttcatggataatttctaggcactagctttatgtaggtcatactttggaaaattgcatttacatgactgtaactatttaataggggcagctccacagatattccatattaaataatgatgctttctttacaagtcaataaatagccttctagtgtcggcaatttattgatatttgtgtgcatgctgagtcactctgtataaaatataggctaatttgtacttacttgctattccatctaacagtagtttgatgctggaaatccaaaattttctactcatttgtgaatagagggcaatagtacaacatataccaacaggctcaccttctgctgttaccacttctcttccatttagagaacagtgttgtgttgttgtgttttttatattcatgactgtctcttctcagaatattttccctaagcgattgtgtatctctcctatttttaattcaggaaatagaaaatgtaatatttttatttttgtagcattctaggtttgtaattttacattttcaccctcctctctgacacagttgagatacagtcgtgtccggaaagctctgggatgaaacttctagcctttgatcctctgactctgttctaatgtgtatttttcaagtacaaaacatgaacagctgactctaggttttgaagatctgttaagcagttgtattttagtgttttgacctaatttggtaggcttgtgggtttgggtggtgaggctgtgtctccagcacagctgttctcagagtgacagtgttctctgaataaatcttgccaccagtgagactcctttttgccctttagtgacctcaaattgaaaacagaataagaaagttctgagcactctaagtatttacatgaaaatataataatacgtctaagaaaattgtctttcttcacaactcacaatttaaaattcaccatcttgatggcataaaagttgttcaaagctagaatgaaaaagttattttaggaaagcagttactgggactgaaggatatgttgatatttggtccttctcgttagaacaaacaccaacaaagaatatgaaaagaagacatgtttcttgtgaataggattcactccacgtttagggttttatttttgcatccagcaacaaactggcatattatagtgacaccgtgttagcattagttaaaaattatcctaggccgggcgcagtggctcatgcctgtaatcccagcactttgggaggccgaggcgggcggaccatgaggtcaggagatccaggccatcctggctaacacggtgaaaccccatctctactaaaaatacaaaaaattagccaggcgtggtggcgggcgcatgtagccccagctacttgggaggctgaggcagaagaatggcgtgacccagaaggcggagcttgcagtgagcccacatcgcaccactgcactccagcctgggcgacagagtgagactccgtcccaaaacaaaaacaaaaacaaaaaaattactctaatttgcctgggtgtggtggctcatgcctgtaatcctagcactttgggaggccgaggtgggcggattgcctgagcttaggagttcgaaaccagcctgggcaacatggtgaaaccctgtctctactaaaatacaaaaaaaaaaaatcagctgcgcgtggtggtacatgcctgtagtctcagctactggggaggctgaggcaggagaatcgtttgaacctgggaggtggcagttgcagtgagccgaaatcacaccactgcaccccagcttgggcgacagagcaagactctgtcaaaaaaaaaaaaaaaaaaaaaaaccaaaaaaattattctaatttaccctagagaggggatgagggatgtattatatgtattaatccattctcacattgctacaaataaatacctgagactgggtaatttatacggaaaagaggtttaattggctcgtggtttttgcaggctgtacaggaagcataacactggcatctgctcagcttctgggaaggcctcaggaagtttacactcatggcagaaggcaaagggggagagtggtgtcttacatgatggcagcaggagcaagagagagagagggtaggtgccacatacttttaaacaacccgatcttacaagaaatcactattgtgtcaacagcaccaacggggatagtgttaaaccatgagaatccaccccaatgatccaatcccctcctaccaggccctatctccaatgttgtggattacaatttgacatgagatttgggccaagacacatatctagactatatcgggggatttatataatctataaacattggttacctgtccatctttttgagtaggtgtgtgctgcagacttattggggacataatcagatatacctgatttgctgcagtatactcaaggtgtattagttgagaaaggttgctgctactggagactggtttctattcagactaatttctattaagtctaattatgtagaagtgatatatatttcatattaagtataattttctatgtgtaacaaactgtttttagaaaaaaactgccaaaaattgtgctgaatttagtcagacactccaaagagcaaacacacttttgttttttagcataaagaaaactatttcaaatcccaattaaaatagttgtacaataatttgctttttgtatttatattgtgataactacaaatttttaataattgatataatgtatatgtatgtgttatctttttattaagtgcctactacgtgctaccacatggtctaagcaatggatgtaacagtaaataaagtagaccagaatccttgctctcatggagcctgtattcgaaatagccttttagatgtgtatttgctaaccaattcatcattatatctggctgtcctgtcagacatctcgttattaagcaaaatagttctcaagcctatcaaattgctttgagttgtgagcagagagactgagcataaaagatgaaaagattgagacattctgatgcgtatacaactaataccgaggctatattgggatcctcgtttttaatttccagagggaggctccttccctgaaacattaatgagaaaaaggtaccttttgtgtttttgtagggctcttgcattcttcctcactcttgatgatgtggcaacctacacctatttgttgtgcatcagcaagctttcctggaggctaaagaaacaagatgaccaggcagaatagaggagtgctttagaggttcacggcagccagcagacagacctgggtgtttggtgcttgctagtttgggaggtggtgataaaagagaaggagtgggaatgacacccactgttttaataaaatgagccatctgtgggggtggggatgacgttcagaaacagagtacaggaggggtggtagctgcttcatgcagtgaggagtgcatgggtgatgaatttcatttgatgtgactgtagaatatccaagtggagatgaacagtgttgggccagtgggtccacagcccaggagacagagcaaggtgggagctctgtagatttgggagtcattagtctagtgaaggtactaactgtgggaaggggcagcagggaacagggagagtttgctgtgtaggatgaggggaaattgaggagattacccagaggtgtgtccgtcaaagggcacagactgggtcagccagtgtggttggcatgatgttctcattggaacagccttttctcaagtaccagcaaaacccaaaattttaaacattttcttttcagtttctactgctataatcacaacaatataatgctctgctcctttctattattttagggttacattggctgtatagtggcttgaaacatcacttatagaacatttgttttggatgtgtgttgtgagttcccaagtaacagaatagtgaatgaacttttagcatataacttatgtgtaatttgagggcttcccatgttaagattgcttgatttctagagaagattcttaagctgacactgctgttaccatgattatgtatgcaaaggaaagtaaccactgtaccagcttggagatggagtgcagctagtggtgaaccctgttgtttacatagtgtgctcatccggattaactttcaaacatgcctcttaaccatgtggaaagatgagaatagggagatgaaatcaatataatggaagagtgcagagagattttgagagtactgttacatttactacgtggagtttttttgttttttttttttagtagtcccaaaaagaagaaaaatttaaaacctaccatgagaaaatggcattgttatgcacaattttggtgttaatgctttaatatattattactactagagtttcttttctttcctgttctctcattcccttgatagtcaatttttgtttgtttggtttttttttgagacggagtctcgctctgttgccaaagctgtagtgcagtggaacgatgccagcttactgcaacctctgcctccccggttcaagcaattctcatgcctcagcctccccagtagctgggattacaggcatgcaccaccgccctgataatttttgtatttttggtagagatgtggtttcgccatattggccaggctggtcttgaactcctggcctcaagttatccgcccacctcggcctcccaaagtgctggaattacaggcgtgactcactgcatcctgccgatagtcaatttttaagagcttctttgttcgatatatagagcatacatgtatatacatatacacacacacatatatatataatatatgaagataggtgacatttaaacactcaagcatattaacaattgtgtgtgtatatgtatgacagggtcttgctccatcacttaggctggagtgcattggcatgattatggctcattgcagccttaacctcaaggctcaactgaccctcctgtctcggtttcccaggtagctaggactacaggcgctcatcaccacaccccactcccagctttttttttttttttggtagagatgaggtttcactatgtttcacaggctagtcttaaactcctggcctcaagtggtcctcctacctcagcttctcaaatgtttttgtgtttttaattttaactgtatatcttaaagctgttcatgggtgactttacaactttatttcagttgttaatataaaagtgtagcaccacgtattgacctcatgtagcatcaagtatataatgattttaccttaaaagcgttaattttagaatagttgataagacatgaagataagaaaataattatccattaagtgatttctgtcatctagattaaaatgtcaatcagattgttcccattagttatttttaaactaagacaggtaagtaaccgtgatcatatggggagtccttatacagaaatcttagggttgctttggaccttggctatttttatcccacacttgttcagatgttggttgaaagaatggcataagggtctgtttttaaatgtataaacaaatatattgtctattaaacaataggactggagccccaggcgggttaaatatttactgctctctctccagagtattcaatttaaactatttggtaaaaatgcttattcctcctattctttttttttttcttcgccctggggaagaagtttcctcctattcttatgccccagctctcctgcaaatggaaagtctcttccatgaggtgaagttagtgcctgggctgagctagcttggaatatttgatgttgctaagcaaacatcaggttaaagaaaacaatatttatttttgtttttatcttaaatacgaagaaagaccatatggtgcatatctagaaacacctaagtggttaattgcatgttaaatttctttcctctttgcctgcataaacaactgaaaaaatatttactttctgtgtcatgctaggtttatttatgactttgtaactaaaacacagaagtgttataaattgaaactttaatctcatgattgactcattttctaaaaatttatatggtttcagtttgtgggacagctgcaactctagatttcagtgatttaaaacatgaggaaattatgactacccggttgtttttttaatatggtcctttgagccaaatcaccaactttcatttttgtcttggttttcatgaataatgctgccctttttttcttctcggcctgcaatttgacaagctagatataaggaactaaaaatccaggctattagtagaagttatttctttaccaggtaaacttttgtatcttaaatgatgcacatgtgtcttttagatttaggctgtttctatttcaggaagcgttttctctggtaattttctgaggtaagtcccgtttttactcacaaggaatgagagccggacacagggaccattgtgatgcctctttacctttatgccttatcaccaacagggagttaaggcagcgttagcaatatgaggaaggctccagttgagtgttgttaatttttaattttaattttatgttgagtaagtaatacatatgcatgattaaaaaatcacagggtgtcaaaagctttacaatacagtctccctcctcctcaggtccctttctctggaggcagcctggggtactatatcacactgatttgaagatgaattacctcggttcaacataaatttaaagacataaaatctgcagttctcagtcacttcctcctcttaatattcttcttgccttttctcatggatagagcagctctagactggactcacagtcttcccctaatgagcgtcctaggaagtatctgctatacaactctcaaatccacacaacattagtgaggtcttttctaaatacagatttgagtgtgacgtcccttcccttaaaaccctcaatggcttccattgatcttaagctaaaggccagagtcctttgcccacttgcaagttcctgcgtggtctggtcacccaagcttcctccagcaggacacagcctgcttcctttggcactggagtcttggcacttgtttctgctgcctggagtgctctctttctgctccctttgccttctgcttgaaccatcatttctccagacctggccagcctctgttacagtctcccagggctggggtccttcccttaagatgggtcatctcagtttataatgtattgatgccatttgattcatttctatcttcccaactggagtgaacctcaaagaacagcatggctcatttctgatttgtttattgttttcccagggccctgaacagttagtagtatgtacccaataaatatttactgagaaatgtttttacatttttattgagatataatgtacataaagtacacaaatcttaatttatagctccatgaacttctggaaatatgtttgcctgtggaaccaccacccagatcaaaatatatacatctgcagttatccagaaggctcttgcgaccccctttaaagttaaccactagttttgcctgttttgaccttcatgtaggtggcatcatacagaaatcctcttttgtgtctaatgacttttatacaacatgtctgtgagatccactgtcttgttgcatgttttagtaatctgttccttttcattgctttgtggtattttcttttccagtatgccacaacttatttatctgttccactactgatggacatttgagttatttccagtttggggcttttatgaataaagttcctatgaatactcctgtatgtggtttttggtggacataaacattcattttagctgagtgaaatggggaacacttttgtttagttttattttgctatcgccagtttttcaaagtgaccatcatgagttacattccaaccagcaatatttggatatttgcttcatcctctccagttataattaaaaggatgtaatcaatcctttttacttcagccattctggagcatggagaatgatctcactgtggttttaatttgcacttgtctcatgacacccactcatactgggtgcttcttcatatgttcagaggccacttgaatgtcctctttgtgtaagttttctctaatctggatgaaataggagggtttcaaacagaggactgacagatggaatgtggaatgtaagagaaagaagtgagttgaaaattactgcaagggttttgatctgagcacccaaaggatggcattgccattaagatggagaagacggccagacatcgtggctcacacctgtaatcctagcactttgggaggccaagatgagaggatcgcttgagcccaggcattcaagaccagcctgggcaatgtagactaaaaaattatctgggcatggtggcacgcacctgtagtcccagctacttgggaagctgaggtgggaggatcacttgagtccagtcaaggcaatgagctgtgattgcaccagtgcattctagcctgggcaagaccctgcctcaaaaaataaagatggagaagactatgaagactatgggaaatgtaggtcttaagggagagcagaagatcaggaaatactaagtttaagacgtctactaaacaaaccagaaaagatgtcaaataggtagttggatgtacaagttcagaggactggtctgtgctggtgatacccatttggagtcatccccacacagattgtatcaaaaagccaaggaactgggtgagatcaaccccaagagtaagtataaatgggaacaatctgtctaaaagatgagccttggggcattccaacatttagaggcggggacagtgaggaggaaccaaaaaaaaaggtgaattgagagggagacaccaatgaggcaggaggaaaaagagggtaatgtcttggaaccaactgaagaaaatgtttcaaggcagagtgagtgagtgattgtatcaaatggtacctttagggtagaagagctgagaactgagcaacaactattggatttagcaaggtgaaggtcgttattgacttggataagaacattatcagttgagtggttggtgggacaaaggctaaatggagtgggtatcaagtaaagtgagagagaagaattggaggcagtgagtagaggcacttctggtgttttcctgcaagagaagaaaaattgaacttggaggagatgtacagataaagggaggttgtttttgtttttttgcttgactgactgatttcatttggatttttaacgaggtgaataatatgtgtaagtgaatgggaaagatctattaagactgaaaagccagtgatgcaggggagaatagacaaggggaagggatttttgtacgggtggaggggttagcccgtagagcccgagagcacagcctaaccgtctttagggtgtgtgaacaaagatgcaagcagtgggtagatggtgttgtggaagtcctcttccggggctttgctcagtcaatcggaagcagggcaccagctgagcatgcaaatggggcagtgctgctggcatttgaggagagaggagcaggtataaaggagagtgggagagatggcagagtggagatgtgagttatgattgcaggccacgttaagggcccaagtggggttagtgccactggtttgaaaagagagctgtggggatggttgtgtgcttttcctggccatactcggtgcctagctttcaccagggctgtggttttgccaagtgaatgtagagtatagtccaagagcaggccatggacctgagggttattcagagcaactgtgacaactgactgtgggatttaacaaggcagaggacagtgagcacatgagggagctctggcctggtgaacatttggaagtggattgtgaggtcccagtgggattggagatagggtactagagagttagctgaaaagacagggtgtgattgttgagcaaaggaatgcttggagtggatattatgaaggggttccagttacagtaatggcaaggcctagattgtaaccatggagtgagaggctgagttagggccaagaacatcatcactaaagaagagaaggtcaaggagtcgagaggccagagtattagttgcctattgttgctgtaacaaattaccacaaacttggtggcttaatatagcaaaaatgtgttttcttagaattctggagaagaccacagtgagtgttaatgggctgaatgaagatgtcagcagggctgacttcttccagaggcccctaagagcatccagtccctgcctctccccactccatgaggcagatggtgtgccctggctccgggccacaggctgcattctctgcttccctcatcacattgcctccccctccttctacttcttgcttttcttttataaggacccttgtggttctgactagggcgtactcagataattcaggataaccttctcacctcaggatctttagcttaatcacatctgcaaagtccatttttttcccaaataaggtgacattcacaggttctagggataggatgtggacatctttggaggagagggcattattctttctgccacacagaacatttgaaagattagctttgggggcattgctgtcatcagaattctaacaggagtaggattggtgagagtgaagtaaaacagaagtaagaaatcttcaaggagtgagtgagaaggacggacgcttctgctagtgactgcagtagtgaagggtaaagaggattatggtccactgtcagcaaaatcagagttggagtgttctgaaggagaaggaactggcagtgaaaaccagagccaacacctacttgccttcagacccagtcatatgcaggatttggcgagaaaccagccgtgtcatgaaaaagttgcaagggaagtatggttcttagcagagacctgggtttcttttagaataaaaaggtgaaaggaaccttcaaagaaggcagaggaaaatacaggtggttttgctgatgactggattttagaaagctcagcagaagaaaagggaggaaaaagaagagggcagaaagtggatacagagaacagccaggagagcagtgctgccatagtcatgggtatccacagggttaaaggtctcaagactgatcgcagtggaactgctagtgcgggtagaggggagggtgggaattcccagcagagcacgagggcgtaggatgaggaaagccccaaacccggcaggtgggagaaactgagggtcaacaagaagggcatggaaagtgagatctgtttttatgttagcttgccaaatagaagtacagtatttctttctctttatttgtacctgatactctgggtaatgcagaggccaggatgaccgttcagttttgtgctgaagctaagaagctttgcgtagctttccaaactttggagtaatgctatggggccagaatagactgaggattaaggcatttacctaaggtgttccgggcagaattagtacacacattgcctgacatttggactggagctctttctgttactctattttactgtcatgaagtaaattccagatagagtaaacatttaaatggaaaaacataagccattaaaaaaggcttctatagacagatagctctttttcatttagagaaggttggtaaatgtaatagaaatggaagaaatcacaaatgcaaagagtagtagatttgaacttctctcataaaacatgatgaataaaatgtactggcaaacaaactggtttttttaaattatatgacatatggtttacgttttgctgcataaagagctcatacaaataaaacaatgacaacagaagaacaattttttaaaaatcccaacattggccaggtgcaatggctcacacctgtaatcccagcactttgggaaggcaaggtgggcagattgcttgagcccaggagttcaagaccagcctgggcaacatgacgagaccatgtctctacaaaaaataaacttagctgggcatgttgctgcatgcctgtagtcccagctacttgggaggctgaggtaggaggattgctccactgagatagataattttatatttgttcataaaaggataaatttgtttaaaaggagggaccaagaacctgaagagtttacatatcccttaagccaataatgtaacatttaagaatttgttctaaaggaataaatagaaatccaataaagcttggtgaactgatcatcataacatgtacaaaaacattggaaagaatccagcattcaaggaatggctagataaactagtgcgcatcatgtggttgtcactaggcctgctcactagtaatccagctctcctatctctgccccatggtagaattgcactttcatgccccttgcagttatttgtggccttgtgacttaatatgaccaaagaaatgtgagcagaagtgatgtgtatcattcctaggctgtggccttcgagagctactatacagttgtccacatctcctgcccttggttcagcagtcaatgacattccagttggtggaggtcttgagaacatgggttcctaaatactgatagtgcgagacgggcccactgacctgtgatgacatgttgtatgctcaaggagcaaacacagagattttagggttcatgtgatcacattgtaacatagcatagcctaatatggcccatatgaaataatatgcagtcattcatgtttagaaagaattcataaataagtttagggaaaaactgataggaaagtatacatagtgtgattttgtctttttaaaatagactgaagaaaactttgaaacattagcaaatattgatcacacacgtggattaagggtgggagtttccttttttatatttttcacagtattccattttttctctaatgagcatgtattccttctaaaatcagaagaggaaacacacaaacatatgcacacccaccctcctccagctgactcccagtggtatggccattcagttctctgtgaaccattaaagaggccacgctcatggaaatgatagtaatcatagggacccttttttacctggagagtgcagctgaggtggaggatcaggactaaacttaacttgggctcagagtagaaatttcctgtcatcatggctttagttctagatataacatccatttccctagagcctaaattctttccctctcctttaaatgatcttggagatagagaatgcaaactcacttgcctcggaaaagctgcatcctaaaagagatattcttggaggtggtaactagacttttcgcaatgctgagcaatcattcactgcagagcactccctggaagtgccgtggtaggggacacgagagaaagagaaagtgtgttatttgcctggataaaacacacataaatcaataaatgaaaatgaataggatggtgtgaggaggtgggacctttgggagatctttaggatatgaagatagagccctcatgaagggattagtgccttagaagaagagacaggagaagcatgtgcactcctgctgtgctctctctctctctgtcttctctctctctctctctctctccctctccccgtctcttgctcttgctctctctccccccaccctaccatgtgaggatgcagcaagcaaactgccatctccacactggaagcaggccgtcatcagacactggatctgctggtgcctggattcttgcacttcccagcctccagaactatgagaaataacttctattgtttaagccacccagtctatggtattttgttatagcagcccaaactaagatgtgtagtttaaactttgtacatttttgttcatcagacattttcctaagacctttaccactgtgtgtcagacacaacatgtggatactttgcactgagcaatctgcttgccacttacctgcgtgtcaagctgtggcgttcccatcacccctggtttgtctcccatgtgtgacttctgctcctagttgaagttagtattcacattcactctgcttgctctgaaatcttgccccagaccctccttgtgttcaagattgtgtactcctttttcgttattatagaaggtctgcataactctgtgcacttgactactttagccttaaaataagtccgtaacagtgtactgctgggccaaaaggtaagcaaagttgatgttcccagacacgttgcaaagttgtgcaatagattaggtagttttcttttgacaaccctcactgctgattttaatttttgccaatctgatgctccacaaatgctaacttagttgtgcttgcaattcatgtattactagtaaagtcactctttatttttttttctttttaccaactatatggggagtgaaatgcctatttttattattttcccatgtttatgttgatctttcttttgctattgatttttatgaaaatgttaatcatttatccttcttgatatacgtatttcccctattttgttatttgtctttcatcttttatgattttttaacatcgaaaagattttatttttgttgttttgcttgtatgttgttgatagctttaattaaatctattagactttttccgtttcctgttatgcttaaagagaacttcttatctaagattatttaaatttttgcctatattttcttctagtatttatgattttatttttcacattaaatctttaattatgtaaatttgttttgatgtaaagtatgaaatttggaaccagctttagtttttcttgtcttttttaagatacggtcctcactctgttgcccaggctggcatgcaggggcttagtcatggctcaatgcagccttgacatcccgggctcaagcagtcctcccacctcagcctcctgagtagctgggtctacaggcatgtgccaccatgcctggttaatttttttttattactgttttttgtagagacagggtctcacgatgttgctcagtctggttttcaactcctgggcttaaagggtcctttcgccttagcctcccaaagtgctaggattacagacgtgagtcactggcagatttagtgtctctacatcgttataattcgtcttttccccactgatttgaaaaggtatttttttgtcagatactaggttttcatatgcaacaagatttgtttctcagccttctgtctcagatgttcttgcccaggctggataatcatttgtgaagtttttaattgattgttgatggatttttaatatgaaatttttactgttcgatttacctgcctattgctagcatactatcatatatgttcttcttagaagtccctcatacaccctttttttctttttttagaggacttctttctttttttcttttttttttttttattatactttaagttctagggtacatgtgcacaatgtgcaggttcattacatatgtatacatgtgccatgttggtgtgctgcacccattaactcgtcatttacattgggtatatctcctaatgctttccctcccccctcccccaaccccaagacaggccccggtgtatgatgtccaagtgttctcattgttcagttcccacctgtgagtgagaacatgcggtgtttggttttttgttcttgcgatagttttctgagaatgttggtttccagcttcatccatgttcctacaaaggacatgaactcatcattttttatggctgcatagtattccatggtgtatatgtgccacattttcttaatccagtctatcattgttggacatttgggttggttccaagtctttgctattgtgaatagtgccgcaataaacatacatgtgcaagtgcctttatagaagcatgatttataatcctctgggtatatacccagtaatgggatggctgggtcaaatggtatttctagttctagatctttgaggaatcgccatactgtcttccacaatggttgaactagtttgcagtcccaccaacagtgtaaaagtgttcctatttctccacatcctctccagcatctgttgtttcctgactttttaatgatcgccgttctaactggagagagatggtatctcactgtggttttgatgtgcatttctctgatggccagtgatgatgaacattttttcatgtgtctgttggctgcataaatgtcttcttttgagaagtgtctgttcatatccttcacccactttttgatggggttgtttgttttattcttgtaaatttgtttgagttctttgtagatcctagatattagccctttgtcagatgagtagattgcaaaaatttcctcccattctataggttgcctgttcactctgatggtagtttcttttgctgtgcagaagctctttagcttaattagatcccatttgtcaattttggcttttgttgccattgcttttggtgttttagacatgaagtccttgcccatgcctatgtcctgaatggtattgcctaggttttcttcttgggtttttatggttttaggtctaacatgtaagtctttaatccaccttgaattaatttttgtataaggtgtaaggaagggatccagtttcagctttctacatatggctagccagttttcccagcaccatttattaaagagggaatcctttccccatttcttgtttttgtcaggtttgtcaaagatcagatggtcatagatgtgtggtgttatttctgagggctctgttctgttccattggtctatatctctgttttggtaccagtaccatgctgttttggttaccgtagccttgtagtatagtttgaagtcaggtagcatgatgcctccagctctgttcttttggcttaggattgtcttggcaatgcgggctcttttttggttccatatgaactttaaagtagttttttccaattctgtgaagaaagtcattggtagcttgatggggatggcattacctataaatagggcattaccctatttatagatggggaatctataaattatcttgggcagtatggccattttcacgatattgattcttcctatccatgagcatggaatgttcttccatttgtttatatcctcttttatttcctcgagcagtggtttgtagttctccttgaagaggtccttcacatcctttgtaagttggattcctaggtattttattctttttgaggcaattgtgaatgggagttcactcatgatttggctctctgtttgtctgtgattggtgtataagaatgcttgtgatttttgcacattgattttgtatcctgagactttgctgaagttgcttatcagcttaaggagattttggactaagacaatggggttttctaaatatacaatcatgtcatctgcaaacagggactatttgacttcctcttttcctaattgtataccctttatttctttctcttgcctgattgccctggccagaacttccaacattatgttgaataggagtggtgagagggggcatccctgttttgtgccagttttcaaagggaatgcttccagtttttgcccattcagtatgatattggctgtgggtttgtcatgaatagctcttattattttgagatatgtcccatcaatacctaatttattgagagtttttaacatgaaggctgttgaattttgtcaaaggccttttctgcatctgttgagataatcatgtggtttttgtctttggttctgtttatatgctgtattatgtttattgatttgcatatgttgaaccagccttgcatcccagggatgaagcccacttgatcatggtggataagctttttgatgtgctgctggattcagtttgccagtattgaggatttttgcactgatgttcatcagggatattggtctaaaattctctttttcggttgtgtctctgcccggctttggtatcaggatgatgctggcctcataaaatgagttagggaggattccctctttttctattgattggaatagtttcagaaggaatggtaccagctcctccttgtacctctggtagaattcagctgtgaatccgtctggtcctggattttttttggttggtaggctattaattattgcctcaatttcagagcctgttattggtctattcagggattcaacttcttcctggtttagtcttgggagagtgtatgtgtcaaggaatttatccatttcttctagattttctagtttatttgcgtagaggtgtttatagtattctctgatggtagtttgtatttctgtgggattggtggagatatcccctttatcattttttattgcgtctatttgattcttctctcttttcttctttattagtcttgctactggtctatcaattttgttgatcttttcaaaaaaccagctcctggattcattgattttttgaagacttttttgtgtctctgtctccttcagttcttctctgatcttggttatttcttgccttctgctagcttctgaatgtgtttgctcttgcttctctagttcttttaattgtgatgttagggtgtcatttttagatctttcctgctttctcttgtgggcatttagtggtataaatttccctctacacactgctttaaatgtgtcccagagattctggtatgttgtgtctttgttctcactggtttcaaagaacatctttatttctgccttcattttgtcatgtacccggtggtcgttcaggagcaggttgttcagtttccatgtagttgagcagttttgagtgagtttcttaatcctgagttctagtttgattgcactgtggtctgagagacagtttgttataatttctgttcttttacatttgctgaggagtgctttacttccaactatgtggtcaattttggaataagtgtgatgtggtgctgagaagaatgtatattctgttgatttggggtggagagttctgtaggtgtctattaggtctgcttggtgcagagctgtgttcaattcctggatatccttgttaactttctgtcttgttgatctgtctaatgttgacagtggggtgttaaagtctcccattattattgtgtgggagtctaagtctctttgtagatctctaaggacttgctttatgaatctgggtgctcctgtattgggtgcatatatatttaaaatagttagctcttcttgttgaattgatccctttaccattatgtagtggccttccttgtcttttttgatctttgttggtttaaagtctattttatcagagactaggattgcaacccctgcctttttttgttttccatttgcttggtagatcttcctccatccctttattttgagtctatgtgtgtctctgcacatgagatggatttcctgaatacagcacactgatgggtcttgactctttatccaatttgccagtctgtgtcttttaattggagcatttagcccatttacatttaaggttaatattattatgtgtgaatttgatcctgtcattatgatgttagctggttattttgctcgctagttgatgcagtttcttcctagcatcgatggtctttacaatttggcatgtttttgcagtggctggtaccagttgttcctttccatgtttagtgcttcctttgggagctcttgtagggcaagcctggtggtgacaaaatctcccagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatttgctgttagtctgatgggtttccttttgtgggtaacccgacctttctctctggctgcccttaacattttttccgtcatttcaactttggtgaatctgataattatgtgtcttggagttgctcttctcgaggagtatctttgtggtgttctctgtatttcctgaatttgaatgttggcctgccttgctaagttcgggaagttctcctggataatatcctgcagagtgttttccaacttggttccattctccccgtcactttcaggtacaccaatcagacgtagatttggtcttttcgcatagtcccttatttcttggaggctttgttcatttctttttacccttttttttctaaacttctcttctcgcttcatttcattcatttgatctttaatcactgataccctttcttccagttgatcgaatgggctactgaagcttgtgcattcgtcacgtagttcttgtgccgtagttttcaactccatcaggtcatttaaggacttctctacactggttattctagttagccattcgtctaatcttttttcaaggtttttagcttctttgcaatgggtttgaacatcttcctttagctcggagaagtttgatcatctgaagccttcttctctcaactcatcaaagtcattctccatccagctttattccgttgctggtgaggagctgtgttcctttggagggggagaggcgctctgatttttagaattttcagcttttctgctctgttttttcctcatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagacccagtttgcctgggtatcagcagcggaggctgcagaacagcaaatattgctgaacagcaaatgttcctgcttgatcattcctctggaagcttcgtctcagaggggtacccggccgtgtgaggtgtcagtctgcccctactggggggtgcctcccaattaggctactcgggggtcagggacccacttgaggaggcagtctgtccgttctcagatctcaaactccatgctgggagaaccactactctcttcaaagctgtcagacagggacatttaagtctgcagaggtttctgctgccttttgtttggcaatgtcctgcccccagaggtggagtctactgaggcaggcctccttgagctgaggtgggctccacccagttccagcttcctggccactttgtttacctactcaaagcttcagcaatggtgggcgcccctcccccagcctcgctgctgccttgcagatcaatctcagactgctgtgctagcaatgaacgaggctctgtgagtgtgggaacctctgagccaggcgcgggatataatctcctcgtgtgccgtttgctaagaccgttggaaaagtacagtattagggtgggagtgatccgattttccaggtgccatctgccaccccttacctttgctaggaaagagaatcccctgaccccttgtgcttcctgggtgaggcgatgcctcaccctgctttggctcacactcggtgggctgcacccactgtcctgcccctactgtccgacgagccccagtgagatgatcctagtacctcagttggaaatgtggaaatcacccgtcttctgcgtcactcacgctgggagctgtagactggagctgttcctattcgtccatcttggaactgccccccccatacacctttttaaatgtatttgttttatggttttttgttgttgtgaatgggatgtttatcctcccacctttttctagctgattatcactgatacataaggaagttacttgttttcatttgttgatttttgtggctggaaattctaatgaaaacatactatctttgatacctgccacaatttcggggttttctacatacacatcgctcacaacatttgtaaataacatttttgctgctgctttccaatagctgtacgtttctgtttgtcctcagctgattcaatggcttgaactttcaaactgttgctaaataataatagaaaaggcaaacatccttatttggcatgtttctggtttgacctatggtttgaaagagtgctagtgtgtgtacttgagagaagagaacattccaggataaagagtgggcatattcaaattaacaagaaaggattgagaaagttatgtgtggaaacaggttgtacaaagctgaagctctgtgtggaggagttacaacatgagtagaggtggctcctctgaggagagtgagattaatcagatatgatggataattcaggcatactgtagagtgtggtgttgtagaatcaggtgagctaggcgtgagatcttcatcagtaagatggtgatatctaaatcacaggactatgactgaaataatgtatgatcaaagcacttagcccagtgcctggcacccagtaaacactaagcagatgtcatgtattattattattattattattatgtcagtataataaaataatgtagagcttgaaaggggaattgaaaaaaacgggtaattgacatgataaaaatggtatgtgtaaataaaatcagttgcacataggatgtgtcaaagcaagaaaaacaaatagaccaaaattgatgggaatctgtgtgttcagcattctttcattagtgagttttgagggagtctctgctccccaaggctagccattggccaggccaccaggggtccccatgataatgcacagctagttgcttgagcatggttatggtgattcgtgcccccaacagccttccatgaccatatgtgattattaatgtgctagaatagtttatcttggtgtcttgcacacatcatgatttgtaatgtatatatttaataattataaaagaaagcagttatttgctttctttaacatacattatcttcaaattcctaacttagtgatgatgcaatcattcttttcacatgtgtatgtttttttgtgtcttggggaagctttgaaatacttgctgatttatggagagtgaaaagtgaaccagactttctcagaacatttagaaaaactcagacactcaaaagctaaaatcaaacagtatttgaaatgatttatacaattgcagccataactttttcccacttaagccaaagtacgtctaaacaatcctttcatactgctaagtcctttaaatggaagcaatagatgtctataaatcaaatgatagtttacatttatttcataaccactttttctaacccattttccctcttaaaacttagtatgtcctctaagaagttgaacactctgtcctgattgaatttaaatgaacatgaataaagaaatacattaaaatattttagagaataatatgctgccacagttagtttagagaagcacagtactgaaggcaagtagagtaacactaggtgcagtggagtttgcttatttgaaataaggtaattcagctctaagctcatcagtagtgagtaataaacatgattactgcagtggagtcaatctcaaactagtctattggactaatccttggaattcacaaaacactctaatcttattttttaataacttcttatctcaaaatagtttatgttcgtaagttgcaaagtacctttcacccagcttccccagtgataacattctgtgtaaccatgtgtaccgtcaaacccaggaaattaactgtggtacaatactgtaacacagtaatctgaattactttcacatcctctatttgttcattatgattacttcagaaattcactgtcttttattttctaggatggtgcatctcagaatggttagcaaaacatagtttataagtttaacctacaacctatgactccttttgttctgtttagatgataaccagattttaagtgcatcatgaagacaggaacaacagaagcaagatcagtagagacttgcacatcactgggacttgccctgcattctgatgctaccatgttagagaaacacaaatactttaaagtgctcagagttgagagccacagcagccattgctgtgtttatggtccacttgccccatgggtaaagtcagaataagccacgagatcacccatcttaagcattttcacctgcctttatatccttgacttctctttttactttagtagcactgattttttaatctgtccttgaactgtttactcactggcgtttaagcattttgagcaaacctgcagtaagaaatgcattttacattatgatctattgtacagatacatgtatgtacatttaggtgtatatgtacatatatgtgggagtgaaactgaaacaaaagtaccacaaatctaaagttaccctctgtgctgtgcactatatattttctgtcccattttcttcttttttttttttaatgcaggtcacaagctactgtacagattttacaaaccattagtagataatggtgcacagtttgaaaaatctccatgttaacttatcctgcccagtgattttgcttattctactttctttcccaagtcaaccataaaacctttttccgatagagatgttttagaactaaattatttagaacactaaaaccacaacttttatttaatcccaccaccacttctcctcatgtgtgttaattcatttgaatgacatctttcaggatggatgatatatacatgtacaagacagtgtgaaaaatgatacaatgcagtgctgtgagaacactattataaatagagaagtgttgaattttgcctcgtggagtcagaaatgaccattaatctgggcttagttgcttctgcttcagattttaccctagcttaagccacagtagggaggagggagtgaggaacaggtaaggtatgatagaaagtggttagagaatatattagtcctggttgcttgatgatagggaacttggaacagaagggaggggctgttgtttgggggttgaaaatcagactgggatcaagtcctgaagagttctttatgtctgctcagaggcttatatatgactggggagggaatagggaggccttagaggtttgaagtttgtaagcagagaagcgacatgagcagatataagctgcaggcaaaaagttaaggtttcagtatgggtgatagatggggggtacagagattgaaggcagggagaaaacaatctatccaagaaatagatgaaaacaaatagaaaaatacagtgaatatgaccatatacttaaaaacatctgttttttaatctgctggaatgatctacatcattttgataacattttattcttctctcagcaacacatttaccaaaaaaaattcttttaaatattttatccagagtttagttgtttcattcaggactgttggaaatagcagacccattatgctgatgaaacagaagttcctccatttgatttatctcttcttcctgtgtttttgctttattcttggagattgccttgattttatcctcctgctcttcccactgtttttggtttggtttttgtttttgttttggcaaggatatttttatttctggtagctgctgcctgttcttgtcttcattttccacagcattttggttttgtttaatgaatgtaactttttttggtaagtaaaacatatatgcacatagaccctacgtaccccaaaggccttacagtttaggcaagaggtgatgaggatctaaacctgggcattgaggatgagtatggaagggaaaaactacaaggaatatattgagataaaattatcaggacttcaggattgattggcagtaactgcggataaggaatcaagagtcaatgctgatccccagcctaaaaagagcacctagaaaaagcccacagctgacattatactcagggtgaaagactgaaagctttcctctgagatgggaataagacagcaatgtctgccattgccccttctattcaatattgtactggtggttttcaccataggaatttgtcaagaaaaaaattaaaagcattcatattacaaggaagaaataaaattatctctctgcagatgacatgcatgatcttgtatatagaaaatcctaaagaatacacacacacacacacacacacacacacacacacacacacacacacagagaactgataggctgggtgcagtgactcatgcttgtaatcccagcattttgggagaccaaggcaggtggatcatttgaggccaggagttcaagaccagcctggtcaacatggcaaaacccccctgtctctactaaaaatacaaaaaattagccgggcatggtggtgtgcacctgtaatcccagctaccagggaggctgaggcaggagaattgcttgaacctgggaggcaaaggccgcagtgagccgagctcatcccattgcacttcagcctgggcaacaagagcaaaactccatctcaaaaaaaaaaaaaaaaaaaaaaaaaagaactgataaaccagttcagcagggttgcatggtatgagatcaatatgcaaaaattgtttttctgtattctagcaataaacaacctaaaaattaaattaagaagaccgttctatttacaatagcatctggaagagtaaaatacttaggaataaatttagcaaaagaaattcaagacttgtaaagtacaaactgtaaaacattattgaaagaaagaagacctaaataaatggaaagatgtctcatgttcatggattgtaagacttactattgttaaagatggcaatacaccccaaattgacctacagatttaacacaatctctatcaaaacctcagctgcttttttttatagaaaatgacaaatctaataaaatttctcacggaaatgtgggagacccagaatagccaaaacaatcttgaaaaggaacaaagctagagggctcacacttcccaattgaagcagttactacagagctacagtaatcaagactgtgtggtgctggcataaggataaacatacaggtcaatggaatacaactgagattccagaaaaaaaaaagccatacatttatgttcagttgacaactaattgggaaaagaattgtcctttcgaagaatggtgctgggaaaactggatctccacatgcaaaagaatgaaattggactcctaccttgtactatatacaaaaattaactcaaaatagatcaaagacctaaatttaagagttaaaactggaatattcctagaagaaaacataggattacgtacacatttatgaccttggattaggcaatggcttcttagatacatcacctaaagcataaacaaccaaagaaacagaagattttttttattttaatggggacaaattttttaattttaatgagttcaaatttgtatccaaagaacactaccatgaaagtgaaataacccacagaatgggagaatatgtatctgatcagagtttaatctttagaaaagcaacccattttaaagtgagcaaagggtttgaagagatatttctccaaggaagatacaaaaatgacaaattagcacatgaaaagatgttcagcatcattagggatatgcaaatcaaaaccacagtgcgagactacttcattcccactgggatggatataataaaaagatgggcagtagcaagtgttggtgtggatgtggagaaattggaaccctcatacgttgctggtgagaatgtaaaagggtacagcagctctgggaaacagtctcatagctcctcaaaaagttaaacagagttaccagatggcccagcagttccactcccaggtggtagggaactctcacccaatagaactgaaaacatatgcccacccaaaaatgtatgcacaaatgtacataacagcattattcatgatagtcaaaaagtggaaaccactcaatagatgactggatgcacaaaagccttgtatccactcaatggaaaattggtcataaaaagaaatgaagtattgctacaacatggatagactttgaaaacattacgctcggtgcgacaaactagacacaaaaaacctctattgtgtgatttcatttatatgaaatgtccagaacaggtaaatccatagagacagaaaatagatcagtggttaccaggagctgaaggaaggaggaatggagagggacagcgaatgggcccggggtttctcttgggagtgagaaaatgtgctggagttagtgatgatggttgcacaattttgtgaatatactgaaaaccattaaagtgtacacttgaaaagagtgaattatatggtgtgtgatgtttatctcagttttttaaagttgcacaattttgtgaatatactgaaaaccatttaagtgtacacatgaaaagagtgaattatatggtatgtgatgtttatctcaattttttaaagaagagtcactgtcttagagcagggaagggctgtgatgggccacactcaatgcctccattccttcccaggaagagggagactgaattgccatagaagttagagaccagctttcctgggaagggtgttctggctagtgttctgagggattaggtttaacgttgtaacctatagatctagaaggaaatatgaggccatcagctcacctcagccttcaacaagttgtcattcaccacagatccttttaacattacacctcaaaccttcaaacttaggagatgtgagaagaaagctcttacagagcttctatatataaaatacctataatattatagcattttaaagtaatgctagttgattctctttttatactaataattgtaagaatacttcagcgcagcagcattatttatagtgaatactacttttaactaatggtattgaatatttttatctaatatgttttttaaatttccataatatgtactgtttggcattacccaagttttccatatatttcagccacaactgtagccgttttttttgttgttgttgttaaaaaaaaattgctaaaaactcttgcatcaggaattttggaaattcttcagatgagacaatcagggaggattgatcacatgttgatagaatgcaggcagccttagtcatttcggtggctcagtcacattctttatttctgtcagttattctgaacaaaatacaggtggtaacatgacctgcaaatgacatactgtcacaagccctgggctatcctttagaatgtgcagttaataagctctggaatgcctttacatgggaagtgggggggcagttgttacggattcctggaggtgaagttgtttttattgtctttattaatttagtttcatcttagcaggagcataatccttcgtaagacacacctcctaattgcacacgtctggctttttacctcttaggcaatgtaaaggaaagttaataggatgtactttttaataggatcttagggggatctttcaccattaaaatgagaaaataagtttggggagcagcaattattcaaaccaaggaagttgagtgaatcatttagagttattaggtaagggttaataggtaagagacactgaaatgaggatgtggctgtgcaaacaccacatttcacgggtttcagatgaaacatgactgttagggaagagtctgtgtaggagtcatgcattcttcagtatttcacatacaccttggcctaagcttatgagaagctaatagcagtattattttaattttgttttgtcacttcagaaatgcagatgtgtgtgtgtgtgtgtgtgtgtgtgtgtgtgtgtgtgtagtcagcaaattagttacatgttacctatttgttgataactttataattttactgatttttgaaactggttaattatagaaaaagaatttgaacttacagatgtaaattgtttccaaattatagtcatttatgtctaatattcttgctccttttatcattgtttgtgtaaatatttattgaagacaccccactagtcactgatacaaagagatgtctgatgtccaccctgcttagaaaggattctgttagcagctgacaaactggaccatcccgaggaccagcacagtgcacacttttcccttcccttctctcctttagcccatgccatagccctaggaggtgggtgtggccacggtcagggtggttgtgggatctggtgttggctgtgcagccggtaagtgcagagcctgcattcccatagcacttgttgcagtgtgactgtccagtgatcccggatttactgtctgcaccccccagtgactgtgcagccatgaggtcagggtcctctctagtgctggccagttgtgaattcagtgaggtttggaaagatggatgattttcaagtctctgtgcctagtgtttatgcgccatgcagaggtacagaggaaagggtggtgagcacgcacaagacacagggcaggccctcgctgccacggccaatgctgaggtgaagttaggacagcctctccagttttctctatgaagactgtaaagggacaatacaaactcattagaaaataataaactcgtgtgttctaccccctcttcaataaatcttcccactgaaataatcccaggtgctggctgattagattaatggggagggggcagtggcggtctctggtggtgggtgagtggctctgaaggtgaggattccagcccaattgcaggacatcagccacaccagagagcacctgggggaggccaagctggcaggcaggggagttaggccctgattgagcaagagggtatggagtgggagttcatctgcacagacttcgatgctgaggtcccagctgcctgggggcagggggacagcagtgaaaccggttgttccaattgtgcctggaattggcactgagacagcatcctgaccccctcccctttttttactcatcagagaaggtcttgttgaagaagcgtaatttaaaaagacattgaggaaagtgagaatgagccatatggatcgacctgggggaagagtatctgaggcagagaggagagagctaggatcaggagcttacctggaggctactggaccagcaagtcagtggcatgtctggagcacagtgaacaacgggagagtgacaggaagtgaagtctgagcaggacagggtctgaggaagccattccagggttctgcttgcctgtttaatgaaagaagtcagtaggccctttcctagcccattttctgttgcttataacagaatacctgaaaccgggtaatttacaaagaggagtttattttttacagtaatggaggcatgtaaatccaaggttgaggatctgcatctggtgagagccctcctgctggtggggacgccgcagagtcccaagatgggaaagggcctcacatggcaagggtgctgagtgtgctcatgggctagctcaggtctctcttcctcttcttataaagccaccagtcccactcccatgatagtctgtttatgaagtcagggccctcatgatccggtcacctcttaaaggccccacctctcaatactgctgctttggggattaagtttcaacatgagttttggaagggaccatagcagccgtatgtgacatcaaattgtcccatttgtccctctcctttttgtattgcaagtttatctaacagggtagaggtgctggctgcctgattccccacggcaggcggagacctgggttctaaagctatgagcccctacaggaatggagcctctgcccacaaagcccagttatagccctccccccacacacctgcttccttgcacacttgtgtgcaatctgtgggtgatacacctgcccttggactccttcccattgagaagttactgtcctttctgcatcactttttgttgtactctatgcctggagagaaaatctcatggtctacaaagggcactcatgtccttttccatttttcctttcatggattttccctgatcctatgcagacacacctcctttactgaaggacttatgattatcatgaaaacaaaaacagaacccttcttgtcgtgtgcctcaggggtttcattgactcccagagctgcctgatcagggttcagacacagtacctgttcctacagaggccccgttgctgtcctgggctgactctcctgaccatggacgtccttattttctgtgttaacttctctgacactttcccaatgttagcatgggttcctttagaatgacggggcaatttaccattttctcagcagatgttggaggagagagaaaaagcaatgttaaagagttttgactgggaagaaaaagagcaagtatttgttggttctggttctgtggtggttgtttttcatttgtcttaattagatccatgttacctttctatgtctcatctaataaatgtatttccatttgagtcagttacatccctgctctgctagtagatttgcttttgatagacacaatcctgtatttccaggggttttttaatattacatataaattacattaacagtcgaggttagcatactgaagagatgtgctcctagttaatattttgtgtgtccttaacattacatctgccatactactttgtgtgggtttttgttttgttttgtttttgagacagagtctcactctgtcacccaggctggagtacagtggtgtgatctcagctcactgccacctctgctcccaggctcaggtgatccttcttacctcagcctcctgagtagctgggactataggtgggctaccacgcctagctaatttttgggttgtttttgttttgttttgtttttttggtagagatgggttatcaccatgttacccatgctggtttcaaattcctgggctcaagcaatctgtttttattggcctcccaaagttctgggattacagacatgagccaccgtgcctggtcaacattttaaactatagtatttacttaacatagcttgtgtaagaactttcttttcagctgtaaaaatagctctgtggtgtgttttgatatgtattttagcagacatggtagaaacaaagttaaaagttacaggtgtcatacatacacaacatgaatgtggcatagacatcagttttggtgttagtgatgtaaaatcaagccgggtgtaaacttggcctccccttgcctatcaagctagcagatagaaccagtgagctggtagcttcatcaacatctggtgttcacctttgagtccaaggtggtgattacagtcttcaccatttcaaagctagcaggaaaggagaaagaggacaaggagggcgagtagcttccttttgcagaacccagctgcacacgtcacctttactcacagccattttcaagaatatagtcgcacagccacacgcctcggggcatctgggaaatgcagtcactgccacagcaatcgagagtcctgttcacacttagcaagaaaagggtattattctgtttctaaaaggaaaaaggggaaaatgaaggaaggaacacttactaatctctgccagtagccttgggcaaatcgctcttttcaagtctatttataaaatataagctagtaaaatatttacaaaaaaaaattaaaaaatatttacaaagggccaggcgtggtggctcacacctgtaatcccagcactttgggaagccgaggcaggtagatcacgaggtcaggagttcaagaccagcctggccaacatagtgaaaccccgtctctactaaaaatacaaaaaaattagctgggcatggtggcacgtgcctgtagtcccagctacttgggaggctgaggcaggagaatcgcttgaacctgggaggtggaggttacagtgagccgagatcgtgccactgcactccagcttgggcaacagagtgagacttcgtctcaaaaaaaaaaaaaatttacaaagatactgcccttcaaacattttcacaaagacacaaggtatatctttatataccttccatatttgcaggcgtttattctcaaaatagtatttttaacctaagtctcatttaaaaaaatagatattggtattagttttcaattgctgtataaaaatttctacaaatgtagtggcttaaaacagtgcctatctcacagttggtttggatcaggagtcaacacagtgtagctgcttgctgtgcctgggggtcacacaaggctgcaggcaagttgctggcagggctgcagtctcatctgggagcttggctgcatcacccaggttattggcataattcatgtcctacagttatagcactgaggacaggcttcttaccggttggctctaggctacccacaggtcctagagggccccccaggttccagggtcctcccccagacctctgacagtgggctttcccaacatggtcaccttcttcctctagctaacaaggagtgttctagagtgagcttgctagcgagatggagacatcatggataacacaatgtattcacaggagtgacatccggaaccactgccatattcagttggttaggagcaaggagcagcttctgtctatatttaaggcaggggattccacaaaggtgtgaccatcaggaggatgggtcatgggggcctcctgagagtgtgtccaccacaataactgttccacttaacaacactttatattccaaatggagaattcctgtctgttgggcactgttatttcatgggttttggtaaactgtcagtagggactttttatcagttagaagcactagtctccagtgatgcatggaacatgcccacacattgagagagtgagtgagagagagagagagagcatggatgtgtgaggcaaatagaaggatatgtcctctgctctacattgtggttaaatcgttaaacacttctggagtatcttttttagcagaccagtgatattgtacacagagaatgtgagaactcaaaatggtctttctatgaagacgagctcaggaacttgcttcttcctgccttgttatcctgattacaacaggtgcaagtgtgaacaacaagattatatgagctcatacagtattactagcccattgtttgtttagagtctctaaggcttgaaggagataacatactctaggaagccctactcagattctctgcatgatccagacctggagatgtggtaccaaaattagcctgagaaaccttacatcatctatcaaataatgtagtcaaagaactatttttaaaaatcatttacagcctaagatccaaatttgtttttaacaccatagtatcttcttatctgcaaaacagatatggtagatgctcaaaagaatccggcgaagaaaaatacttctgaaataatgaataggattattccatatcagaggcctttttggatggttgttgtgtggtggtcttgaaatgtactctctcagacagtgtcacatcatcattggtatatagtcaatgtatttaatatatttcactaccattcttaccctaataccactcacttccctagtcgaaaataaattacttaaatgaaactgcccttgtagtacaacccaatacaccggtcttgtaaaccagaaatattattcctggactctgcatctcagccagatgtccagttgtcagtaacattgaatgtcattgtgaaagaatcccatggtgtccatctgtccatccattcattcagcagattgctgtcgagttcccgttgtgcttccagtactgcagtaagtccagacatgggcacaatatgtaggccatgcccttgggaagtttataacacacatcagagcaataggttgcatttctatactcgtggtttataggggtcctccgcttattctcaagggatatgtttcaaggccccaggtggatgcctgaagctacagatagtactgaactctatatatactatacatacatacctatgataaagtgacatttataaattaggcacagtaagagattaacagcaataagataggacaacttatgtactgtaataaaagttttatgaatgtggtgtctccctctctcaaaatatgtaattatggtacacctgcctatttttggagcgaagttgaccataggtaactgaaactgtggataggaaagctgctgttaccttttcacttgagttgggaggactactgtatagtgaccctcagcatctgtggggaattggttctaggacccaccccccgagcatggataccaaaatctgagcatgttcaagtcctgtgattggccatgtggaacctgcagacaggaaaattcagccctccatagatgcaggtttcacatccctgaaatactgtatttcccacctgcgtttggttgtggttgcagaacctgccaatatgtattcgactgtattcattgaaagaaatccacatataagtggatccacttgtgttgttcaagagtcaactgtataatgttccagtgataaaaatcatttgaaaataaattttagctaaagcatttctacatttatagctggacatgaagaaatggtatactatttaagagtatagttggctgagcacagtggctaacacctgtaatcccagcacttgacaaggtaagcagatcacttgaggccaggagttcaaaactagcctgggaaacagagagagaccctcatctctacaaaaattttttttaaaaattagccaattatggtggtgcacacttgtggtcccagctactcaggaggctgaggtctgaggctacttgagcccaggagctccaggttacagtgagacatgctcatgcctctgcactccagcctgagtcacagagtgagaccatgtctctaaaaaaatttaaaaagagtataattgggagaaatggttagttccgttattccatatctagcacacagttactgagtgcttgctctgcactagcccctgttctgtgtttgaaactgaaaatagatagtaagtaaatggctcattgctacctttccatttccggccctggaaaatcgtggcattagagtagggctataggcaagtaaaaatgatcaaagagccttccattctctgaagttctaaagcaagtgaccatatccatgggtttcctgacaggctgctttgctggctccaagttttgtctttcgtatgggatcactgagattatgtaactcaaggaaggtttaaataggcatgccttgggacagcaataggatttgaaaatctatgtctctcaccgtaataaaaggaaaactacaaagatgtttgcatggtttgcttttgaaatcagatccacacgttaaatatcctgaaggaagtgtgaaagcttttatccatctgacaaatatcccttaggaagaagaaaacttcaatttaaaaggaagaggatatcataattccagcgcttaagatgaaatgctatattttatttttccagatgaatgagtgaaatggtaataaggacttaatattaggttgaattagcaggaattcagcaattgtgttcaaacaacagtggaattgtaggtcttagccacagacttgcaaacctatgatgaaaggtgtcaggtggagataatttatttagcatgtcttgaggtgtagtcctgaacccaaacctgtaattaaagagcaagacacaacggggcatgtgtgtgccagaagacctggattcaggcagggggatcaggataaggcagacccctggctgtctaggaaatgatgcatgcacaaatcctgatgtctctttctaccattctgaaaggtcttatttttataactctgtttatgggggatgtgggaactcagttatgagctgatgaaaccagggaacttaagacatttcttagctcagatcaaatgccactattgaagtgggcctgctttcaagataaaacaaagctgtattcagcttgaatctaaacagaattaaactctgctctatactgcaaaggctgccaaactagttctggcaaatcaccatgaagaaaatgtttcaaagacaaagccccttaactgtatgctacaaattccggggcttccaccctgagagacgcttatcatcagtagtacaagtgctcgtatcttgttggagtatcagattaaaacagcaggctgtattccattacagaagataccctcacatccaaactgcttcatacgagaaaggctaccagtggtccatgagttctcatcatttagtagattaggattccagcataaaaagaaaaactgacaaataccccttttaaataagacagagtacattggactgtgtatatgttgtaaacgaattctaaaagccttttgactaaaaatgtagttattcaaagtttgttatactagaatttaattcatagatggtcctagtctctttgctttcgttttaaatagcacttgcatcttaataggatgaaaagtacgtgtctacctttctctgcccttcactatgctggagggaccttgctggcaaaagactgtgcaggccacattttgagtgtccagctcctcccacctagggcacagctctaccaagggcatggcatctgttgcacctccagcagcctcagccccactgttggttgtgtattcatggtactgtttgggggtggcatttgggcctgaagttggggtatcctgtgaggtagggatacaggtctagttgctgtgcaagagacccaaaacaatagccgtgcaagtgcccctgcccagcacaggaggcggctgccccattacaggcccacacttctgactggctgcatccccaaggaggaaggggcatggatcattccttcaggacaccactcacaaggcgcccacctgacttccaatcatatcttcttacagaaagaggagaacggatgtggaggtgcagtgtgtctctgaggtgctgcccccatgtcctaaattgattgcagtgctcctgcacaccttccttatgacagagcccttgccgagcccaagcaaattagttgtcttggagaatcggacataaccagagagtcactagcattgccatgcgtcttttaagccactgtgtagtgaatacagggagtatgctgccacgttcctgtgatgaagtaaccatatttttaaaaatgtttcttccttgatatgttaactagaattcacttatctagtttatagagttgtagcaaggattatactttgtttattctttattttctggggagttaacagctttgttaaagagtgttgttatcatggttaaaaaaaaagttaagctttttaaaaaagttgtttattttttttttaattattattattttttgagacagattcttgctctgtcgcctaggctggagtgcagtggtgcgatcttagctcactacaacctccgcctcccgggttcaagcagttctcctgcttcagcttcccaagtagctgagattacagacttgtgccgccacgcctggctaatttttgtatgtttagtagagacagggtttcaccatgttggccaggctggtctcgaattcctggcctcaagtgacccagctgcctcagcctcctgatgtgctgggattacaggcatgagccactgtgcccggcccaagcttctgttttttaaaagaaatgtttatgtcagataaagacagaagaaagtggatgattgctgtgtcagatttgtttcagaaaagtaaaaatgttaaagtcctaagtgtagcctttgaggacagttttcatagtcccagccttggctggggtgacgttacagcagatataccatcgcaagctcgtgtgccgtgcttgcatagccctgcacctgctgatgaattggaatggagatgttttccactttagcaacagaaaaagagcagtattcgtaggaaaagaagtttccagtggaactgtgtccttccatgaaaatccatgtggcttttcctatcataactacatcattgtcctgagatagaatggatgctctctctctgtgccagactccaaattctctcctccaatgttgatgaccaggcgttccaagtgggtcagaacagatgtgcacctccacccggctccaccattggcactcctgccaccgtctctaggctgtctttacgtttctgtcacagaagtgaatcccaaagtgatgaacttgtacaaaacaattaggtgtccgcttcttccttcttatgattagaaaataagtggaaggagcttagagaaggagggacaacagtttgttcacccttcttccactgagaggcaagttgctggtggttatctttggttcttagcgtttgtctcttcttaaaaaaaaaaaaaaagaatgcattcccagattacccctctttgtatagtaatgatttttaaattctgtcccatttttcttctgctctgtgactttttgttttgtcataaaatgtaattatggtaaaaacatggaaggtttttgtgttacaaaaactagttcatgaaaagcagttcatgcaacagagaatcattgcagagtacaactctctgaactaactaaattattaaaaataaataaactcctgactttactgtttttgtagatagtcatgtgaaataaaatgtattataatcagtgtaattaaactcacttaatgaagaagaatagccatatatttggagcaaaacatatacatctatatatgattatatttatgtgatacaaaattttctttgtgtatgtcttagtgtgctaaggctgccttcacaaaatgccagagactatgtggcttaaacaacagaaatttacttcccactgttttggaggctggaagtccagaccaaggtgtcagcagatctggcttctcccgaggcctctttggcttgcagacagcctttcctctgtgcccacaccctggcatccacctttcctcctcttccaagataccagtgagtttgggcaagggcccagtctaagagcttcacttttacttaatcacgtctttggaggctgtgtctcctaataagtcacattctgaggtatggctttgggtttcaacatgtgaattttcaggagacacagttcagccctaacagtgtataaaatgtgaaaatattgatatcataggtgacgtagccttctagggtaaaatgcaaatgaaagcatttacgggtctctctgtgtctccactgtgttctcacatgtgatattctccaagtggaaactgacttgtgtcccgtgctgtgtctctctgttcttggcaggcctggcagctgcgattcagccacctcgtggggtatggtgctagatattactcttacctcatgtccagagcggtcgcctccatggtttggaaggagtgttttctacaggatcctttcaacaggtaagggggtaagttctaaaatgtccccatcttggaccacagtaattccccactctattacatctggaagtcgggctcgagaactgcagcccacataacacagccaaacctggcagaaagtggcaggctccccacacagcctcgccccacttggccattcccacccaagcttgctcctgcttcccgcagctgaccggtggccctggacatccccctaccctgcagccactgtgtagaggtggctgtgtggtgtctgagggaacccttgtatgagggctcctgtgctacctgaagcagcccctgctgctcctgtgggttttcttggcttttctgacctcaccacgtgatacgggatgcccacccctttccacagaatggaggcaaaacaaggcactggagaggctgggagcattgtcgggaggaagtaggggtgcctaggatcagtagtcctgctttcccaatctctttctaaaggccaggtagtggttaaacttccattgggtggagaggtacaggagatcccttgcttcctggagggtgtgagggattctatgctgtggctgggggatgcaggggatcctgtgctgtctaggggggtgtgggggatcccgtcccgtgctgtcttgggggtgtggggaatcctgtgctgtctggggaggtatggggatcttgtgctggctgaggggttgcgggggatcctgtgctgtctggtgggggtggggtatcccgtgctgtctggagaggtgcgtgggggtcctgtgctgggtgaagggtgcgagggttcccgtgctgtctggggaggtgcagaggatcccatgctggctggagagatgtaggagatcttccctttgctccctgatttggcctcctgatcctcctaacaggaatccctataacaataggaaccaagacgttgtcaagtttgggtcctatgattccttagaaggctctttctttgaaagaaaaccagtaattataatctggtgtcagagttgtttatagcatttatcttctcaccacacaaataactacatctccaaattcttttcagggaactttggctgatgagtgctatttttactgctttatcttggtttttagagtgtcctagagttttcacatagtattcacagcagtcttggcagaaaccagcacgttttataagagaaaactgaggctcagagaaaacagtttgttcagacttcaccattaaaaactggactaagactataatctaggtcttctcattcctggttttttctccctcccacctccacctcaccctctcagtctgtcatacaatttgacttagacttggatttttctcagcagttaataatcacatttgtttcaaattatttgagtctgaatgtgatgtcatagaatttttaaatattttgcagcttggtactcacatgtattttgtcttctgccctttgcagactgtagacatttggtctgctcttcagattttatttttaaaagatctttagccaaacttgacatcagtaaatcagtttcagggattataactttttactgtagatttctgtaaaataggcaaaatatcatcttgtttgaagtatactttactagaaaagtacatactataaaatatatacgtttctaaatatttatatcttgtttatgtgtacattcttgcctagacatgtagttgccatacttttatgggcatattaaagtaagctagtaaaaatgctcactagactagaaaatttctaacctctgtcaaagtctcctttttgatctcactcctgagaaataaccaggctggagcctacatcagaaagccaggcattgcagagctgaggcaagccaggagctagaggcctgtggggagggatttgatttagggtcagggcactacatcccatggctgagaagggcctcagagcaccccaggtcgggagtcaggcagggcccctcagccacccctgcccctgaggggaggcgccacctcagtccaggcttcctgcttcgcttagcactcacttcaggatgtgaccagggctagtgtttgatgtcagcatgtttttgatactgtaatgctatcaaaaagtctgattaaagaccatgttcacaaaatgacccacatgtaaagaggctccagagcttctcaaatggaaacaatatcaaaatttatttaacctgtctcatcatagtatgtagtcatgtatgttaaaggaattgcatttttcataaaatacaaaagagtagtactaaataacttgtttccaggtcccattagtttggaggatttatgtctacaaaaattattccaaacctgccttcacatattgtcattaacagtgttccttgtggaactccgtcaggtaggcatatccaggtgacacagagtaccagaagacgggaacaaggcagcctccactgtgcctttatcacccgcacactccagtggagtttgctgatccgttaactgttatcctgaaccaaggttttctggtgtaattaaccttttcctgccagcttctcttccttcactcttgttttagagtgttctttttctcttctttattaggtgccatcacaaattatttcttaatggtataatttcaagcctcatttaaaataatcacaaaactatttttatagagaataaaatgtaatattttacttattctgtaacaggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatggtgagttgtataatcatttcactatatattacaatgtataatgtaataataaagtgcaccgtaaatgtaatgttcttgaatcatcctgaaaccatccctcccccatcaaccctcgtctgtggaaaaattgtctttcacaaaaccagtccctggtgccagaaagattggggacagctattgtataatacataagttaattatttttataaagtgaggtctcttgttaacagaacagatagccaaaagtatagttatcctcttacagggaatatgtcacacctgatttaatttattttagaacaatttaaaagccagaatttgatttttagaagcaagaaaataggggccaaattgtcacatggtggcagcttttatgaatatggcatcagtgtggctttctttgagaattcaagacaagtgtgaatggaggctgtgcaagcaggagtctgtaacagaacctctcttccccagggctgccggggagcgctatcgcagggagatgctggcccacggtggaggcagggagcccatgctcatggttgaaggtaaaacaaaaccaaaatggcaccatctataatgaaagctgatttatgttttctccatatgtttttttcatttaaagaaaatgttttaggccaggtgtggtggttcatgcctgtaatcccagcactttgggaggccccaaggagggtggatcacctgaggtcaggagttcgagaccagcctggccaacatggtgaaaccctgtctctactaaaaatacaaaaaatagctgggcgtggtggcagacgcctgtaatcccagctactcgggaggctgagacaggagaatcacttaaacccaggaggcagaggttgcagtgagctgaaatcgtgccattgcactccagcctgggcaacatgagcaaaactccttctcaaaacaataaataaataagcaaataaaaaagaaatgtcttagctgtgcattgtgttctaagcatctgtctcactgtgtcctaagtaaattaatttttagttgccatgatttattcaagtaccaggataaagattcaggttttagctttcaaagtgttacttatactctaatagaaaaattttttatttgtcataaactcttagaaaattttcctttagattttaacaggtcacagtgttttttttttagtctaaagaactcatttattttttattcctttatttctttttctgaaagtttaaaactacatattttcaagaaattccaaggcattgggttagatttgtttttttacctgttgaaaaattagaacttaatatctttaaggtattacaattctttttttctatgtaattttctcagtaattttttatttgagtatttttactgaaaatttaattgtaaatggaagtgatcatcatgatttttcatgtatgaatataagaacattgaaacatgcttacaaatatttataggaagatatgaatgttactagataattgcaatatattgatggttatatttgcagctgagcttgactatctgaaaagttttctggctatctgaaaaagtgcatataggaaataactttcaatattggagaagtgttttcattgtagtaattgagtgtgtctgggtagtcatgagtgtgatttaaatgtctccttgcctaagactgttgaatctaatgcctgtactcctttttagcagaattccagattcttgccttcagccattcatttattcagcaaatatttgtgcagtgccttcagccattcatttattcagcaaatatttgtgaagtgctaattatgtgccagacatgattccatgtgccagaggtgaagtagtgaaagacgcttagacaaacatcctgctcttttggagactgcattcattccatcagctttgtgaagagtgaggaagtgtgcatgctgacacagccatcatttacagctagtccttactggtccttattgaactttccacctctggggatggttttagggattaccatgtatctgttgattgactcttcttagtaaccctatgaggtaggagttatgatccccgttttatagacaataagcaggttaggccctctgcttatgtaacaaggcagtatgtggaagagccagggattgaaccaggacctcaggcagcaagcagaccaagctcttcagctgcctgtactgtcagacaggacatctagttcagggtctgttccagacccaggcaaaagtgaaacaataggcacatcataataagctactgattgggtacattgtatacttttggctggtggttggtagcgccagcccaccccgagctaaggcggaaataagcggtgagtttctgtgaggtgtgtgttcctggcagccgtgcttggctcatcctttcccaggccatgctgctacacctcaacatttgctgataggagataccatcaaaagaaaaaaatgtaaatctttttcagtgtttatcttttggctggtgtgcttttctagtcggcttcccagaatgttgcaactaactctcaaaaattctgttctttatccaaaacaattttgtgttaagaaacttaatattttctgcactaaaattcacatatgagagaaaaagaagtccatcattcaaaccagagatgattaagtattcagattttagttaacacaaacaatagaacaattctacttttacattttaatatttttcttaatgctgttctgtcagatctcattaattcacatgatttgtttcatgtcagagatgaatgggggacatgcaaagagggttatgccagttgtcacttcatagggctggatttgtaagctaagacccatagtagtggcttctcattttcttggaggcagtcagtctgtaccccaaaacagcaggtcttaggtgttggctcacagccttaacactggggtattaccaggagtgatgggtgaaattactgagatttgtaatgtaaaagcatacaggatctcgttggcagtattcttctatgaaaatgtaactttttataggtaccttatatatttttgtttaactgcttcctggataaatgtaaagaattatattacatagcaaaatggaaagaaatagaacacctgccttcaaactatgtacctccctaaccaaatcacaacttttttttacctccttagttataagactgtgtttcttagggtcagaatacctttgtattcatatttgtgctctttgaatgatacaaattcagagaagtcaaatagggaatgcttttgatctttgaataataagttctacataggcaaacttttagattatttgtctttttcagaatgagtcatcccttgggaacagggctctgctcagagctctgagtccctcggccatttctagtcctcaccagctagaggccaacaccctattcaaggaagtccctgagcacacaggattcctctactttcttttttccctgatgtttgctttacattcatcagttaaaggccactgctaggcaaccatgtatctatgctctctaactcttggctgcaaggtatttattcagaagttttccattacttaactttacatagagtgatcctcacaggaaaaaagacaagttgcagcagcaggggctttcttaaaaagcctaacacaccaaataccatttgaaggcaacataatagtggttaaaacagtattttcttccccagagaaagaaagcaatcacatggtgaaatagaattggatttgcagtcagtgactctgctacttactgtctataaattacttaggaaagtcacttaatttccttgcgggaggtaaaatgtgatttgacttcaaaacacttctttttttgtcttattattattattatttttttttttttttttgagatggagtctctactgcccaggctggagtgcagtggcacgatctcccctcactgcaacctccacctcctgggtttatgcacttctcctgcctcagcctcctgagtagctgggaccacaggcatgtgccaccatgcccagctaatttttgtatttttagtagagacgggattttgccatgttggccaggctggtctcgaactcctgacctcaggtgatccaccctccttggtctcccaaagtgctggggttacaggcctgagccaccttgcctggcccaaagcacttctttttaatctgcttctcctttttttaatctctgaagggggtggggtgtgtgtacagacgtgtggcagtagctttgcagattgacagtatggccttgtctatttttaaacacattcatagcttacataaatatatatattataggcatgacattcagtcacttaatcctccactaaacacatgtggcaatacctgactgaaaccaactttcttaattgctgagacatctggggtgaggtttaactctcattgtcaatgttaaggttttctgctgttcatctcatacccccacaatggtttttggcttatgttaaatcacatttctgagtaataagataacttaaggtttttgcttaaaataaaccatgatgatatggcatttccattcattttaccattttataaaatatatactagaatatttgttaagtatgctatggtgagcatgatctaaggttcagtttccattacagccacttcagaaaatgtgcagttttctaaaaagacagatatgctgaggcttgtgaatagcaaggaagtaatactttgcccccactaggaagcagaattgtttcttactacagcaaatagactggtagaattatatagatattaggaatggaaactatattacttcagcagtttgtgaatggcaattgtattactcatgcaagttttcatattgccctctgtaaactatttggtctttttgtgttttatgttatgtaaaatttttaggtaaatccctcttactgagtttttaggttcagattttacttatcctctgataagtttaatcccctataacacaggtcatattgtccctatttttataaataatgaaactttgtcagtgttcataccctctgtgctgccttgcccacatttttctctgttgatccttacattctgacatgaaagtgacctggcctttagaaggcaagagatgtaagcaatgtgggtcttgggccctgatggttctcttaacgatctccaagttttttttttttttaatgtcgcaacctatctattctcattgacattggagagacctgcctgacatccactgatcaacaataaaatcttcctcttcctgtgagctcctttagacttttgtggcaaagctgtcaatttagtttataaccatttttagccatgggggtcctgatggaaagattctccccacagccatgtaagcaggacatggcccagttagttttgggttctgcctctggttacagaattccttatgctctctttcttcaactcttccgcaaagaatctgaggggaggggaagggaaaggataaagtccaagattttagcattccaggaggttatttgtaaatattaaacaactttatttccatgctcctttctaatcagaatctctctggccaaaagcagtatgcaagtagagatactaaataataactttatggagtttttcaaatggaccaaacatcagatcagatggaaagaaatagtagtagctaaatgagtcaattctcaacaaactgaaactcgattttgtttgttttttcgcatcagactgactcaccaaaccaaagtctagaagcccgcagggccttaccttaagctgattaaaatataataccttacgtttctgtagagctttatttatagtctgccaaacacactcgcttttgccatattatcctatatcatctcttctagcttattaaattttttttgtttaagaaacaaaccagagaattatggtttatactccaaagaatcacctccatgctccaagaagattaatgcaaacaatgaagatatctatctactagtttctttaaaaacagttctcagttccagcagcacggagcacatcagcacccagaaattgggtttacaccattctccagtaagaggaaccaaggctccttggagaaatggctgattccagggctggaacaaggaagacagaagatgagcatgaagcatcttatagtgccagaaaggaaggaagtgcccagaaacacacacagtgatgggcgcatgtgtcatcgcagcaggggcccactgaaagagctcccagtgccccaacctgggccaactccagcagccaaataaatcacagtcttgggatgtgatacaaagtattaaatacatatccatgagtccatattgatataaatgattaaatgaatagaatagaataatctcccatagagaagagttccaagtaatttatgtacatactccccaccttagggaagtggaacataactccccactcattatgtgggcagtgcagagtgagttccgtccagagcactctagagacagcgggggaaatgacaaatacgacctcagtcagatgatcaaggtcagcatcagtgatgcgtcatgtggacagtatgcatccttgatataatatgatgggaagttttcctcccagaaacccataaccccagtctcataatgagaaaaacgccagacacaccaaattcaggacattctgcaaactgcctaagcagtactcctcaaaactgtcaaggtcattgaaaacgaagtctgagaagctgacacagtctagaggagcctaaggagacacggcagctacatgtagtatggtcccctggttggtcctggaacagaaaaaagacagctagttttgatcgtaccagggcaatctgactaaagtgtagctggagctaacaatattctgtcaatactggtttgtgagttgtgacagatgtgccacatgatgaaagatattaatgataggggaaactggctgagtgtggagtgtggaggaactctcttgactccatcacagtttttcagtaaatataaaactatcctgaaatttaaaatttaattaaaaacaaagaacctccttgggaaggtttttagcagtgacaccactgctcatggtttggtccacaccttgactccaccatgtttcccttcttcccagcagccttttcattgccacttgggggagggaggggcacggaggtgagattgaaagaggagtattaggcacaaaatgaggctggaaggtaagtgggcgtcaggtcgggcagggcattgtggatactgtgaaagagagttggtgtttattctgaggactatgagaaaccaattacagtatttttaaggcaggtagtgccaagatcagttttatgttggcatggaggagggtgagtgtgatatcaaggatgactcccaagctccgtgcttcagttgttatagagatggttgcatggttatgactgtcacgggggacagaaatcaagaagcccttatgcaattcggccactgcgagaattcagctcaggaagctcccaagcctgtcggattcagtttctgagtgactgcgaaggactctgtacagaatgggctggagaaagctctttgcccatacagttctgatgatgggaaactcactttttcacaaggaaactcacttcagtttcagacagctctgactgacaggatgacacgtttattcaaattgacccaaaatatttagtccacttgaaagtttgatgtcttgtgacacagcagcttaaataataagcgttgatgcctttttttttaaataacctgattactaacctagtaggcaaaacatgcttagtgcaaggctttgctattggtgttatttgcacaatacaaacatcacgacaatcgaggagcaataagtcctgtctgtcagcaggagtactgctgacatttaaaataagaaagctaaataaacagtcattgttcagcaatagcttgattaatttccctgttgtcaaaaggtatacacagatactgaaacagaaaaggcgttttacattgtcttatagcactgaaaattagtagtagttaatacttctagttttaaagcatgcagttagcatttatgtaatctgatcaatctctaaatattggcattgtgtggcaaggctggtgtgcccagcactgtaggagaacagtaaatgcacactacctctggatggttattcctaaatttattttttaggtgtctttgctttttatttttttaataagggatttcaagggaaagataagccttaacgcctgacaggttctgcctgactgagccagcagcatctgtgcctccaggtatgtggaggcgcagcataaataaatgccagaacgtgctcaaagcaccagccttggcttgggataagtgcccaccccagggtgtgttttacatttgtgagggacttaggaggaaggaaatgtgttttacatttgtgagggacttaggagggacttaggaggaaaccccttcacacagatacattaaatattaaaagataagatgatttaaaactactagcatgccaagtaaaactttgctgttggaagtaaatcattctgatgaattttgatgggttgtttaaacatttatgaatagagtctcttcgtttcccctgtagtcagacattctctacccccttactctgctttgtttttgcttcatagcacatattaacatttacttcctaatttcaacatgtattatttcatttattggtttatggtctctgcccctcaataaagtctaagctctgtgataggagggcaactgactgtcatgttcacagctgtatctgcagcccctgttacagggctcagcccatcggcattcaataaatatttgtgcaatgagtgaatacacgaataccaaaatagacttaaaagagcaattgtttcctgtgctgtagaaaagttgtgatttagctgggtgtggtggcatgcacctgtagtcacagctacttgggaggctgaggcaggaaaattgcttatacctgggagtcggaggttgcagtgagccaagatcacaccactgcactcactccagcctgggtaacagaaggagactccagctcaaaacaaaacaaaacaggccaggcacagtggctcatgcctgtaataccagcactttgggaagccgaggcgggctgatcacaaggtcaggagttcgagaccagcctggccaacatagtgaaactccttctctactaaaaatacaaaaattagctgggcatggtggcatacgccggtagtcccagctagtcaggagtctgaggcaggagaatcacttgaacccgggaggcagaggttgtggtgagccgaaatcacaccactgcactccagtgcgggcaacagagcgagaccccgtctcaacaacaacaacaacaaaaagttgtgatgattacaatgggaacaggtttttatttgcctggttcaggaattttttttatcacatgaatatttttggatattttacaggctaaatattttcgtgaagttctttaatcatgtaaaagaaaaaaaatatatagccattgtgctgtctccacacttgttcggtctctcagctgttctcttactcctatcctgcccttcctccttcctgtcacggtgttttagacactttttgttctagtacagtgcttggttctgcccactggacgagtactgactgttaagcagctagatagcaggcataataagtaggggacaccactagaagaaagggggtccgctatccattcccaaataggtccttactggccagagtcaagcacctcttcataagccctgggcatcaagagatcccgcctaaatgatttcagatagtactctgtttaagcagcatgcaggaaggagattctccatgcaggaaaggcaaagggacaatgacagagtgaaaatgtgccaggtgggtcatgggcagcatctttaatccaccaaacactgctctggtgggtcgtgtcatctccacttcccatgtatggaagcaaaggtcttgtttcagagccattctctggcatagtcaggagtcggtcacactcttttgcctccagagcccctgctgccccacagcactcctcgacacctcttagccatagactcttgattactgtcttcttcaacttctgttttgtcaccgttacttttggtgggtagtgcttgttttgacagttttctctaatagtaagctatcatctactttctgtataaatttgatgggtccctcttccattttgagatacgtccagaggttgactttgaggtctgagaggtttttcttcctcaagtaaatatcttgtagtagattcattccaaaaaatatactaatgattccatttttagatgatgtcagtgtatactaccttctaaaaggaatgtaggtaacgttctctcagtgctttgagtgctgaatggaaacatcataagatgtttttgaagatggtcatttgttatagatggtgttcctttttttaatttttttttttttttttttgagagggagtctctctctctcacccagggtggagtgcagtgaggtgatctcagctcactacaacctctgcctccttggttcaagtgattctcatgcctcagcctcctgagtagctgggattacaggcgtgtgccaccatgcctggctaatttttgtatttttggcagagacggggttttgccatgttggccaggctggtctccaactcctgacctcaagtgattcacctgccccagcctcccaaagtgctgagattacaggcgtgaaccactnnnnnnnnnnnnnnnnnnnngatatgcattagattctatgtgtatcgtgtttcgacacattagagtgagtaaagtgcgatatgtaaaatagagtaattagataggactatatggcatattgatggtccagagatagaggatcaaatcgaacgaatgtcatctaccataggtaacttcgtactactgtgtgttttatggagattataatgagactcaggcagccctatattaatatgtgaataaacaggacgtatagtccaagcacgccccatactatttatgagtaattatatagttaaggcaagtgtttccacttaggagagccaatcataatatggatcatcactaacataagagtaaaacaacattcattgagtacatcacaatattgtgtgagaactcaagccaatactcgctacacctggccaaaaccataaaattttatgatataaaggagatgggcacagcactaagcacaatgcatgatggtatagactattggtgtatgagtgatccgtccaggcactaaggttaggccctaagattcccagctattatagagattactatggggtgtgtctcctaaggtaagatgtgcgaacctaggttgggcaccatggtgagacttcaccgctactaaaatcccgagttttgcagtctgtggtccatgcacgtatagcccgagctactctgggaggctgaggcaggagaatcgcttgaacctgggaggcagatgttgcagtgagccaagattgtgccgttacactccagcctgggtgacaagagtgaaacgctgtctcaaaaaaaaaaaaaaaagtgtgctgagtgggctaaacacaggttacagaagcagatgttgtatccccaaacgtctggttctaggttttgttttgttttgttttgagacatagtcttgctctgtcatccaggctggagctcagtggcacaatctcggctcactgcaaactctgccacccaggttcaagcgattctcctgcctcagcctcctgactgtagctgggattacgggcgcccaccaccacacttcgctaatttttttatttttcgcagagatgggctttcaccatgttggccaggctggtctcgaactcctgacctcaagtgatccgcccgcctcggcctcccagagtgccagtgttacagacatgagccactgcacctggtctggatctagattcttaactttcctgcgtgacaccctcaggcatcaagcttcaagggctgaggaaatcacaagttggcaatacactgatgaatttacatttggaaggagtaccagtaaaaagttaaattatagtaataattatagagatttagagcagattttagttgaagaattgaaattgacatttgctagccaactcttttatgaaatgttgctagaggatgtaggaacaagatttctcttggtttaactggactgtttcctgaaagagcatttacaagacatcttctggtgtttgtttatgtctttttcaactaaatgtaaaagaaactttttctttatgactatgatgtaacattattaataatgaaattagattaagaaattatacctatacctgattttcttttacatttaatagtttatctttacattaaagtttctcttattgaatagtccctggttaattgtagagtttgcacatctcaaatatctgaatagcattatcaagttatttttgtgacccatcacataagttagagtatgtcaggtaacacacagtttctttactctctttccattcggtactaaatgtatgttttgtttaagctttagggtcaggaggaaggccaacctgtacttaaatttccctttctagcagtttaaataaaactgagctttaacaaaattcttaaaagcttaagtcacacactcaaaatagtggaatttcaacactagatttatttttgtcttccttttgatgcacgtgcattccacattaggatagacattttatttaaatgcttccatagcctgtgtattgattttctaaagataagtaatccttcatgtcaaatactttcaataaaactaatttctgctacttgtatattgccagcattgaatggctaggagggagtcataaaagtttaatcaaaccaagcatacatttgttattttattgttcattgttacaatagtgacagcaataacactaagtacagctaaaagcatttgttgagtgtatttgatgtgccaagtactatgcatgttgctgtatgatctcatttaattctctaaacagtccaagggatgcataagtaacttatttgcctgagatcacctagtagcagacattagaactaggattcagagtcaggtactctgactcacctgtgtgggctggtaatttcttcaacttctttctcattataccaggaagtttttgctttgaaatatgtgcatgcatattccactgtattttttttcccttgctctttcataatttttggcaactgagttgccttgttgggaatacagtgatgctcaaagaagatattattgggttatcagagtaagatatcatggggacaaatctgaaaagtggcatgtgccaactagtatgctaactagtagctaatatatatactagtatgtaattgccttacctacagtaaaatgattttgtaggaaaataagatttgttgaatgtaaaggcatgaacgcacagcgtacaaagcaagatttggaactttacaggatgttcattggcagaaagctgcttttcttgcacagcgtagcaggaataaatgaggaaagcatgttacggaatcagagttacaatttagttagctctaggattatgacacaatttcaataatagaggcagcccagaataatagccaagtaaatagaatccctaatctttggcttgttcatatatttacccaacgtagcctctgaaatcgctgaaagctttttggaagaaagaaatggaaaggagcacctgcgttctcaaggctaagacctcccttttgtaaatgcactaatattttaagagggtgtgtgcgtgtttaatgtgtgggtgtgtttgtttaaggaagacactgagcttcaaaaggcaagatgttttgtaacccagaaatgtaattgtaaatggaattattaaatctgacaatgaaattaaaataaactaatgtgtaaacagggcacatatgtggggctgtacttgctggctcaacttctgtctaacacaggttcagaggcttcacttcagttaataattctagagagacagagagagcctcatatgtgaatgccgacagataccaatccagcacagggagcagcagagtctttttagttcaaaggaagagaagaatttcacttcctggccgatagtctgattttctcaagaactgattgtagatagagggaatccacctttagcaaagggtgtgggtaaccacagtcttgtagcagagaaaaacttcaaagtcaagatggtgagccatacagttgccctaggcttgggagagacagatctggaatgaggattctgatctcataaaattcacttaagatttttcaaactgccaggctagcctttgtagctacaattcttaatcagtaggctgagtttggcacatataattatttcagcagaaaaaagagccattaaactattatgatgaattattagaattggtaatggtgctgagaatactcaaacctccttttcactcccaaatctgtttagataatctgctttttggtacatccaagttattgttatgtctagtaatggaggacggcatagcacagacagctgtatatttgagtgaatcgcaggttctaaaaagagatttctgatctctttttaaaattgtggtaaaatatacatgccataccatttgccattttaaccatttttaaatgtatagttccaagccattcacaatgtcctacacttacaatgctgtggagccatcaccagtatccattttcagaacttccccatcaccccagtgaagaccctttatcacagaagtcaacaggtagaaaaatggatttattttaattccatcttttatttcttttagtagataaacagttacctaataagcagatggcaaaaagtagaaaaaagctgtgatttatgagctggataagtagcttgtgattgtgagttttatgatagttttatgatatttaatcacagatcaatgttttggaattgaacttgtgcaaaaatagtaagcaacctcctccttcaactcttgaactaggaagcaggttttcataaatcttcgggtctgattattatagtgagttactgagcatttctgtgtgttaaatgctgtatcttatttaatccttattaacaatctagcaaagtagatgacattgtgccagttttatgaacttcaaacattatactaaactccaacattttacttttacttagatttcctccagcaggggttaagtgattagtctgaggtccttacccagttgtttaacccagggtaatctcttactaaacccttgctctaaccatcaggatatattgccttctttcgagccacctaaagttttatttagaaaatgaaaaaggtatttttttctctctattctttcttggcaccccttcaaaggaaaacttttgtatagtcagaagagaaatagcctgaaatttcaaataataagataccatgcggaaccagataatgttccattcagccccaaattcacaccagcacagtgcccctgaggctgttggtggaactgcattcgaatagctgctctgctgaccagcaaggccccacggggctattgtcctgtagggggtcctcaggacattttcttttttggagcctgaggctctttttttggtccaccagactgttcctaactgatacttataggccttaaatagaaatctggctaatggaacttaattaattaatttctactaagtccagtgctgtggctgaaatgtaagaatatgactagcttttaacttttattttttttttttaaattttttttctaggttcggtgtacatgtgcaggtttgttatataggtaaacttgtgtcatgggggctttttgtacaaattatattatcacccaggtactaagcctagtacccaatagttatttttttttgctctccctcctcccatgctccacactcacataggcgtcagcgtgtgttgttcccctctgtgtccatgtgttctcattatttagctcccacttataaataagaacatgcagtaattggttttctgttcttgtgttagtttgctaaggataatggcctccaactccatccaggtttctgcaaaagatgtgatctcatttttttatagctacatagtattccttggtgtgtatgtaccacattttctttaaccagtctgtcattgatgggcatttaggttgattccatgtctttgctgttgggaatagtgcatcagtgaacattcacgtgcatatgtcttcatggtaggatgatttatattccttttgtgtatattaaccagtaatgggattgctgggtcagatggtagttctatttttagctctttgaggaattgccacactgctttccacaatggctgaactaatttatacccccgccaacagtgtataagcattcctttttctctacaacctcaccagcatctgttatttttttgactttttactaataaccattgtgactggtgtacaatggtatctcattgtgattttgattttttagctttgattttaaagaactgatgaggtatttgtcctgggtgtcttggcccatggcactggccacgcctgattggtgttacgagtccatccacctggccacatacacagagcacccagacctcccctctcctgggcagccttggacacccagtccatgaacttcccttgcatctttgaaacccacaagcagcgatacttccttccccgactccacaagggaagatccagtttcagggagacccaagctatggagggcagtccctctgtgcatcttcctatccccctcacacctcctgccacacctgacagggcttggtggcagtgagacactgttttctctttgtccaggaacaacccctgcttttccagtgaaggtggggagtagaaatcaggcattaaagcttgcttgtgtatcacccagactttatgaatcggaggaaagacagaatcatttaagtgaaaaaacagctgcttcaggtacaaatcctgggtctacagagttggtctttgatcaaacaaaaagatcagtgttccctagacatcattaaattctttttaataacgggtgaactgatttttttttttaatcaactgggaatcttcttgaaagaaatagaaccaactctggcttatcaaagcagaaaaccaattttttttttttttgaggccacagactcaaaggaagaagttacaacagggctccagaagagcagctcggtggggcttggcagaggagagggtgtgttcttcatggggctggtactgggatggctcagctccagccagccatagacctttctgcattcggctcaagactcaatcctggaagaacacatctggccaccctcactggctgagccaggggcagggagagcttcctcatttgttggcccaccgcagggtgtctgcctgcacactgttgacgttttgggaccagataagttctttttatggggcctgtcctgtgtgtagtatggtggttcactcctccagtgtgacaaccaaaaatgtcatcagaccttgccagatgccctgacaaaatcaccctctaaaccactgctctaaagcaaaattattctcctaaccagaagggaaatggatgctaggtggaaaaaagcaatatcctaccccattgacaccttggtgctgtatgaacagttatgtatttccatggctttctccccaactcatgaagttcctcagaacagaaatcatgtctcactcatatctgtgtgcctgctgtctccagtacacagtgtttagcacacaagtgcttagtaaacatttccttttgataaatgcatgagcagacgttcagtctgaagtggagtcaggagtagtcatgtttctgcttgctgccgtgcacagggagcttggcctgcaggcagaggcatttatctcagaacactaatgatgggagaggtccatgcctatggggagtcagacctaagcaactccatccacctttctgctaaaatcgcccactttggcagaaatcatgacctatcaacagatgaccagtcctctaccaacttcgtgttttccttgagaaatggctccctctgggctcctgcctgactgaggttgggttctatttctcaggctcagaacagtcagaatgaaagaagcttcttaggtgtgtgtttctgagcttttctcataataattgatcaacacaaattattgtcctgtagaatgttcctagtaatcaaaacataccctgctttttaactttttaaataaaaggactgccttcatctccaaagggcacctcccgtctgggagacttcttgagcaagtgcagagccccagcttccacacagctcacactgacaccacgtccctttctccgtccccactacagatctgtaggccatatccatgccaaatccactagatcattgtaggtgcttttccagctagctggtactcaataactttgaacagtgtcccaaataaattatagttttacatgaaacaattgttttctatttcacctgagaaatcttttttagttaagtagaaaattacaatcgtctacatctttcttgctcagtatttttcaagttatagttgccagttgagagaaacgacatctcattttcaggcttaacaggtttccgcaggtccatctgagccatggggcttaaaggcgagcatgcagcagagtcactgggaaggcttattaaaacacaggtcactgggcctatccccaggttctgattcagcagggctcggatgggggattaagaattcacatttctaacaggctcccagttgacacaccagtgatgtcagtccacttttaggtccactggatcatagttttcagaagaaagtctcagccagtcacagaggcgcacgcctgtaatcccatggggcactttcagaggctgaggtagctgggtcacttgagctcaggagttcgagaccagcctgaacaacatggcgaaaccccattcctacaaaaaaaaaaaaaactagctgggcgtggtggtgcattcctatagtcccagctgaggaaggcggaggtggaaggatcacttgagcccagaaattcaagacttcagtgagccgagattgcaccactgcactccagcctgagtgacagagtgacaccctgtctcaagaaaaaaaaaaaaaaaactcagtaatttttatatataatatatacagggatctctaatcttttggcttccctgggccacattggaagaagaattgtcttgggccacacataaactacattaacaatagctgatgagctaaaaaaaatcaccaagaaaaaacttcatagtattttaagaaagtttatgaatttgtgttggggcacattcagagtcatcctgggccacatgcagcccacaggccatgagttggacaagcttgatatataacatcttcctaataaataacatgttttttcttttttggggttgtttgtttgttttgccttcctgaaattcacattaggcatttaggcacagatagaatggatgaatgaatggaaaaaactcttacaaatattcaattaatagtttcttcattcattcattctttgagtttcattaaatttggatcatactcagccattgatcaaacagccatagtttcattttattgggcacctttgcttggtgtcaagcaatatataaaatagactcaaagaaaagatgtacctattcttcttcttccaagctttaaaataattctactttttaattgcctggtaatcccctgtatttatgaaattaaatgatacaccaacgatttcaccctagggccttaggaaagggagccagaatgagatttcgtctttgcaaggttggcttacaggtatagtcaaactgccaaccaattgctctcaatcatgttttcaaataattatattaattgtacatccaaaagggcattcaagggttaaacaggtgaggccatgagtatgctgatttttaaatgaaggtctggttggattatatgttcattatgtattacaaaataacaggatatgaacttgcagctttgtacacatatatatttgaactcatcctggagctgacaggattttttcttggcgaaagtgtagaaatatgcatagttaggagccccttaaatatgtgaaggctactgtttgaaggggttaccacaggcacttggagaccacccagaaagcatccctaagcacagaactcttgggcactttttcctcccagtatcacgccaagacaggaactccagcagcaaccaagcattgtgagcactgttgtgccctgatgggaagaggctcttggtcgttacatgagtgcctgtcctggtcatgagtgtcccggtcacagctgggccaagccaccgttggcagtaccagactacggccctgtgagacgaagccactgatctctgccctctacttccagctagatgggcacagtcgtgactgcttgtaaagtgtgctccacagaacggaagccgtgtaagttgggtacaagtgctcatgggtggcatcaggaaataatgagacctttctctcaagattttctacatatttaggttctgtcacatcaaggatgctgatatttaaatataaacctttttagaatgtatttgacagaatttcggggcatgaggcaatatatcatagcgctttaagagcatgggctcaggaaccagactgccagggttaaagcaaacctatgagttgtgtgactctcttggcttctgttttcttacttgtgaagataggtgtctcaaggtgtgttttaaggagaccatggatcagtgctcttaggacagtgtctggtgcacagtgaatgctctgtaaacagccaccgtggttctgggagtggagtggctggtgttctctctgatgagccccgtctaggccagctgtctgcaggtcaagtcctcctgcatggtatttttctcctcactttctctccagctgtatgtctgcagtcactcggaagaagaggactggaaagccgcagtttggaaaccctgccgttttaagactcagtcttggaatcttgttgatattataatttaaattagtcaggccagaataattaccctagtacttcaaggttatgaaacacgctaatttgagcagagccgtcagaacaaaaatgttctggcttgtaccatcttttcttagcccatttgtctctcaggtaaaatgaggagaaaaatacattaaattctcactctttaactactctttatatattctctgtccctctcagtaggacaaataggtgaagatctactacctgcttccttttgtgagctcatatttgcaatgtgtgtcctgatgcaattttgtctttcttatattgctattgacacttttctctttttaattgtaaagttattgcctgtttgagtccttttggcaagatccattcattctccctctaatttaggtgatttccagagtgaaatgtgtttgttaactccatccaccttggttggagttaacagctccaagctggttcccaggggtgcttggaaaatacaattttaatcgtcacccttctaaaattaagacttgaaggcaaaggggacatctttgtcagctttaaaaaagaaaccaaagctttcttggaatttttttactatggccatatacaaaatccaaatccagtttttcttacttgtggaactacctgaaacattgtttttttttgtttttttttaaattttctgtgtagggtttagttcatgttaacactcgcagaacatttaaatctaattagagcagggctagcataacagtgtgcccaggattcttccccagtaactattcttcattatccttccaggctcaggtcctgatttcctcctttttgaaccttcatcttcagcaatcacatacatacaaaatcaccaaaccagttagctctaactatatttctttagaaaagcccacaagtgtatatatttttctcttgtggccacagttgccattctgtgagatacaggaattgttttaaggtgggaaattggagaaggacgtgtgttagttgggcctgtctgctgggaaggagagagcaaggtcatatttatattggcagtttgttgagttgaagtgaaccacttcaaagaacaggatagccatacttacctgaatagcttggctctgaataaatggctttctcttctgagaattccagtcatttagttataaacgaccagtcatgtaattatagaaatgtttcaaatatagttttttttatttttaaggagcagagagagtttaataggcaagaagaagcaagagggaagggagaaggaagaagctcccctgtacagagacagaggaaggggggctccaaagccaagagagggaaccccacctgccacagataccagctaggtatatatacagaggctggaggaggcagtgtctgatttgcacaggctcaggggattggtttgactaggcatgtcattcacgtagcccgcaggaaaagctggctctcccaccctagccttttaatatgcaaatgcagggcaccatgatcttctacacaggtggggatacttcggggtgtccatgtatccaggaatgtggggaaagggcaagaagtccacaggaatcgccatgtttgggtggacccactttctaatggctggcatttggatatcgggtaactggcctggctttaagagctggagctttacaagaaacttttccagacgtgctttaaaaaacaaaaacttcctaaggaccccttttcctctctatctgcctaaaataatttatcaataactcctacaacattcccccctgtggagatgccgcactaactgctgttagaggtttgggcgacgatgtcttctggctacttcctgctggaaaggggcgtcgaatggggaacagcagctagggctcctcctggggttgatctaagggtcctcggaagactgacgtgtccatgtgtggttcagtttatagcaccatttggagtttgattgctgtgagttgggtgatcctctcctcttgaggtcccaagataaactcagagcttccagacagataatttccaaattctagaggaaccaggcagagaaataaacatgcttcaaattttgttcataggagtacaccttactcaattattaaaggccataaatagtttaaaataagtttccttgactcagtctgatgaatgaatttcctttctcggccaacgcaccaaaatgatgtggctccgatgagtggtggagcaccagggtttttggtcctcatgccagcttagatacaaggacacggacacacgtggagtggttttaaggagcagagagttcaataagcaagaaggaaaagagaaggaagaagctaccctgtacagaggaggagggcgccaaagctgagagaggcaacccctcaaatattaaaaaggaagaaatggcgtgataggctagcacattttatggaaagccatgtcttaattaaatgttttccctacaaatgttctctgtatcaagaaacctggcacatagggaatgcatgaaacctgatttataatcagattcagtctacttaagtaataacctatatctagatgatagattgtcaactgtgctactttagccatcatcacatacccagcgtttctatccttagtgacacagctgggccagaggcaaggcctgcattcatgcatgcagattattttactgtaaaaaagaacactgtgttttgaactttaattgcacaaatagacacagcaatgacattctcttctagtaactagtaacagcccattattcctcacatagtacctaagatagagctgttagaatttagatagacattagatagacagtgaaaatattttagtctacagttgaaactgtaacaatattggtattgttctcaactacccctggtctagttaagggctttcaagtatgtgtttggaccaagtattttcatgtccaccatctagatagtccttggtctatttcccaccccatgtgctttctggtgggatgatcacatctgcacctctagtccccaagctgtccctgagctctgtgtcctcactgtctccacatggagtgtccccttccacctcaaacttgacaagggttgtgtctccacaccaccctgctcctcctggattccagcccagtctgtccttccttttctgttggttgccctggttcagagccctgggacctctcatgttcctctcccagagtctcttccagccttactctacccgccagaccacttcttggtcagcatacattgtgcatttccccaggtttgtgcctttcctatattgtctcctccacctaaaaggcccaatctgttaagtttctgctcaatcccatctcctccacaaacctgctgaatctcttcattggaattcatctttctcttctgttctccacactgactgcactttgtatgctattagcatctacagtttactttttctcaagattttatgttaaaatttttcaaatattcagaaaaattgaatgaacagtacaacactcatatacttgccatttagtaaacattttcctatatttacatctcttcatctccgtatctggccttatgtttttatgcatttcaaggtagcagacatcagtacattttacacctagattcgtttacatgcatagcattagagttcaatagttgcttactgtatttaggtaaacttttcatacagtgaaacgcaaaatctcaaatgtacctttcaatgaattttgatgcatgtacacacctttataactcaaatcactatccagatgtagaacatgaccatcacaccagaggccctcctgccccttctcagttgattctaatatccactcccgaaagcaaccacagttctgatttttttcaccatagattggtttgactaactttttgaacttcatataaatggaatcaaacagtatgtactgcttcacataaggcttctctcactcagcataatgtttttgagatccgtttgtgttgttgcatgtatgaatagtttgttcctttttgttgctgagtaatattccatcatatgaatatattgtagtgtgtgtattcatgtcctattgatagaaacttgggttgtttcaagcttggggttgtacaagttgtttctttgttgacatatgctttcatttctcttggataaatacctgggagtgaaattgctgggtcctagtgtaggtctatgtttagtttcgtaagacactggttaagaccttttttcaaagtgattgtatcattttatcctttcaccacaaatgtatgacaattcaggttgcacacagccttgtcaacatttggtgtagcacagtggctcacgcctgtaatcccagcactttgagaggccaaggcaggaggatcgcttgagcccagaagttcaagaccagcctgggcaacatgacaagaccccatctctacaagaagtttaaaaactagctgggcatggtggcacacacctgtggttccagctactctcaagctgagacgggaggatcacttcagcctgggaagtcgaggctgcagtgagccatgttcacaccactgcacatgctgtgttgtccaggcctggacaacagagcaagaccttgtctttaaaaaaaaaaaaaaaaaaaaaaaaaattagctattctggtggatgtgtaatagtatctcattgtgggtttggttttcatttccctagtgactaatgatgttgaatgtcttctcagtgcctattagttgtgttacttattcagatatcttctgtgaaaaacctgaccttgtgaaggtaaaatcttttgtcaatttgtaatttaaaaaaacatatttttacaatgggtcaaaggagttctttatattttctggataccagtcttacgtgagatatgttttgtgagtattttttccaactatcatttgtctactcattggcttaatggtttcttttcaagagacattttaaattttgatgaaatctaacattttttccttttatgcattgctttctgtgtcctaagaaactatacctacttcagggtcacaaagatacttcatgcggtttttttaagataataattttagtgtttacacttaggtctgtgaccatctcaaattagtttttatgtatggtatgcagtaggagtcaaggctagttttctgccgtatggatatgcagttctgcccagccgactactctcactcttcatgttgtgactgagcctgcccacctgtatgcccatgacctggcctgatcctttacacacaacagatgcttccttcatgttcactgaattgcaatacaggttcagagaacaatagaggattcctgcaatcttttaatgccttgattttgaaaatggttttacagaattcatctcccaaagtaaatatcagtatatagagcctgttcaacccttcagttagcatttcctgccaagaatgtaggttaaagcaataaggttaattgcatcaatctttgtttttggcttctttagagtgaagaaaggacatgaattcagctttttattgaattcttaatatatgctaggcatggtgcttcattgcttctactacatcttcttgtttgatccttatagcaaccttgtaggaaatttggatgccagagattttaagtgacttctgcgttacacagttactaagttgcaaagctaggagttctctgggacagggaaatctggaggagagccaataacttgattctgatataagatttctataaaagaattaacatctaattgattgtaaagtgtatagaacttgataacaaaacttgatatgtaattaaacttgttaaattgtgaatcatcccagtcaaagataactaaaaaaaaatcagtcttctaatatcagtctctaagggtatagtcatatatgcaaaaataatagcccttaggaaatatatttaggcctaaatctctaagctaaggatggatttgatagtaaaaatacattaaaattataaatagctccaaggcccacacactgcccatgactttataaaatgttcttgcattcaggttatacagccagagtcttaattcagaaagccagagtgttcctctagtgtgtggatttgattttgtgtctttgtgcttcctgttgcctcctggtgaacgcagttctgacctttcctttgtttgcaggtatgcttcagaagtgtccttctgttgatgacttcgtaagtgccctcgtttccgacttggatctggacttcgaaactttcctcatggattctgaataaaagaaacactctacacctcttaaatcaaggtcatgtagataatgactttgttataaatgctacagctgtgagagcttgtttctgatttcattgttcgcttctgtaattctgaaaaactttaaactggtagaacttggaataaataatttgttttaattattctggcttttcacctgtttggcaaatatttgagcacatggaaatctctgacctagtaacaacaacacttctacatggcattgttaaatggagggtatgggcatttccttagtataaccactctcctgttgagcttttccctctttccatggatctttaattggtttaattaaataattaactaaaagcaaaattgtttaagacagagtttgaagcagtcttcagacaggttacacttatagttcttttaagaatgatgaccatttcttaagaccactatctaaagtaggcttagaaaatgcactttaaatagtcaattacaggcaaccaacaaaccaagtgtggtttccaaaatacatgtaattatctgtactgttttttcctgaatgtttaggcaaatagactcagaacacagaggactggcttggcaatgaaggtagaatgagtaagtgcaggtacaattaataagtgacataccagtgtcaagcaactggtgaatcaggaaacagaccatgtctgtttttatctggaactcatttgctttacagtattgcataccatactgtattttggttaatatcaggaaataaattatttaatgggtttttcccaccattaaagtcaaaaccaaattatgaatttccagtttaaaaaggcatctgctaacagcctcttcttgcttctcaccaaagaccaatgatgaaaggaaagattcaaaatacccaaaactaggacacacattcaacctatttgcagaatctggaggaatttcttcatgctcagagatgggactggatggagaaacatcatcagtggccggcctgtgccaggtgctcctggatgcaagggggatcgacccttcatgctttcccacctcctcctcacccttagaaatccaaatcggtactgaccagaaagcagagcagccagcaccccaagtagggctttgcgtttgactgagtgctgcagtgggtccctgtccctgctgctccccattggagcttctctctctatacagcagcacttggaaactgcagctcacacagccttgggcagggagtcgggcaagcctggcagtggtgtctcctctgtacccaaagcagagctgaggaacggagacaaaggtttgaggaagggctctggtgcagtgcccagggaggaatcttgctgtttctatgtctcaccctatttacaatatccaagctaacttaaaaagagatcttatcctgacaaactggcaatacacagatgccagctcattctgggaaacagacttggagacatttacaggtaaatcagttacaggtaaatctgaaaagtgctttcatcagcacccaggtgcaccgacagtgacaaaacccctgcatctttatcaggtcttttttgtagaggtgagtaaccaaaaaaagaagtctatgtggagcctttttaaaagcattcttcagaaaagggaaaggaagacttgacctggaagatgctggaaaatcataacttagaaaattattatttcttttgagacagagtctcgctctgtcactcaggctggagtgcagtggcatgatctcagctcactgtaacctccgcctcccaggttcaaaggattctcatacctcagcctcactagtagctgggattacagatgtgcaccaccacactgagcacatttttgtatttttaatagagatagtgtttcaccatgttggccaggctgatctcaaactcctgacctcaaatgatccacccaccttggcttcccaaagtgctgggattacaggtgtgagccactgtgcctggccaaaaattatttttttaaaggagcaaattgctccttgtacattgcagcaaaatctctctgttttgtttgtttgtttgtttatttgtttgtttttgaggcagagtcttgctctgttgaccaggctggagtgcagcaacatgatctcggttcactgcaacctctgcctcccgggttcaagcgattctcctccctcagcctcccaggtt

SEQ ID NO: 13547 - DNA, 46085 bp, Human
  misc_feature (1)...(46085): n = A,T,C or G
gctagttaaaaaaatgttttgactgggtgcagtggctcacaactgtaatcccaacactttggggggccgaggtgggcagatcacctgaggtcaggagtttgagaccagcctggccaacatggtgaaaccccatctaccctaaaaatacaaaaattagccaggtgtggtggcaggtgcctgtaatctcagctactttggaggctgaagcaggagaatcacttgaatccaggaggcagaggttgcagtgagccgagatcccaccactgcactccagcctgggcaacaatatcaagactccacctcaaaaaaaaaaatgtttttcataaagtgtgacttttatcagacctctgcattcttgaaattaactctggcttggctgggcgtggtggcccacacctgtaatcttaacactttgggaggctgaggtgggcagatcacgaggtcaggagttcaagaccagcctgaccaacatgatgaaaccccatctctactaaaaatacaaaaattagccgggcgtggtggcatgcacctgtaatcccagctactcaggaggctgaggcaggagaatcgcttgaacccaggaggtggaggttgcagggagccgagatcgcaccactctattccagcctgggcgacagagcaagactctgtctcaaaaaaaaaaaagaaagaaagaaattaactctggctcctagaaggagccctatatctcagcaggacactcagtcattcaacagacatctgtcaagcacctgctgtatgctggagctgtgggtacgtcagcaattagaggaagagggcaggggtacaggagttcctgaccaccccaggccagcacgctcctatagcagctggcaaggagcagatgactcagacttcagctcagtccacaggacagccttttctggccactgctctcaggagatgagatgtgtggctgcaaaaggtaaactcctggctcctgagcaggctctgggcaatctgctcaacgctctgtgcctcactttctcacccagaaagtgtggacaatgagaggacttatctggctgggcgcggtggctcacgcctgtaatcccagcactttgggaggccgaggcgggtggatcacctgaggtcaggagttcaagacctgcctggccaacacggtcaaactccatctctactaaaaatataaaaaattagccgggcttagtggtgcacacctgtaatcccagctacttgagaggctgaggcaggagaatcacttgaacccaggaggtggaggttgcagtgagccaagattgtgccactgcactccagcctgggcaaaaagccaaaactctgtctcaaagaaaaaagaatcatggcagaaggtgaagtctatgttagtcccagttcccaggtcgtacatggcggcaggagaaagagagagagaaggggaaactgccacttttaaaccatcgggtctcctgagcactcactgtcagaacagcctggaggaaactgaccgcatgatccaaccacctccctccaggtccctccctccacacgtggggattacaattcgaggtgagacttgggtggagacacagagccgaaccatatcagcatgtatggggggcactgaaacttgtgcttggtgcccattcattcaacgagtgtgtgtggctggtctcctcatcttcaactccctgccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcccagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacgcaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgacgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcaacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttctgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacagcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcgcagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgactttgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccaccaccacctccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctccacctccacctccaccaccaccacctccaccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagttccagctcagagcagtgccagccccaccgcaactgcacggccctgggcctggccctcaatgtgccaggctcttcctcccatgacacgctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaa

SEQ ID NO: 13548 - DNA, 46085 bp, Human; identical to SEQ ID NO: 13547
  misc_feature (1)...(46085): n = A,T,C or G

SEQ ID NO: 13549 - DNA, 5989 bp, Human
agggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctggagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagttccagctcagagcagtgccagccccaccgcaactgcacggccctgggcctggccctcaatgtgccaggctcttcctcccatgacacgctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgcttcccgggaagtgaagcttctccccctctggggcaggctctgaagcctcccgatgcacccagagcaaccagggggctgcaccagccactcgcctccccagcacggccaggttcccggggctggaggtcccccccaggtcctgggaaccaacctgcagaacacacacagggtcccctggagaggacgcggggacttccagggcccgactcctgtgagtcacagccccgcagctgctgcgccacccccaccctgactcatgccccttcccagcagctcctcccaggaccccatgtccttcccacatccgcaggaagggagtgcctggactctccaggcccacctggggagcccctcacctgcccaccagcccctgagcagcccagtaacaccatcaccgtgtccaacagccaggagcctccaccctccaggagggaagggatggacagagccacactcgccgtctttattttgcactcaccctgggtgacactgggcaggccgctcctgcccacagccagactgaggaagaacacagcactcggcaggcccagtggggtccgtgcagggaggaccccaggaccagccttactcccgagcaggggacacagggccccacagagaacccctccgggaggttctctcctggctgggggagggctctggacccccacaaacactccccaacttgcggggctggggcataaaaacagccactcccagcaggccccctcagctttttgcatcagtcagctccctcccgggggattagggtgaggtgaagccaggcccaggcgtggggtataggtcttcccccgcaggcctcagccctgtcccgaggctgcatcacaatccagggcccccgctggcctttgggaacatggcctgggtcttcctcaaggcaagatcagccccagaccacttccggggtcacggggtcacgagggcagaagccagatggcagccatggctgacgggcctcctcctcgatggggcggagacagccacggggtctcccgagggtcccacagggctgtcctcatgcagcccaagccagcctgagcactggagccccaattcccaaccaggtctccctcagaccccccagaaagggcctcgaaaggccgccgctgcgccctgtggaaaggctgccgctgcagggcctgggccagccgggctgccagactcccctccaaagcctccggatgcctacgcttttccagacatagaggaaagtttgtcttcgagaaaacaaagtaaatagaagaaccccaaagcaaagcaaacccaccccccagatcagcagcatgggagccaacaggaggccactcctccagcaccaggggaccagccgtcccgacggcagcgcggctgcgcctacgtgatgtccctctgccgcggcggccggtgcacattccgcacgacacacttcaccatccactcgatgccctcgcgcacccctttgctgtgaagacagcgggtgtgaggcggggggtctcggtccccaaagcccccgcaggtgcagcccccactcaccctgtgagggccgagcaggcctgggtcaggcaatcgcgcctgccgatcttgctggtgcagtc

SEQ ID NO: 13550 - DNA, 30245 bp, Human
gtgccttgatcaccacaaaaggatgatgggaacggggctgtggggtcccagggaggagcccttcacctggcctgggttacaggatggctcctgggaagacaatgccagctgtgcgctgaaagtctgtgcaagctgctcccgtgaaaaggaggacattggcatggcagggctgtgggcaggtcttagtggctggacattcccaggagttagcactggctatcattctgtagggctccctcccacctccaaactcctggcttctacaccagggcattcacagacagattgcagactcacatggtggcatgtgaggctacagatacacttgcacaggccagaggatactactgcgtgtcccctggagccaggcctgggctggactttgttcctggcttagggatgcaacacagaatgggacaaggcctctgctcacaatggtctgtaatgtcacatctctgtggtctgccctgaactgcctgaagcagggactattgtccctacatgtccctagtccccgggctggcctggttgggttgagcaagaatctctggaaagaatgaaaggcagcaaatggagaaaacattactgagagcacgagagcaggctaaggccgtggtggtaagggactcgggcctgtgcaagagtaccaggaagacacctgtgggaggaggtggccgggtgaaggaaggggcagtgggaggagcttccatgcctagggaccagtaccaccccaggctggaagcccagagtggagtcctaggacatcagatcctaaagggcttgaataccgtttaaggcttttcttccgggagcaagtaggagccaaagaagggaagttgcgggacttgttttcgtggggccagttgcctggtggttacgcgcctctcctctgaagtcaggcatcctgttccagagtatcctggttgcgcttcaacttgcggagtgacctggggcaagtgactttaacctcagcttcctcatctgtggagtggggagggcgcagcgctggtcgccctgaacaggaagtgagacaacctcggggtgcacacgcgcaggcccgagccgcagggtccacgcccgaggcgaggcggcagcggcgcctgcagggcgaggggacgaatcgcgatctttttcagagtaacccgcgtacaataaaaagtccccatgaaaaggacaaactagccaggcgtgaggggcggtggctcacgcctgtaatcccagcactttaggaggccgaggcgggtggatcacctaaggtcaggagttctagaccagcctggccaaggtggcgaaacccccgtctctactacaaatacgaaaattagccggacgtgttggcgcgcgcctgtaattccagctactcgggaggctgaggctggagaatcgcttgaacccggagggcagagattggagtgagctgagatcgcgccatggcactccagcctgggcaacaagagtgaaactccgtctcaaaaacaaacaaaaaaggaccaactaaaaaaagaatataaatacaataaataacaggacttacgggggcaggctgacccctaaagtaaggggtcgggctggaaaggatctcaaggggtcagagtttgagccgccgaggcgcgcgagccccagcactcctaggcagctgcatccgccccggaagatcccctggggccctgcgctggctttccacagcgccatgttggacggtcctcccacttcccaccttcccagtcctcccgctactctgaccgttctacctgtgattctcgctggtggagtcaacctggaatggattcccgccgaaccacgcctccctttcctggttcgcccgcagtttcggcctatcaggttgagtcgggtaaaccaggacgggccaagcggcactctcattggatatcactggtgggggcgggaagaaggcggagcacgtgcccgggcggaagtagccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctgctcttgcttgctctgccaccccccggtccctgcgcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcctcatggagagggggtggagtgagtcaggggcacacccagcataccaggcctgtttccagaacagtctccccagagcagtatgagatggccactgaggggcgtggagcgagcccaggagattaaaatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatctcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaattttttgtatctttagtagagacggggtttcactgttagccatgacggtcttgataccctgacctcgtgatctgcttacctcggcctcccaaagtgctgggattacaggcgtgagccaccgcgcctggccttttttttttttttttttaattttttttttggggacagcgtctccctctgtctcccaggctggagtgcagtggtgcaatcatagcttactgcaatcttcaactcctgggctcaagcgatcttcctgcgtcagcctcccaggtagctgggactataagactacaggcgcaccatgccaggttaattggtctttctacttttttttttttttttgagacggattttcgctcttgttgcccacgctgcagtacaatggcgcgatcatggcttcccgcaacctctgccttctgggttcaagcgattctcctgcctcagcctcccgtgtagctggcattacaggcgtgcgccaccatgcccggctaattttgtatttttagtagagatggaggtttctccatgttggtcaagctggtctcgaacttctgacctcaggtgatctgcccgccttggcctccaaaagtgctgggattacaggtgtgagccattgtgcccagcctcatttgtctttttttaaatagaacagaaaggctgggctcggtggcttacgcctgtaattctaacacattgggaggccgaggccagtggatcacttgaggtcaggagtttgagaccagcctaaccaacgtgccaaaaccccgtctctactaaaaataaaaaaattaaccgggcatggtggtgtgctcctgtagtcccagctacttgggaggctgaggcaggagaatcgattgaacccaggaggtggaggttgcagtgagcggagatcgtgccactgcactccagcctgggtgacagagtaagactcgtctaaaaaaaaaaaaaagagaatcagtggataaaaaagtggatacgcttcgtttagtaagcgtttgtggagcgccaaggaagtgcacacggctccagtcctatgggacatttgaagggagtgagatgcagccagcttttaagaagagtatctttgttaagtgcatttaatctggtgtctttgtgttgtcttttaaaaggcatagtttttttttctttttcttttcttttgttttttttttttgagacagtctcaaaaaaaagagacggggtttcaccatattggccaggctggtcttgaactcctgacctcaggtgatccgcccgcctcagcctcccaaagtgctgggattaccggcatgagccaccccgcccgaccagtttttctttttttttttaaagaatttttttttggccgcgcgtggtggctcaacgcctgtaatctcccgggttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatggtggctcacacctgtaatcccaacactttgggaggccaaggcgggcggatcacccgaggtcgggaattggagaccagcctggccgacatgacgaaaccccgtctctactgaaaatacaaaaatagccagcgtggtggcgtgcgcctgtaatcccagctactcgaaggctgagacaggagaatcacttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtgggaagatcacttgagcccaggagtttgagagcagcctgggcaacacagtgagaccttgtctctacccccaaaaattagccaggtgtggtggcatgtgcctgtagtcccagctactcaggaggctgaggtgagaggattgcttgaggccaggaggtcaaggcttcagtgagctgtgattgcatcctgcacagcagcctgggtgacagggcgagaccctgtctcaaaaacaaaacaaaaacttcttttctaaaaagtatttatgtgatcttctttaagtgagagtcccttaagagtaatgtaggaattaagaacaaaagcctccaaccataatttttagtcaaaccaactgccaagagttttcttttcaccctgtgatgtggtttaattccagaatctgggtccaggcctaggtctgagtaaggttggttgtgccgctgagtctgaggaccaggtttcagatcctgaggacatcacacagctatttctagcctagaagattaaaggagagtagcaggaagtccaaggacactttgctttccatttaacttcagaatatgtgagtttagaaactaaatccacaaggtttttttcagagttgaattacaataaggtgaagtttttttttttttttttttttttttgagtcggagtctctgccgcccaggctggagtgcagtggcgcaatctcggctcactgcaacctccaacacccgggttcacgccattctcctgcctcagcctcctgagtagctgggactacaggcgcccaccaccacgcccggctaatttttttgtgtttttagtcgagatggggtttgttttttttttttggagacagagtctcgccctgtcgcccaggctggagtgcaatggtgtgatctcggctcgctgcaatctccgcctcccaggttcaagcgattctcctgcctcagcctcccgaatatctgggattacaggcgcgtgcctccctgcccatctaattttcgtatttttagtagagacagagtttcaccatgttggccaggctgatctcaaactcctgatcttgtgatccacccaccttggcctcccagagtgctgggattacaggtgtgagccactgtgcccggcccctacaaggtgaagttctgtattgcttttttttgttgtttttcttgagacagagtcttgctctgtcgcccaggctagagtgcagtggcgtgatctcagctcactggagcctctgcctccctggttcaagtgattttcatgcctcagcctcccaagtaggtgggattacagacgcctgccaccacacctggctaatttttgtatttttagtagagacagagtttcaccatgttggccaggctggtcccgaactccgagtctcaagagctccacctggctcagcctcccgaagtgctaggattacaaatgcgagccgctgtacccagccaagaaagagaatttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaaggatcctcactgttttttgtttgtttgtttgtttttgaaacagtctcggtctgtcacctaggctggagtgcagtggcatgatctcggctcactgcaacctctgtctcctgggttcaaacagttttcctgcctcagcctcccgagtagctggggttacaggcgtgcaccaccatacctggctaatttttgtatttttagtagagacggggttttgtcatgttggccaggctggtctcaaactcctgacctcagataatctgcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttgtgatccacccacctcagcctcccaaagtgctggccaccacgctggccttttttttttttttattattattcttttttgagatggtttcgctctgtcacccaggctggagtgcagtggcgcaatcatgattcactgcaacctcaacctcctgggttcaagcaatcctcccaactcaacccccctcgtagctgggatgacaggcgtgcgccaccatgcctggctaattttttcacgttttatagagacagggtcttgctttgctacctaggctggtctcaaatttctgggctcaagcaatcctcttgttttggcctcctaaaatgcttgggattacacgtgtgagccaccacatccggcttatatacgtgttctaaaaaggcagacacactggctagttgtcctggtggaaaatgataggaagactgtttcagggtccagacttgagagagcactgatcaggtccttggcaagagcggtttttctgtggtccttgttgtgggtgtggcatggtcacagcctctgacccagatatggccatatgggccgggcatggtggctcatgcctacaatcccagcactttgggaggctgaggcgggtgtatcacttgaggttaggagttcaagactagcctgaccaacatggagaaaccctgtctctactaaaaaataaaaaaatttagctgggcgtggtggtgcgcacctgtgatctcggctactagggaggctgaggcaggagaatctctttaacccgggaggcggaggttgcagtgagccaaaattatgccactgccctccagcctgggtgacagagcaagactctgtctcaaaaaaaaaaaatatatatatatatatatttatatataggaccatatggtcccacaaccctagggactctgaccctccccgatgacgacgtggtcctacatgacgacgtggtcctataaccctgggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtggagggcatggtgtaggatatgctggtggaaatttgaaatcctcacgatctgggaggcactgcattgtcagagcatcagccagtgtggatcaagtgtggatagttttgtatgtgtgtgtcagtggtgttgttcagagtgactcctaatatttggagatccttaaactagataatagcacttcatttacttgtgctctgatctgattataacgtctttaaactgaggaggggaatatttttaaatagtctctgtgggattttttcatctgttatttagaaggaagcgctgtaatcgttgccacagaacatgggcagaaagtcctcccatgttggtctgaaaggaagcagttgctgccgagcttgtcttgaaggtcctgggggaccaggctggcactgcgtgcacatggagcctttgcgtctggtgtcacggtgggaggctggtgtcaggaaccccgggcggttctcggcatgttgccccgggtattccagggacccgggtggttcgtgggcatggctacagcagccagctgtacatctgggtgctctggggacccgggcggttcacggcatgttgccctgggtattccagggacccgggcggtttgtgggcatggctacagcagccagctgtacatctgggtgctctggggacccgggtggttcatggcatgttgccctgggttttttttgtttgtttggttttttttttgagacaacgtctcgttctgtctcccaggctggagtgcagtggcgccatctgggctcactgcaagctccgcctcccgggttcacaccattctcctgcctcagcctccccagtagctgggactacaggcgcccgccaccacgcccggctaattttttctatttttagtagagacaggatttcaccatgtcagccaggatggtctcaatctcctgacctcgtgatccgcctgcctcagcctcccaaagtgctgggactacaggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctaggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaagctccctgcatcctgacccacgtgtttgtagatcctttcagctattggcgccctggaggatggacgggaaggagaacgtggccggtgggtggaggatagcactggtgcctggccccatgaggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagctttcccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactctttaggcacaaatgcaggtgcagctttcccatccccactcttagggcacaaatgcaggtgcagcttccccatccccactcttcaggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtaatcccaacacttttggaggctgaggcaggcggatcacgaggtcaggagatcgagaccatcctggctaacacggtgaaactccgtctgtaccaaaaatacaaaaaaattagccggatgtggtggcgggcgcctgtagtcccagctactcgggaggctgaggcaggagaatggcgtgcacccgtgaggcagagcttgcagtgagccgagatggtgctgctgcactccagcctgggctacagagcaagactctgtctcaaaaaaaaaaaaaaaagaatttgtgtttttgaaactaaatatagcaggtcattagttacttataactggtgttttattaataaaagaagaaaaaatttaaaaacagccatgattccagctgcacggagcctggatgggaaagtgcatcctctgggctgagcacggtggctcacacctgtcatccgagcgggctgggcgcagtggctcacacctgtcatcccagcactgcgggaggccgaggcgggtggatcacctgaggtcaggagttcaagaccagcctggccaacatggtgaaacgctatctgtactaaaaagacaaatttagcagggcgtggtggtgggtgcctgtaatcccagctacttgggacgctgaggcaggagaatctcttgaacccggaggcggaggttgtagtgagctgaaattgcaccactgccccccagcctgagtgacagagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccagatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgcagacgccaaggccctagagctttgctttgatgggatgtacccatgtgggtggacactggagggagctggaggggatagaagcggggccttcactaggggccaggacagacccttgcactgtgaaaagaggcctgggaatggaactgtccgatgttctgaaggcacacggggccccgccgtctggagcaggggcaccttgcgggctgcatggccactctgtgacgctcgttccccacagacgtggttgagcttgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctgggctacctcctggctgggcaccccagctgggcctcaggcacgccttctttcacaggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctgcctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcagtatgcaatgtgtgtgtttcctctgtgcaccctcacacgcccaaggctccacactccccagcagctgtgacttgggggggtccttgtggggcaccctacaaatgcaggtcttccctaccactgctgagctttggacccaggagggaccccctgagtttcagctgaactcagcctcgcagggctgttttcttcccgaaaatgctggtctcaccacagagcatcttcaggaagtaacaggtgtttgttgtgcctaaattatgccggccatcaggaggcgtttgcccactcttagtgtccacactcccttttgagtttgttcagaccattgtggtggaaatccaaggggcacgtggagcccttggcactgattggaatagccgtgcacaagccagtcctagggttttgatctgggcatttgtttgtatggcctgtttttctctggaagcacagggacacggtcctggttctctgtctgctcctccttctctgatggggagaaaggctttcgctctctgctcagtcctggggttggcagctgacccgtgtcgtgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctgggcccattcacctcgagttagagactgaggttgagagctcactacttcctgaaagtgaaaattgggttctgggaggtttatgtcatgagtttagggctggatgaaccccggcggacccctgctaactcttgggcggaagcccctctggacagctgcccaacgcccgtgtccatgatgggcctgtcccagggcagccccggtctgtgaggcctttggtgtgccctggggcatgggtgatggggatgggaggaagggaactggattcaggtcagagtgggggtttacagcagggtcaggtcaccgtctgactccgtggtctcagatgaggcatcggccctctcaggacctcgggcgagttgagtgtttctcagttcttcagtggctccctccatgtcagagtgggcctggctgcagtgagtggcagcagctgcccttggacacacaggtttccaggttggcgtctgtgggcacggatggagcgcagagcagaaatgctcggcgccaagggtgtcccacatcctcccacggtgcgtgtgctccctcagctgacgtgatttggggaacacgggccgctctcgttctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccgtgaggccaagggaggaccctggggtcgagtttcctttgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggatggagctggcctgctttctcctcttgtctccttatcactctgctgtcccagaagtgtccttggtcttccgtttgcttctctgagagatgtgcatgaagaactgcacagacttttcataacttcagtacgagagcccagggtgtccctgtaggggacagcagagaggggccgacagccccccaactgcgcagacttttcataacctcagtacgagagcccagggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccagggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcctcggcttgtgtgatgtatcgttcgggaccatgataagagtggtaaatgaactggcacacggtacctgccctaatgagtccgcacccttgggagaggcaggcaggggacagtgctaaagacaaagggcaggtcctcaatgctgggacaaggggagccagctgtgaggggagaatggtatatggccaacctgtgaggtcagacccagcgtcttgggaagaggagttgaaactgagccccaggaggcggaggaggagctcaccaggctccaggttgggccgggagctccagaggcttcgccagctgcccctgcaagcactgagctgctgctgagcacacctgtagtccccgccattctggagggtgaggcagatcacctgagcccaggagttcaggaccagcctgggcagcataccgggattccatctcaactaaaaacagtaggctgggtgtggtggctcatgtctgtaagctcaggactttggaaggccaagatgggaggatcacttgagcctgggagtttgacaccagcttgagcatcgtagccaggccctgactctacaaaaaagtgaaataattagccgagtgtggtggttcacacctgtaatcccagctgctcaggaggctgaggtaggagaatcatttgaacccgggaggtggaggttgcagttagccgagatcacgccattgcactccggcctgggcgataaagcgagactctgtctcaaaaaaaaaaaaaaaaaagaaaaagaaaaaggaaaagacccttgagggggaacctccactctgcccctggtctggcgctttgcatgtatccattcctagtctttggagttcccactggaaaactagtgggagcaccagtcttcctttggaggtcagaggtagctgggctcaccccagatgtaagagcagggaaagttaggtgacctcgaattgtatggtacataagccccaatacagcagggagctggtaccaataaagggtgaaatgcactattgccgcctgcagtcaagatttacactaatttattttggaatgagttcatgtgttcttcatttattgaacagatactgtaactgccctgcgggtaagagtctgctaggttttgtggggtacaagggtgaatctgatgtggacccagtgctcaaggactttgcaacccgtttgttggggaagacagattcccctaagtcactggcttgtgtttgacgaggtgaagcgattggagagcttcgaggatggagcaagtggagtaagtggacctgaggagcgggcagcaatgcctgaaggctcagtcccctcttctcagagtgagggtaatggtatctgcctcatcatattgaaaggcttaaccttataaagcacttagcacagggcctgatgtatcagaggtaaacatcagactcttcccaactgtagccactgtcaactttcctgtcttcttttttttttttgagacagggtctcactctgtcgctcaggctggagtgcagtggtgcaatctcagctcactgcaacctccacctcctgggctcaagcgatgctcctgcctcagcctcgcgagcagatgggatttacaggggcatgccaccacgcccagctaatttttgtatttttagtagagacagggttttgccatgttggccaggctggtcttgaacgcctgacctcaggtgatccgcccaccccggcctcccaaagtgctgggattacaggtgtgagccactgtgcccgggcgtaccttcctgtcttattttctccaagcaggctggaatgttcatggatagatatatgtgtgataatatactttttacatatcatgcatcgtgctcattttagtttcaggagttctttgctcctgtgtagcctttctacacattatctttctttttttcttctttttaaataagagatggggtcttgctctgtcacccaggcaggaatgcagtggcacaatcatggctcactacagccttgacttcccaccc

SEQ ID NO: 13551 - DNA, 9620 bp, Human
cccaaagtgctgggatgacaggcgtgagccactgcgcccggcccatactttgttttaaaaagtattcttatcatgctctactaatggtcatcacctgcagtttgaaaaatgccttaactgacacttgtccaagtgatcctttcgctgactcgtcaggccagatcaggcttctgggcactcatgccactactttcccgcagagctgtgttcacaatttgttacgttagtgtcagtttccccccactagacaactgttccatgaaagcagcaacatgacaacgatgctcacagttgtatcaggtgctaagtctcagtgctcaataagtatttgtggaacgaataatacacgagcaaacgaatgaaactcacacttaatgtgttattcctcccaggaggacttccatatagaactttgacaaatcaatatctaatagtgaaatttctagcacatttctttctgggacagggaacactgggtggggtagtaggctacaaggtacaagttctatcctgttgtatttaagagaggatctgattttaaaagtgacttatatacatctatttcatacaacttcggagtcatactttactctctctcattcctcatccaccagcaaatcttgccagaatttaaatatattcagaattccagtactcaatatcctctgtttacacaccatcacctctcatcatagtcactacaggaacctataattatcttcctgctgatacccttgcctcccttcactttcaacacagtgactttgtcaatatagaagtcagatagagtcacccttctgttcaggacccttaaatagttcccatctcaaagcaggggaagcctcttttacatacttcccatctcaaagtggggaaagcctcttttacagtggcctctctgcttaattttcttcacagaaattatcatcttctaacgtgtcatctatttttacttgctcattgtgttgctccgcctcgtaggatataagctccacgagggcatagatttgtttactgccgtgtcatcttacacaaaccttggtacagggtagtcattcattaaactatgtgttaaataaatgaatgaatccataggataacccaaataaatatgcaataattcggaaatgtgaatctctggcgtccactaatccacctctacaagtatctacggaggacctactaggtgcggacacgaggcagctaaacgagttctcctaaaagggcgataaagcctcctgcaggcagtcctcctcatacctcggatccaaaaagaagaatggaggtaagaacttaagtcatttcattcattttttttttcttttgtagaggttgggggaggtggtctcactatgttgcccaggctggtctcgaactcctggcctcaagcgatcctcccgcctcggcttcccaaagagctgggtttacaggcgtgagccactgtgcccagtctcatttcttgaaagagataaataagtagaggggagaaaagaagtatagaaaaagaaaaaagagaaggaagaggtcctgctgccttcgtgctcccggcctttctcttccatgctagattaggatcccagaatttccgttctgtctattgctgtgtgtatcgagagaaaagcaccccactgttggcaaatcaatcttacagtcaatcattctttaggcagcgggaacatcctccactcagggttcgcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaactatgtctggaaggtacgcgttttaaatatagttctttatttttgtgtgttagacgtgaacgtaaatgcgagcttaaaattggcaagaaaaaacttagatgtttgctctgagtaacttttgggtgggggtgattacaagtcagattggttttttgaagcttatgtttcatgttgtgtatcttttgtgtcttaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaagtaagtttatgacactggtaggttttgggtttttgagatctgcctcattttcttttttatataacggagtcttgctctgttgccgaggctggaatgcagtgacttggtctccctcaccgaaacctccgcctcccgggttcaagcaagtgtcctgtctcagcctcccgagtagctgggattacaggcgccggccaccacgcccggctagtttttgtattattagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggcacaatctcagctcactgtaatctctgcttcccgggttcaagcgattatcctgcctcagcctccgagtgaggtgggattacaggcgtgtgccaccacacccagctaattttatgtttttagtagaaacggggtttcacagtgttggtcactctggtcttgaactcctgacctcaagtaatccacctgcctcggcctcccagagtgctgggattatagcgcaagtcactgcaccaggccaaaattagtttttatgcatgcctaaagatgtttatgctgtagacttttttttttttttgagacaaagtgttgctctgttgcccaggctggagtgcagtggtgtgatctcagctcactgcaacctcagcttccccagtagctgggattacaggcgcgcaccaccacacccggctaacttttgtatttttagtagagacagggtttcaccatgttggccaggctggtctcgaactcctgacctcgtgatccacccgccccagcctcccaaagtgctgggattacaggcgtgagccatcgtgccattgcaccttagcctggacaacaagagcaaatcctattgtcttcacccactccaagccaattaaaatctctgggaaagtgttttaatcattgccccaccttttcttctacagccaatgtgttcctttaaaattttaagtcaggtgcagtggctcacacttgtagccccagcatttgagagccctaggtgggaggattgcttgatgccaggagatagaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtggcataatcacagcttattgcagcctcgacctcctgggttcaagcaatccttccacctcagccccccaagtagctgggaccataggcgtgtgccaccacacccagctaatttttggggtttttgttgtgtttttttgagacaaggtctcactttgtcacgcaggctggagtgcagtggcatgatctcagcttgctgctacctttgcctccaaagttcatgtgattcttgtgcctcagcctcccgagtagctggaattacaggcgtatataccaccatgcccagataattttttgtatttttgtattttgtttctccatgttgcccaggctggtcttgaactcctgagcccaagtgatctgcccaccttggcctcccagagtgctgggattatatgcttgagccaccacagccagccttgaataaatagttttctggtgaagatatttattgggcactgaagtaattgttagaaagcaacaattcaacagttacgcctggcataattgttaatattttgccatttccatcatgtcagtcttgttagaacaggtgttagtagctttattttgtacatgaagaaaacagactctcatgttcctaggtctcaggtctttggtgccagccttggactctaaatttttctcaattttctcctgtaatttttctcaaatagttcgtactttttctttagggtccattttggaatgtagactgtatattcttgggaccaagaatatatgcataccatgtattcttggggccagggggtactgttgaaccctgctaagtggttcattagggtttatcaacagaggaggcttttactctgtctttagaagaagcaaaattaaatgtaccttcagtacatgtttttctttttctttttttttttttgagaccagagtctcattctgtcaccaggctggagtgcagtggtgggatcttgcctcactgcaagctcccaggttcaagcgattctcctgcctcagcctcctgcgtagctgggactataggcacgtaccaccatgcccagctgatttttgtattttttagtagagacagggttttaccatgttggccaggatggtctctatctcttgaccttaggatctgcccgcctaggcctcccaaagtgatgggattacaggtgtgagccacagcacctggccagtacatgttttttatgagtgccggttcttacggtatgttcacgtagagactgaaggctataaaaactttccttaccactagaacatgtaattggtagcctttcagagatttatccgtattacggttcttgatttgtagacgtatatataacattcacctaatgttttgtgttcttttttccctgcagatgctgtacccctcaaggatttaaactaacgaaaaatcaataaataaatgtggatttgtgctcttgtatttttaagtggattaaaaaacttactaccttaaattgatttgctacatgcttaaaatgatagaggttgctcagcatttttggagtacaagggggtcagagagacatgtgatgaaaattacagggcgagtacagagatttagaagggaacgggttttaatgcgagtatctttgacagagtcttgctctgttgcccatgctggagtgtagtggtgctcgctgcagcctcacattcaaaggctcaagcaatcctcccttggcctttgaagtagctgggaccacaggctcatgccaccatccctgggtcatttttaaattttttgtagagagggtctgactcttgcctatgctggcttcaaactcctgggctcaagcaatcctccttccttggcctctcctgaagtgctgggatacagttatgagccaccacacctgccaagtgctttgtgatactatgcatttgttcaatgcagattgggaaacttaaaatttgaatggagattatgttgatgggctttggcagttcatttggatagactgggatgagaagctcttgggacttgtgactggacaaagcattccagtatattaaaataaaattaagccatattactccactcataaaaagcaatcctatggtaggtacatggaggttgggaatagtgcacggaaaggtggcagctttctttggcttcatgttttaatctggtaaagttcaagattgcactttaagcaggcctcctaaatattttagatttcttggggatatgctaaaataaaacaactaaggcatcagttttgctgtatggttttttttttttttttgaagacaaggtcttgttttgttgcttgggctggagtgcagtggcgtgattacagcttactgcaacctcaacctcaacctcctcggctcaggcaaacctcctgcctcagcctcctaaatagctggggccacaggcatgtgcagccacaaccagttaactttttagttatttgtggagatgggcctcactatgttgcccaggtagtactacatttctaactgatgcagtaacagtctttttttctgccccctgagggttactgatctctacagcacaggtagttttttaaattaacatctttaaattgcactgaaaatgtcaacaagaaactgggagtttgccacctaagcccttttgcagttttgcagcgtgtatgggttctcttgtctatgctgcaaaagaattaacatgctggaaatgtattaggataagagggtgaaagaaaggattgggtaggaaaagcacactggctgttgtgttatttggtcttccatctcctggagacaggactgagaaggaaagtttttgtagtaagggaaaagagtgggaatactgtccagctttcccacttccccttcctccagtaacatcctgttacaaatctgctaacctacaaagagggtagtgagatatactgacccaagagaaagcaagaagccctcccccagaggtccctctgtcacactggcagttctaagaaaggtttggtcagtccaatggtggtatgcaagccaaagctgccattgttggagtcccgtgcttcgtggacatgggcttgtgttagtactctgccaggctcatttattaggattgtggtggtttttttttttttttttttgagacagtcttgctctgtcgtctaggctggagtgcagtggcgcaatcttggctcactgcacgctccgcctcccgggttcacgccattctgtctcagcctcccaggattgtggttttaaggcaaacaaagtgcactgatgctgtattcaccagaagtgagcagtacttcaaggccggaagttggaagttgtatattagaatgctaatgaaattgaacttgggaattacgcagtcagcgcgaggaagtgctgatcttggacacccactccaaaaggccaacataagctaaaagtacctactgtgttcattgtgccagttaagtagatgtgatca

SEQ ID NO: 13552 - DNA, 24171 bp, Human
  misc_feature (1)...(24171): n = A,T,C or G
gctccacgactcattgtcttggtaagtgtattctagcattgagaacagtgtcccccaggcgctgcaggtgccaggcactgttccttaatctcttggagcttcacttcctcacacataaagtggagctaatagtgacacctaacttcagagattcttaggaggatgcacttcaataatacgtagaaagagtgcctgtctttaacatactgctgactcagatgtcaacctgttgttattatcattaacagctagatctggattagaacttgggtttcctatctggtgcattttcttgcgtgttttcaagctcgctcactagtttgttaatttatttggtgatgattccagggtcatttctcagggtgcctcattcctaattctgtagcaacatccacatttgggttcagatgttaccaacttctcccctggggcccaactccccattttttcatccccaggctccagtgctcaaggcccccatgggtctgatcacatactctgaacccagaggctctctttcctccctcttttcccctgccttctccctcataacagagactcaaggcctctgattcccactgggtggctatcctcatcctccctcctgggctgagcttacagtggaaggctctgagtaggtcccaataccagaatttcactctgacatgctttcccattcctgggataacctgcaccctccaagtcaccttcaaaaatttccattacctcaaatggctcctgcccacgcctttctaactgacttgggcttgggctgttgcctgggttaaaaggaccagtaaataaacacagactcttccttaataaaaagaatccctgtttctctagagccttggaggagcgtggggcacttggtagacctggtcgctttgattccctcaatacccctcagaggtgaggggctgcgggatgggtgctcccctctacagcctggggcacctcctcttggcaattcctgggaataaaggcagaggtggcctcagggcgattgtttgtgtgtatgagagggaggagaaggcaaacatagattggagatacaccctgacagaagcggatttgtctcctggcagttgacaagcaggccaagggacagagagtagaactaagaatgccccacgtcacttttctggaggtctagggagctttgggctctctaggagggcagggagaagggaagggcagtgacctgctgagaggggcagccactgctgggcctcccttttgaggagcccgtcatttggtcaccttgggggtcatccggaggtgactgccagccaggtgagaactggtctggtgatcccttctggcaccagggccccctagtttttctcaggacagagatacaacagagagaagaggagctggggctccctcgaaagctcacacttgcccctggtgccaatcgttgttgtcatctggccttgttcagaggccccaccttctcttttcctcccaatcagctgcccagagctgctggctcccctgtttactctgagctgatcgatcaccttagcacacagctggctaggagagaaccatgcagtcacttcggccacacctgcccgttgacccttgctacctcggcaggctttgatcccttctgacctggaggccagaggctaggctgaggtcactcagcagacatcaaggacctgggcagatgggccggctgggatggtggcgagctgtacagataaaaagggacatgaaaatgaaaagcccgagcctgagttttcatcacggttccactcctgagtggtcttgggtgaatcacttcatctgccaaggcctggatttcctcatctgcaaactcagaaaactaaggtttgctcttacagttacgagaacgaactggaactttaggtgtaaatgccatggagcacttgggaagaacaacaatatgctgacagcggagatcgggatgggaaagcagggctggcgggagcatgtcgggttttacagctaatttcttctcttcccaccaggctttggccctcgtcatcctgcccacccagcggggcttcccaacccaccacacagccatggacgggaaggtggcagtgcaagagtgtgggcctcctgcagtctcctgggtccccgaggagggagagaagttggaccaggaagacgaggaccaggtgaaggatcggggccaatggaccaacaagatggagtttgtgctgtcagtggccggggagatcattgggctgggcaatgtctggaggtttccctatctctgctacaaaaacggaggtggtgagttcactttgaggtaggcatggtggggagagctgtgtgctggcagctgggcagtgcctacctgggccctccttcctgggcagtgtggtttataaaaggagggctattttggaattggaggacttgagtttgagttccagctccactactagcctcagcgtccctctctgtgaaatggggacaatacctcccagggtgacggtgaagatgaaactgggcaatgggcaggaccaagaaattctagtttttaacaagctccttcatgactatgtaaaggtcaatcattgatagaattcagtcattcattcagtgaacatgattgcaggcctgtcacgtgccagacccggcgctaggtgcaaaacagaacacattccgtgtgccaccctccgtgggaggattctgaggagttgtactgtgtctgcggcaggttgcggacaaacggttccgcgtggtctatgtcaaatggtgatgagtggaggggtgagacgtgacgcagggaggagggatagggaatgctaggcgtgcagaggggaaggtgacatttcagcagacttgaaggaagtgaaggcatgagtgtcgtggatgtatcctggatggagaacactctgacacagggaacggcaggtgccaaggtcctgggggtggaagctgcaggcctgtctgaggagcagtgaggaggcaggtgtggctgggatggaatgagagaggcagagaataaccgggtgagggcagagaggtcacagggatcactcaggctgaggttggacaggtcacaggggtcactcaggctctgttctgactgagatgggagccaccgaagcaattttggttggagaaataccttgcctttgagtttttttcaagttagagaaacatgattttattatttttcagcactgggtgtaaaaattagcagtggtggggaggggccagttccttattctaagtgcacaattcagtggtttttagtatagtcacagaattgtgcagccatcaccacaaccacttttggaacattttcatcatccccgaaagaaatcctatattcattcgcagtcgctcctcattccctctccctgccagcccttggcaacgcttatgtgctgcccatctcgatggatccctatttgggctatttcacaggaatacaatcgttcaatgcgccgtcctttgtgagtggttagattcattttttttggccttttgaaatcacttttatttttcttgtggaaacagtatatgtttattgcaaatattagaaacatttcaggaaggtagaaaggaatactcacatttagagataatttgttgagaaaatcctcctaaacactatttatattaaatctgaccaatatttacggagggtctactgtgtatcttgctatgtgttttaaaccttatagttgcgatcacaagctgcttgaactgacaactcctaagaaatagcggtaggctttcttgggctggctcagtctctggtgctgaggctgaccctgggccagaaagtcaggggaggcaagatgaaggggcagggtggtggtttccttcttcatccagggccaccatctcatggcatataggatgttagggctggagatggaggtgctcagactaagccctcctttagtggaggaggatttgcccaggactgcagagggccttggaaccatttctgcgtcacggcacactcctcacccagccatctgggagggagacagcactagggcctgggaggcagggccgcggtgtcgggcgcccaccctgcctctgtcctgtcatgctggctgctgctgtggctgtggcctctgtcctggccgtggggtggggtggagagagagagatgagtacccgcagtaacattatggaatatcggatccggttacctccttcccagcctaactcttgggaaagacaccctttctttcatctttaacatgagggggccaaatgaggttggggtccccttctggagtcactggtccttgggggtctagaaatgtagtaaagaagggccaggaattcattttctcatttccaacaacctaatgatggatggatgtggaaacaggatgtcacagactagtccaaatgtcttttatttttttgctttagactgaactgtactaactcagagtgataataaagtttatatcaagctgaccataaggcctgattggcacttaaatataattttattaatatatgcagggaaatttattgattattaattagtaaacatagttctgtagagaaaaatctttcaaaagaaacaaaaaagagtaataaaactattggtctaatgagggctttggttatgaaaaagaggggagcccctgaactagaaatcactcacctcaaaagagaactttaggaagttcccattatccgggttgtgagtggttcaggaaagagcatgcagcagaggtaaggcacaatgtagaggtgttgacaccaaccccaggcttcagggcaccgtgtcggtaaaggtccctgtgggacacaccatgttggtaaaggtccctgtgcgacatcgctgggccgcccgtgcccatagcctgggctgacacgaaggagacatgaagcagggtaaccttccaaagcaaggcactgatgagggaatttgaggggagggtgtagcagtgtcagcgttctaaaaacccaagggtagaggacgccctaacgcgctccagaaacaacctcttcatctgcccctcgaaggtccagacttagtgccaccctttcagggaggacccggtctgagcgaggcccagctccaggcctcctgaagtcaccccgtcttctgtggggcggaaatccacactcccaggtgagaactgaagccacctcctttattggagggaaggaccttctgcacacaacaggtgggaaggagtcccgtgggccacacgccctgacagacatcctgtaaagtgccttctggggaggccttaggccgtgtccctctaccgagtgctacccctcagcctaggtcctgggacttcccaagccactgaaacctgagtcagtggtgttactggcactgtgctgaccaacactctagtattcctagggttggaaaggcaaacatggggttcaaagggactttggaactcagtggagagttactggccttttgtggctccctgggatccagaagacaacctttttccttctcccacatattgctgtcaggaatgcagattggtgcaagagttttggagaacaatttggaaatgcgtatttaaaaaatgtgcataccccaaaggtggaaacaaccaaaatatccatgaacagatgaacagataaacagaaagtggtaggttcacacaagggaatagtacgtagccttcaaaaagaagggaattcatgctatgacctggatcaatcttggaggcatgcatgctgagtgaaataagccaggcacaaagagataagcactgtataattacactttcataaggtacctagaataggcaaatgcatagaaacagaaagtagaatcacacctaccaggggctggggagagaggggaatggggagttagtgtttaacgtgtacagagtttcggtctgggatgatgaaaaagctctggagatgaatggtggtgatggtggcacaacgttgtgaatatacttaatgccactgaactgtatacttaagaacagttaaagtggcttatattatgtatattttgtcatacacacacacaaagagaaaaaaagtgcataacttttgactcaggaattcctctactggtaatttgtactaaggaatgaattagacaagtgcacgaggatgtggacagtggtcttcattatgacagtgtttcggatgaaatgaccaaaagtccaatgataacatactgacgaagtgcactaggatagatacatagagtggaacactatgcagcaatcaaaatgatgaggtagatatgtatttactgacatgaagaggtttacggtaaaaatttaaaaagtggttatcaaacaatgtatttgatacatgattacttctcacttttgcaaaaaaagaaatacatgtgtgtgcttttaagaaatctggaaggatatacaatgatttttcctttctttccctctgtactttctatgttttctacataataatatggatatgaagtatcagaggtatatagtgtagtgattatgagctcagcctcaggactagactgcctgggcttgtgcctcagtttcctcattcatgcttcggtttttccgtctttaaagcgacctcagttttattatctgcaaaatggggataacagtagagcctgccccatgggaggttgttttgcaaggactgtgatgttgatgaagtacgtacaagagtgcctgacatgaagtaggcaccaaataagcactcagcgttctcatggtgtaacacgcaataatccattcaccctgagatgaacttctcactcgagctttatgccttagtgactcctactgaagtgggtctcctgggtgtggtcttcagattccattcctgtgtaacctgctggatgtctgttaggcctggcctccctctggcacctgcaggttggcacctaatcacgtgatggccttctctgctgggagcccagttcagatcagaactgggtggaggcaacaaacaccctgaaaattattagtgggaaaataatgcttctgaggtgtttgtgtttgtttttctctaaaatgtaccaagagtttaataagcatatcaagttatacagaagccatgtgtttattccaaaaataatctattgactagatttgtaaagcacactaagaaaataaatagtgcatatattagaatttccacctaagttttcactaatttcccttccaaggcctttctcattctgtgtagggttcagatcagaacattcccacctgtgcctgcctaacactcaggactgcacgcaggcaggagtgggcccttggaaagtgtcaggagggagattaagaacaggatggtggagggcgggtttgttgggggaggagggtctgaaaggatggaggctgaggaagagcccgggtgtggctcagccctgcctctctctcttctgcaggagccttcttcatcccctacttcatcttcttctttgtctgcggcatcccggtgttcttcctggaggtggcgttgggccaatacaccagccaagggagtgtcacagcctggaggaagatctgccccctcttccagggtatgtatcctcccccaccttccccttcatggggccgccatcttgcctgcatccccccatggtctctccctgcctacccatccgctgcttcacccatccgctcactcccatatcctgcgccaagtgcagaatcaggcttcatgggtgggccggagagagcctggtggggaaacactggctcccgagcaagctgggacccttagcactgatggtggggaggtgggggaggccagtttggtgctgatgcctcttggggcaaccatgggacccctgcaggggcagaagcgaggggctggagccgagtgaagcttggcttacctatggctctactcacaggctctgggtgctcccggggtgctgtgcctccgccagaacacagtttccccctgttctgccctcgaccccagcagtcgtgtaaatgtcccgctcagctgggtcctatgcgtaggtccaagcacgctcacggacagcacatgcagggctggcctctctggaacacacagacggcttatgcgggtgccacggtcagggtgagcaaacggagcactggaatgcgagaggagagaggtcgtggctctttccttcttttccaagtcaaagaggcggcagggcctggcatctcagcgggaagcgcgtgcaccgcgctgtgctggtgggaggtccgggctgccctccccgccctctgccggcctctccgcccgccgcactcccctctcccggagctgccgtactggctcgaggcgcgcccccgcgcgcccccgcgctcccccgcgagccccttctccacccagcgccgccccggcccctctcccagacagccccaccagaacgccggcccccggctcggccatcccgggtccgcttagttcacggggctgacccggggctgccggacgggccggacggccgcgagcacagcgcgttccgccgcggcacaggggccgcttgtttgtgtgttttttgggtgtctgtgtgcgcgctctcaacgccccgcccgctccccgcggaccctctgccgtctgcgggtccctcccgcgcagcgccacgcccacccccgcggcggacgcccgggccgccccaacgccgctgcgcggtggagaccgcggtggaacccgtccttgccagggtgggctcgccgggccccaaaggagaggttttgttcatagtcagcattgatttttcagccaggctgttctgaaaggtccacagtccttcgttaagtagtgagcacttcgggaggctgaggcaggaggatcgcctgagcccgggagttcgagaccagcctgggcagcatagtgagaccctccccttctcccgtctctacaaaaaaaaagttaaaattagccgggtctgtctgtggtcccagctactccggaggctgaggtgggaggatcgcttgaacccgggaagtggaggttccagtgagccgagactgtgccactgcactccagcctggacaacagaacaagactccatctcaaaaaaaaaaaaaaaaaaaaagaaaagaaaaaagaaagaaaaatatactatgaatggcttctcatgccactggataaaccccaatggtgctctttgtgtagcacccaatacccttgtaacctcaactggcagcttctatgtgacttttttgctaacattgatctctcttgtccctccccatctctcccccactctggaaggcattggtctggcatctgtggtcatcgagtcatatttgaatgtctactacatcatcatccttgcctgggctctcttctacctgttcagctccttcacctctgagctgccctggacgacctgcaacaacttttggaacacaggtatccatcatttcagcccctgggatgttgcctgttaggggctgggctgcggtggctggtgaatccaagcaacgacggggagtataagtgtagcagaacctgcctggcagccaagccacgtgggctcctgggcagctctgctccttggctcctctgaggccctcaggccagccactcggacgagtcagtgtggttgggagaacccagagggactgtattaaatgactgcaagggttattgccacttactcatttgtgcgcttaacaagcacttactggacacctactgtgtgttaaacacggtgccaagggctggagattggtacgaggctgagcaaaagcagcagggacccagccttcactgtgtttacagtctggtggtaagaacagacaaataaacacaaccactacaaattgtgataggtgaacgaaactgcagaaaccatagaacaaggggagggagaagtgtcatctgaggcctgaagtgagagagagcccagcatgggggcagcattccaagcagggggaagagcaggtgcagggccgcagtcccttggcctgccaagtggagagacaggaagtcagaacgggcaagcggggagagtgcgttccgtaccagccgcccatgaggggactgagtagatctgaagtctggatactgtctgaggttggcagggcagccaggtgagcaggcagattcacagggaacaagagcagggggaggaagagctggccctatgagcctcctgatgccctggagagtgggggctccaaaagaagctcttggggctaggagtggtgaggaccactaggctgcaaggccagagggccagggggactagggtataagagcatctctctccatcttgtccctaaccttgtccccaacagagcattgcacggactttctgaaccactcaggagccggcacagtgaccccatttgagaattttacctcacctgtcatggaattctgggagtaggtgctgggcccatttgccacatgtgaagaggaaatttggatgtctgagctgtgcaagtctgaatgtctggggtgcaagtttaagattctgtgtgtgctttccagcacttcctcccccgccccactccaaccccacacatcactgaggcaggggagaacgctctcacatctacccacacgggtccacggagactcacatttatccgtcatgtccaccttcagccccacatccctacctccatgcgtgtgtctgcccacacatgtccagtggggtgctggacagagtcttcacagctttaggggagctgagtgtgcatgtctcttcccactgccatgctcggtggtgtcatgccggtagcttgaaattgcccaaggcgggagtgctcacatcaagacatgggcacaccctccactcacacactcaccctctcacctgacaacgtaccccttcacattacctgtgcccacactcgtccacctgcattcccacgcaagactgcctgtaatctctcacactgagctaacccccacgtaggcaccaatgccctcacacctgaatgccctcacagtactggaccctcacacccatgaatgcagttccagcaccccatcacatgtttagaaactaacacactcagcccctgcatgggatacccatgcacttgcccatcaacctgcatgtataaatatctactctctaaacgctcatttatacattcctcatctctctctctctccatctttctgtacgagaaaaataatctggatgagttagaaagataaagatatgcataggatgatggtagtagtttggtctacgggaacatggcctgactgtgggggaggtggggagtgggggaagccctggaatatgagatccgtggggtcagctctgagaatcaggagacttgctgacagacgcaaactgtcccctttagcctttcccctcattacttatttttcccaatcctccaggagacgagttctgggcatcacctcgggcatccatgacctgggctccctgcgctgggagctggccctgtgcctcctgctcgcctgggtcatctgctatttctgcatctggaagggggtcaagtccacaggcaaggtgagatgtcctgcctcctgggaagctccctttggcccccagagtctacggggacacttgagggggaccctctggagaactgatttctttctattaagaaactacacttcctgagcagggcaggggagatgcctagtgagaacagggggagccacaggaaggcggagcttagctcgatgcaaggaaagtctttctttttcaatatgactttaaaagtccggtttacataagaatattcagggcggccgggtgcagtggctcacgcctgtaatcccagcactttgggaggccgaggcgggcggatcacgaggtcaggagatcgagaccatcctggctaacacggtaaaaccccgtctctactaaaaatacaaaaaattagccgggcgtggtggtgggcacctgtagtcccagctatgcaggaggctgaggcaggagaatggcgtgaacccgggaggcggagcttgcagtgagccgagatagcgccactgcactccagcctgggcgacagccagactccgtctcaaaaaaaaaaaaaaaaaaaaagaatattcagggcaaattagaaacagaaaaatctcattgttggagctaatccctgctggcaggttggcactgctaatctctgttcatttttgctgtgttgccttctggtttctctcatacgtatgtgtgtgtgtctgtatccattatgtgtggctatgacatcattaggatcacacgctcttatgactcacttgttgttgtatttaacaacatagcaagataattttgagtttgaattagcaaacagaactgtctttgaggtggcgagtttccagtcattgaaggggttcccaccaagaatgggcaacaatgggcttgtcacatagacagaattcagatttgagcattatttccaacccagagagccggagactgtgcttcatgcctttttaaagccaggagtggtcagtaaacggacttctctgcttggccatacactgagtctgttcccgcagcagcctttcccctccctgaattgtaacaagttggtaatagggatgatgaaagtgatcatcgtagtaataacagcacagacagtaccactgccgccgcccagggaaggagctgagtttgcttagtggcagagaagaacagcccggagctccggccgccgctgctcccccaaccattagcctgcaaaagcacagcctaactttccccacagatcactgtgcaaatctggtcactattcccctgggtcgccagggggcaaggagagaacagccaggataaaggattaagaaagaccagattctggactttaaattagtctttgccctgatttgatcattacacattatatacacatatggaaataccactctttttcataaatatgtacagattatgcacatacgtacatgttgactaaaaataagaggaaaaaaatggtcttggacaggttatgggctggaagcctgtaccctgcctccctccctgtcttcctcctcccctccccaccctccccctgctgatgtgtatctcacaccctggggggagcacagacccactggaatgtgtaaagggaggtgtggaaactttcttgtgcttagcccctctaggctgtctctgaggttgggactgagctccgtgtgactcgagctgcctgtggggcgtggctggagggccactgcgtccccaccaggagtgaccttggcctgtccccccacctccaggtggtttatttcacagccacgtttccgtacctgatgcttgtcattttgctgatcagaggtgtcacccttcccggagcctaccagggcatcatctactacttgaagccagatttgttccgcctcaaggaccctcaggtatgtaccgtgctgggaccacttccccaggtgccttccccacccagccaggtctgtagttttgaaagtcttgtatagctttttccttggtttaaaagcaataaatgcccactggagataaattagaaaatatggaagaaagctataaaaaagaaactaaaaaaatctcttgtaattccaccactcaaatataactttttttcttaaaaaattttttttctcttacttagagacaggcagggtctggctctgtcccccaggctggagtgcagtggtgccatcatagctcactgcagcctcaacctcttgggctcaaggcattctctcgcctcagcctcctgagcagctgggactgcaggcatgagccatggttcctgggcattttctcttgatattttgatgaagcagcctctttgtccccaggtcatagctgcttaagacactatgtacagagatcttagttgaatgagacaagtgacttctggctgtgccctgcagataggccttgggtgcagccatggtttgtagattcccctggagaaatccaagcaacacacatgtatttggtactcactaagtgcctacagaaccaaaccgaaactgggccgcactggggaggagatcaccgtggagaccggagggcgcactcacggagagttgggatgcaggagggaagcgctcagggagcactgaggggccaggctggtgctgcaggggacgggtctggatctcgggtcaccctggctctgggccctgggggctgcctctacctctttcttggggttttgtgtaggtgtggatggatgcgggcacccagatcttcttctcctttgccatctgccaggggtgcctgacagccctgggcagctacaacaagtatcacaacaactgctacaagtgagaacagcgtgggccggggtggggtgaaggagggttggggcctggggatgggttctgggcaaagacccatagtctctgggcccagaccttccttattcattatacgttgtatcagactgaacttatgggttcctttcccagactaaatgtcttccttcttccttttctctctcacttctctctttgttgtctgccacctgatttttgtctttttcttctactgtcttcttcccatgctctcttcccttcctcccctcctctgtgcctcccttgcctcccccttctctctccttggtcccctctcactgtcttttgacctctcctcccatgactgatctctctctcttcctctcttttcctccccgttcctgtctgcccttgccccactcccacagggactgcatcgccctctgcttcctgaacagtgccaccagctttgtggctgggtttgttgtcttctccatcctgggcttcatgtcccaagagcaaggggtgcccatttctgaagtggccgagtcaggtaggtgccactttgctgtctggggcctgaggggaaggagagtcagagaacacacttctctcttgctgaaaggcatgagtcccagaagatgggcaatatgatttatttatgggtagtaggttttaattttagcatctggggcagcgcttagcacaaagcagggcttccattaccatgagaaagaggagggggaggatgatggatggtagatggaccaacactggatagatggatggatggatggatggatggatggatggatagatggatggatggatggatggatggatgaatggatggatggatggatggatgggtagatggatggatggatggatggatggatggatggatgggtagatggatggatggatagatggatggatagatggatggatagatggatggatggatggatagatggatggatagatggatggatagatggatggatggatggatggatggatggatggatagatggatggatagatggatggatagatggatggatggatggatggatagatggatggatggatggatggatggatggatggatagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctccttggtcccctctcactgtcttttgacctctcctcccatgactgatctctctctcttcctctcttttcctccccgttcctgtctgcccttgccccactcccacagggactgcatcgccctctgcttcctgaacagtgccaccagctttgtggctgggtttgttgtcttctccatcctgggcttcatgtcccaagagcaaggggtgcccatttctgaagtggccgagtcaggtaggtgccactttgctgtctggggcctgaggggaaggagagtcagagaacacacttctctcttgctgaaaggcatgagtcccagaagatgggcaatatgatttatttatgggtagtaggttttaattttagcatctggggcagcgcttagcacaaagcagggcttccatggatggatgaatggatggatggatggatggatggatggatggatggatggatggatggatggatggatggatggatggatggatggatggatggatggatggatggatggatggatggatggatggatggatgggtagatggatggatggatggatgaatggtatgcttcccaggcctggaaagagaagaacagtggatggaatcaccctttcctcttaaagtgtgtgcacaggtacacacacacacagtgcttagagagacgcctcttccccaagggcagcacacgccctggagcctccctgactgtgctgtgtacctggcaggtcctgggctggccttcatcgccttccccaaggctgtgactatgatgcccttatcccagctgtggtcctgcctgttctttatcatgctcatattcctagggctggacagccaggtacgtcactgcagcccagcctgccctgccgtggtgaccctcttgcaagcctttgcttgtcctgggactactttcccctcactcccactcccctgaccacacacctgaggccccctctgctgtccagggcttttccttggggttgggggtgtggcctggagaccctctggggtgaaggggccactggctttgtgctcccagccttgagcctctgcatgcatggatgtttcctcccagatgttccttcagctcgagctgcccagccccagcccctgagcctcggggacagaacatacccccctctaaccctcactgctgagactctttgtcatggagttgtagttaagggcagggttggctcaccccagggcacccccatttcttccctttgtgctgctccctgcacccctgtgcatcagtgtggatgagccaggggaagtggaggccagggctggtggccaacagcccgccccacaccctctcatccagttcccctcctggcccacagtttgtctgtgtggagtgcctggtgacagcctccatagacatgttccccaggcagctccggaagagcgggcggcgcgagctcctcatcctcaccatcgccgtcatgtgctacctgatagggcttttcctggtcaccgaggtgagctgcggccgccggcctgcaggccaggctccgggggagggagccacgggggacactgctgaccctgctcagagcctcacttttcttatctgctgacgaggggtgtgaacgcctgccctgcctctccacagtgaggttgtagggaccacacaacatgcatttgtgaggtctcttttggttgcaggtgaccaatacagctggcttaagcagaaaggggaatgtattgggtcaggttgctgaaaaccctaggatatctgggtttcggtgtggttggatccagctgctcttgtggcactctcaggaaggctcctcggtctcctgtgacttcactcagaggcgggttttcctcctgtgacattagggatggatgctgggcttcaggcttacctgttactgtcagccaacccaggaggaaagagagggcccttttcctgagagtgtggcaaatgtccaggctatgactcttattcaagcctggagtagagagagagggataccccagtctaaaaggaacaaagaatgagggggtgtcactttccagaaggggagatgctgggcagacgagatgatgtgtgtccaccacagtctcccagtgccagaggttattgtcctgatgttgactggggggcctgaaggcaggggcagacagggcaaactcctttgagatgcaaggaatggcatcccacaggccgggcaggagtgcaccccacgtgggcatttgccatctcactgagggctggagtgtgtcccagctctgcactggccatgccccagctccacgctctccccacagggcgggatgtacatcttccagctgtttgactactatgcttccagtggcatatgcctgctgttcctgtcattgtttgaagtggtctgcataagctgggtgtatggtgagtggggtggagtggggtgggaaagcagggtgggagaaagaccgtctagccagccaggggcaggctttgcctgggggaggccgttctctggtcccctggtttctgtgtgtctttgcgctgttgccctgcttcttcttactgggaaatttacccgtggctgggaagcctggcattttcatggcagcaagcagagctgtaatgatgacaaaatggatttccttcaacagtgagagaatgatcaataacagtgcacagcgcacagtgtcctcgatatggaggtggcctgaggccctgtgccactgggaatcttagtcagaagggacgtttattgccacttagcccgatcctccgcaaactcccacactgcctttccaacaacgaggcgatcacccagactctgagtacttccatggacagggagctcattcctgtgtttttgagggagtcttttccatttatgcatttctctcctgtactgaggtgaattctgcctttcactgacttccgccagcagcctggccccctcagactgagatagctaccatactgaatgctgcaacagccagggggtgaccatgtcctacaccaggaaggggaagaagcccgattcactgagccaatgcatgactgcgtgccaggctggttggtctcacacacttacaatctgtgcagggggagagtgaggctcagaggggttcagtctcttgcctaagctcacgtagcaagcggagaagccgtcctcataccccaggtccctctgactccactgcaccgcttgggggaacccagtgccaatgtcacaaggttcagggcagagggccagtgggtgccacacagtagggcctcaggaacagccatgagtagaaaagactttattttgctgccctaagccttcccacttgtgtcctttcctctccatggagacgttccttccttctcacctcaggcatctgatgccttccgaatttccccaactccttttcaaaacttctcagagaggacctgctaaacttggtcacaacaggtgtgaatggctgataagcctcaacatgcttcactcacctggccatatctggcttttaactttggcttttcacagtcaaaggaaccactctttaatggtgtgatttcatgcatcagggatcggtgggaaggtattttgggtgggaaggtagagaggccctccaagtatctttaccattcagtgattctttgcttcttagaagactggctctgcctagaactacagcaaatgtggaaactgcaggagtgaaacaacaaaaaatacagccagtcaatgttttcactaaacacaaattaaccttcttaccatgcttttttgggaactcagaggtggttcctctggagtctgcaatctagaccaccgttctgttcccagtagccctctagccctctatgagttttctatgatgtgtctgaacagcgggagccttgttgttttgctgttttggcttgaaccaaattcatctctgctacccgggtaaacaggcgtttgtctaaccattgagccccattttgggctcacaccactcctttgtggttagaccagtggggtctccatcacaagacagggaggcaagagacagcactgacaagagatggcagcagcagtgtgtgggggcagcccctgcctcgtgactcgaatgcatctcatgcagggatacagggtgtcagggaggcgtctcactcacgtgccctgttccagtttccctgcacagggcgggggtgagggaagggcacagagccaagtgggtctttcccaaacaccgggaagctgttctcaccctctggctctcacactctcccacgccatgcctgctcaggggcggaccgtttctatgacaacattgaggacatgattggctaccggccatggcccctggtgaagatctcctggctcttcctgacccctggactttgcctggtatgtgcccaccagctgcccctctattccttcctgcccccagaagactccagagatgagggaaaggacggctgacatgcagggctctttccccacctgtccagtctcccgtggggcctggtccatttcctgttctatgttgccttccctgctcttctttctggggccatctcatccacccataagtagaatcttgttctacttcctacttccggctccatcccttcctcacagggcctcctgcttctgcctgatttctcgatggttggtctcctgtctgtctgagcttctcttctgagcccttcccttcctttgtatcaccccctgtctccgtctgtgatgtgaatgatgctcttccgagcccctcccttcctttgtatcgcctcctgtctccgtctgtgatgtgaatgatgctcttccgagcccctcccttcctttgtatcgcctcctgtctccgtctgtgatgtgaatgatgccttggcctgggatttgcaggggcttttactcttccaccttacagacgtgctgcagtgcacctgacttgtcctctgtccttggctgtacgtagctgcggagagggtttcagtcgccccctatctcacccatggctgccccttccttctcccaggccactttcctcttctccttgagcaagtacacccccctcaagtacaacaacgtctatgtgtacccgccctggggatactccattggctggttcctggctctgtcctccatggtctgtgtcccactcttcgtcgtcatcaccctcctgaagactcggggtcctttcaggaaggtaggtggtgtaggggagagtgacctcttaaaggagggcactgagagaggctggacttggggcaggacacacaactggggccagggagcagacacaaactctgagtgtggggcagcccttcagtctcacagaatcttaacgagacgaactttgaagaccagtccagtggcttttcagaaatgctctgaaaagtcctagagtcctagacctacagactctgacctcccatggatgatctgggcaggctaacggagggcaaactgctgaaaggttcaggagaaaactaagtcacaaacatgaacaggaaggtgcccagacacagaaggtttacaagactatagattccttgccctcggaaaactgataaccagcaagcacagttcactccacacacaggctcctggcttcttttcttaactctgcctggggacacacgcaagaggctccctgtctagagtttgggacatatcctcctggaaggagctatagccaatgacccacaaaggtagaaatctatcttgcctataaataatagaaaacccaacctccaacagtttcagcaaataggcttgtttgttttttatgtttcaagaaggtcagagattagggctgctggtatttggtttggctgcttaaagaggcccttagggaccagacttttcctgcatttctacacttccatcctgggcatgctgtgttttcatcatcacgtttatcacctcatggtcacaagatggctgtcacgattccagtcatcacatctgcattcaaggcaagaaggagggagcagatggcaccaccaccaccaccaccaacagtcgtagcagtaccactgataagaagaaaaataatagatacttattgagcacataataatagtaataacaataatgacaataacaaaaatagatatttattgatcacttactctgtgccaagcactgttctgtgaggtgcattctactattattctcaatttacaggtaagaaaattgagggggattaacagaggggttaagtgagcagccttaggtggcgcaggtcggcagcagagccaggactggaacccaggcagcgcacactcattcgtagtcacggtattgctgcctcccttctcacctcaaacggttcattcattgactcactcatactgtgcggtgctggccatgtgctccgctctgggctgggccctggggttgcacacatgaggaaccttctgcgcctccctcaccatcagctccaaatccctgcctcttctctccacagcgtctgcgtcagctcatcacccctgactccagtctgccacagcccaagcaacatccctgcttggatggcagtgctggccggaactttgggccctccccaacaagggaaggactgatagccggggagaaggagacccatttgtagggtgtggccagaggccaggcggctcctaagccgggaacctaggtcagggccaccctccattctcagcggacagcctctgcctctgtctcctgccacaatcctgctgggaacctctggagagccacaggcacccccagctggaggccagactcctctcttgtgctagctggagcagctccttcccctttgctgataacaccaccactgggacgtgccatgttgggacgccactccctgtgggaaggcaccatcgtttttataaaggggggtctttttggaggccgccatctgattgcaacacctcgagttatgaggattccactgtggggatgcctcttgttagagcgtactgcatttgtacacggggagaggagctataattggaacgcacactgccgtccaatgtggagagcctgatgggacaataccctgttggaagtgacaactgaacacactgtgttggatcggaggttccgttaggggatccttccttaggcttaacgacagaggcaagcctttgcatgccgtcagtctggagtttcctccgagtctctcatggcatctccagctcctgccctagttccgcactgttcttgcagtgtttcatcaactcctggagcattggaatggaaggggcttgggagatgattcctagacttcacaaacactcggcatgcctccctgcactgtccgttcctctgcccaaggccgatattgctaactgatcacagattctttcccacctcacaatccttccgaatgtgctccaggcagcaccatttgccatcctgcttctaacgcaaacccctgacttcatggatgaggaacctggagaccaaagagacaaagggactttttcaagttcacatggggacccccttcttgggggccagagatatgactaaaaccttatctccttgtgctcaggccagtgtcttcccattaaccccctgccttagttaacaagtgtgtatggattgccttccatgcgtgctggtctcctttgccttgctccgtttctgttgagctatgccgcttggggtgggggaagagaggacccctctgttggaggtggtgaggagctccccagactagcgcccccgccttggtaatttctccatcagcccatcatcacctggcccgatgtcctcccagatccttttgttcttgtccttgccacctcttattcccccacggaatgcacggagtctgtgagagtgtcccagggggcgggtgtgggggtgccctccttagctgccacacatggctccacccgtttcccacccactcctcttcccacacccctaccgagtcccacatgcctcttctgtggctggaaggcttcctggaggaggaggcagggtttggataaggtctgtgctgttgtgttcagaagggaagggaggagagggactggggctggggagggaatttcagggcagtttcctgggacaagggaagccagccaggatgaggggggtgattcgtatatagatgtcacctggaccccccgcccaggggctgcaggagaaatcaggtcaggctggggtgagttccgtcctcgacaggcctatgccacctcaggtactcttagcttctgaccgccccccttgtctccctctggactgctctgtgcacctgtgccctcgctccttggaccggctagtggggagagaaggaggcccaggggaaagagaaggagagcaacggcttcagccagatgctctcagttacgaggccgggtctggcggaaaacgaaaaacgcgaggccggcgcagcgctgtctgcggccgccgggtggcagaggggagcagcgccgcgtccccgccgccctcccccggggcccctagcacgcgggcgcgcgcctcagccggcccctgcccgcagctagtccagtacttcccgccgccttctccccgcctgcaaacgccgcggcacccgtcggtgctgcaccctggagggcacgctttgggtcgggctcccaagcctcgctctctgcggaccgcacagccctct

SEQ ID NO: 13553 - DNA, 103792 bp, Human
  misc_feature (1)...(103792): n = A,T,C or G
gaccccctattgctgctggctgtcctcagcacttaccttcccacacatgcttttgtcccttttgtcccaaaacattctatctctttcctcttcctttatttaaattcccaaagcctgtagttgatcttagcacggtgttctgtcaaatgcaaggaaaataatttatactatggtgtaagagactgataggtttaactattcaaaggagcattcgcatctttaagggacagtttgtgaactcaaacacatctcaaacgggtagaatgtgcacgggaaatctcttcgaagcagggtctcaggaactcttccagttccacgtgtgtagtgcccaccgggccaccgccacccgcctcctgggagcaggacagggctccgctgccgagcccctctgcggaaagctcaggcccggcgctccggagtctgggctcccggggtgggcggggatacttaggccccacgtgccccgcggcggagcggtccccaaacctgagccctggcctctgccggcccggaatgaagccgcggcgtaggagggggcggcggggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcccgcctcccgcctcccgcctcccgcctcccggggcctggagcgcgcgtggccccggagccgccggcgccgcgcgaggaatagctgtgcagcacgccgagcccggactcggcatggctcggctcggcgcgggcgggcgagaggatgctggcgggcttccccgggctcggccgcgctcccgccgtggagggccccgcgcgcgcccctagcagccgccgccgccgcggtgcaggggaggggtccggagagccgcgctcgccgccgcccgcgcctgccggcccccgcacggcccctgcccctgagcctcagccccagggcgcggcgcgctgggccggcgcccacggatctcccagccctcgtcgccgcctcctccttccccctgcggccgggcgcccgcggatgctgaggggcagccctgcgcctctcccggtcggatcccgggcctgacggcgggagatcgcgctccggccgggccccgaggcgctgccggggcggcgcggctctgcggggagcagccctcgggcgcgccgagctctcccgccccagcccgcgcggggaccgtcccggagcacgcggtggccgagttcccgcacaggtaaacgcaggggcagggccaggcttccgggggggaagacagcgccccgagcgtgggaagggggccggatcggagcccgagcctccaagggtttggtggaaaaaggaagtaaacagaaggaaggctcaggaatcccccacgatggtcctgatttctttccggcacattttatttacagcttctaaggactgggcctggagggaatttaggtgaggaagtcggggactgagaaagaagagatgacagagagaaaccggttaccagggatggaaaggcggctaggcccttccacaagccagggacaggaaattgagtgtctggcgtggacaggactaagtgtgcctgcggtgggcggtggtgtgagccgggggtggcagggaaggccctgggttgggaggctcttgcagcagagatccttttatgagggttagggcgggtcatggggaaaccgcaaggtaggagggaagaggtgcttctactcagcaatgcccttttcagttctagctgatcagtgctacctgtgctctggaaacccgctctgcgttcctgctggaggtggcctcccctccgccccagacaagaagaggccctcagccctcccccggtctcagagagccctgagaggaggcccagtccagagctcttcctccgttcccagtccacttctctagggccagtagcagacaccagccagtatgccgaggaaccagggcttctccgagcccgaatactcggccgagtactcagccgagtactccgtcagcctgccctccgaccctgaccgcggggtgggccggacccatgaaatctcggtccggaactcgggctcctgcctgtgcctgcctcgcttcatgcggctgactttcgtgccggagtccttggagaacctctaccagacctacttcaaaaggcagcgccacgagaccctgctggtgctggtggtctttgcagccctctttgactgctacgtggtggtcatgtgtgctgtggtcttctccagcgacaagctggcttccctcgccgtggctggaattggactggtgttggacatcatcctcttcgtgctctgcaaaaaggggctgctcccggaccgggtcacccgcagagtgctgccctacgtgctgtggctgctcataaccgcccagatcttctcctacctgggcctgaacttcgcgcgtgcccacgcggctagtgacacggtgggctggcaggtcttctttgtcttctccttcttcatcacgctgcccctcagcctcagccccatcgtgatcatctccgtggtctcctgtgtggtgcacacgttggtcctgggggtcaccgtggcccagcagcagcaggaggagctcaaggggatgcagctgctgcgggaggtgagtcctgcccactgtccccccacagcgtcctctcctgcagctctcaccaacttgggacctgttggagttgctgtttgctttgcctttgagtcaaaatgtgtcctgggggcctccggggctctcacctctctccctagtccctgccttttcacccctgtgccattacccggagtctgcctgtgcttggccccagggaaaggaggatgtcagggcattgggcctcagggccactcttcacctgtgcccagtctaagtgtgtgacaggaaggcccacccagggctggtcttgaggcagcattgtcctggccattccctgtcagtgaccctggcaaggaggacctcccttgggaagagggctccttgattcccatctctccccagcactgactagctgtgtggactcagtgcccctttgtcaaatggggataacgtccgctctgcctgcatgacacggttgttgtcaggattgcaggagatgtgggggaaagcgcattaggatacgtgaagggctgcacagagggaagacgcagttgtcatatttcctgcctccgggagctcggggtgcctggggagttctatgaagtggagaatggtggtctccccactgaaggtgtggtgtggggatgcaaatggggacagtcatgccggccactgtgacgtagggtctcctggtcctaaagcacgcattctgctggtcctggagcacgctttctactggaaggggtggaatttcggcctcagcttaactattatagtattgtgttcccaccaagtgccaggccctcaggggctgcagagaccaggggacctgagggacagtaggcagtgtgtgtccctggggagccagcaagccggtgaccagagaatgaggcggagatgtctgcatctgggtttggtgcccagcctgccagcctcgtgccaatgatggtcaagagaggctcccccacttcctgcccctgcagtgctctgtctggtagagatgtcttaactcccacgccagctctgttctgtggttagtggggctggggtagagtcagctctgaagcggtgaccttctgggtgtcaggagaggcagggcgtgcccagaatccttgctgactgacgtgagcctctagcagccatggaggtcagtgcctgggtcctggagaccaggtgctatgtgcaggcccagggtggacagacagaatcttccactcctctgctgatttctccactcatgtctcatcctgctgatttgttctagaaatgggtagaggatgttaacataggcagggcctggcagggcatctagcccagactacccattttacagaggaggaaacagagatgagtgataactggttcactgtcacccagcactttggtggcagaaacaggacgggagcccaggcattgacccccagcccagggctcatttgtgtatgttccttggagcactgagagctgcctgagagcaggagctttgcttcccaccccacctcctggagacagtggctatgtgctgccctgccgtccccaccccaaatctctgtagagggggctgtgagtttctggtcattgactaggtggaaacaccagtcatatctcttcaggccatgcattagccagtcccaggttctttttttttttgagacggagtcttgctttgttgccaggctggagtgcaatggcgcgatctcagctcactgcaacctccgcctcccaggttcaagctattcttctgccttagcctcctgagtagctgcgatgacaggcacgcgcctccacgcctggctaatttttgtatttttagtagagacaaggtttcaccatgttggccaggatagtctcgatctcttgacctcataatccgcccgcctcggcctcccaaagtgctgggattacaggcgtgagccaccatgcccaggcatcccaggttctaaggtctgaggtctgaggatgactggtctctctagctccatctcctcaggtggacaaggagcttattttgaggctcctggagcttccagggaaaaggactgagaaggtatggccacagggctgggccggggcctgggtgccccaccacgtggctactcggagatcacttctaaactcatgattgttctcctttgagtattgctaagacataaaaccctaaaacttagaaaacagaaaaaaaaagatagaaatcaagaataaaaatattagcatcccaggggagcctgaccttggcatgcaagcagtgcctgggaggcagctttgggaacagagcaggaggggcagagagctctcaaggtccgattgggagcctgagatcgaaggcaggaggccccagcttacagtgggctgtgttccagaagcttctgagtcactggtttgggactaatgtgactttttaaaaggtgcctgggttcccaggcccacccaccagggtcttcctcaactcacagcatcccggcatttggcctctgaagatggtggaaatggggccgggcatggtggctcatgcctgtaatcccagaactttggcaggctgaggcgggcggatcacctgaggtcaggagttcaagaccagcctggccaacatggcgaaaccgcatctctactaaaaatacaaaaattagccaggtgtgatggggcgtgcttataatcccagctacacaggagactgaggcaggagaatcacttgaacctaggaggcagagattgtagtgagccgagatcgcaccactgcactccagcctgggcgacagagtgagactccatcaaacaaaaacaaaaacaacaaaaaacacaagctgcagcagcctgtgttgctgtggggagggacacccgggacagcggtctcccctgagccctggagtgaggtgtcattcatctcccctgctgccgttgcctcctgggatgtgggccccatcaaggatcgggggcaagggctggaggacaggatgcaagaaccaggggaccaggccccttctggtcagggtaggtcccagaactttctccagaccccaggcaccgcctttctcctacccatgtgcttgcccttgtctttctctctcccatcccctgtcggctctggctggggactccctccagggtcagtgggggatgaacgcagtttcccagttcgaaatagacacctggatttctggggtcttgtgagttttgtggttttgttgctgctgtcactggcagcatgaagaagcattgccagtgtcaaaagtcttcttcctctgcagcccttatccccccatgcccatgcgcagctctgtggggaaggacagaaggtacacatggggctgttggcagcctgagaggtcagaggccagccagacaacctgtcctgggctcctcgcaggaggccagtgggtggggttctgacaggaagagcaggtgatcagggagtgtgggatggggtggggctggggccccaccaatgagttaatgagtgaatattgccgagcagcatgggccttgcagcctgcaaggtcaggggataaggaggatgaggccatctgacactcaggctgtgctggggcggggaggatgttctgagagccaccttgggtgggcagagacctagccaatggttctcacgacccatcctctagcccctgcctgtcccccattcctttttttttttttttttgagacagagtttcattcttatttctgaggctggagtgcaatggcacagtcttggctcactgcaacctcctcctcccgggttcaagtgattctgctgcctcagcctcccaagtacctgggattacaggtggccgccaccacgtctggctaatttttttgtatttctagtagagacaggatttcaccatgttggccaggctggcctcgaactcctgacctcagataatccgcctgccttagcctcccaaagtgctgggattacaggtgtgagccgctgtccagaggagggaacagaggacgaaacagagatgggtgataactggttcactgtcacccatcactttggtggcagaaacaggacgggagcccaggcgttgactcccagcccagggctcatttgtctgtgttccatggagcactgattgctgctccatgggtcccccatcccaagaggcaacacaggcccagagcagccggaagggaggacagatggatcaggaggagccgaggctggcagtgtttgcccatttcgctcccctggcctgggtcctgccccaggacctgttacggaattacttgccctttactgccctaaactgcccctgggctgggtgaggaggaaggaggggactgggctcaggaccaggacctgcaggaccagcggccaatgagtgcggacaatggggaaggcagccaggatggttgggggtggtggtgggcggggcgtgcctttagcatttggcaaagtagggactaggaactgctgacaaatattttgtacccttacttcagagcagaaaggctatttgggagcaaaattctctcatggaatgaagagcctgttaagaccttttttcaccaagtaaaacatgaggaagctgtggatgtgcagtttctttcacacctgcaaattacacagcaatcattcacccagcaaaggaacatttgctcctaggggctggagggagctgccgtagggagggtgagaggaaactgaggcttccagagacaccctgtctgcagacggcaggtagctgttgcatgcacctcatcccatttaatcctggatgttactggctccatttcacagataaggggactgaggctcagtgaggttgagaggaggtagtggggctggattacaggggaggggtcactgatgagtgagaaaggtgggttgggggacttccctgaaagcctctctttctctggaacccaggcatctgggcctcctacttttctggctgcccccaaatgtctttgctaagcaacgtagctgaacagtgccaagagatggcagtccctaaggtataacaggaggcacccccttctccccatgggaattggatgcaaaaagggagaagcccatgacgatgttccctgtgggcacgtggccaggagtacttgagaaaggcagggggctgaatcgggacaggagctggtgtgaggtgcggtgggcaggaagcagcaggcctgggggctttcagccttcaggaagcaggctgcagggagaggtgtgcaggacacagagcaagaggaggcaaactcaagccagtcctggctctttggccctgggctcctccactgacccgggacgggaaagaagccgtcatccctccgtggagagtatgcagatgggcatcagtggagggtccagggaccagaacaatgatgacgtgcgtagaaggggactgcagggccatcagattcagctgcatgtgaggaggaataatcagtcattgaacatgtaaacaactttgcagaaaatcaacccctccatcctttccctgtcgcagctttctgtggccttttctgaccccgatctgtgtataaacagagctttcccagtttgtcatcatcatgcatatgcaatttaggccccacctttcatccacattatttccctgacattttgctgtgaacactggactcctcgtgtttattattttaaatcagcgctttatagtcagcgagtttttctagagaggaaacggaagcccagggctgggccaggggtgggtaactgggtagttttatatgcacatgcaggcacacacacacacacacacatgcacacacacacacacagcacacacacacacacacacacacacacacacatgcgtgctcactcctgggcttggtctgcccagccttctgggtaaaccctccgtcagatggaatggctgggatgccagggttattggcattctgcagtttcttcataaacaaacagcaaatcccacgagggtggtctaatgctgggtaaatattccaacaccaccctctgcccctggctgcccccccaccaaattacacattctttttgttttttctttttttctttttcttcttcctttttttttttttcaaatagagacagagtttcaccatgttgcccaggctgggcctgaactcctgagctcaggcggttcacccacctcggcctcctaaagtgctggattacaggtgtgagccaccatgcccagccatcaccaaattacacgttcttgataatagattccacgggtatgtgctatcaccaacacggagactcagagacacattgtgcgtaggtcgaggcccatgagcagggacagtgaggaggtggctgtgtttactgagctcttgctctgttacagtttagtgccttctggcaagaggcaaatattatttccattttacagatcaggaaactgaaatgggtgacaactgaaatgacttgtccagggccacatgcctagtaagaggcagagcaggattggagcccaggtcagtaggattttggagttccttctcactggagtcataaaagaacccattaggcggtgaccagtagctcatgcctggaatcccagcactttgggaggctgaggcaggaatatcacttgaggccaggagttcaagaccagcctgggcaacataatgagaccccatcttcatacacacacacacacacacgtacacaaccaccaaaaaaaattcagctgggcttggtggtgtgtgtgtgtgtgtgtttgttttttttttttttgagtctgtctcccaggctggagtgcaatgatgctatcttggctcactgcagcctccgcttcccaggttcaagcaattctcctgcctcagcctcccaagtagctgggatttcaggcacccaccaccatgcctggctaattttttttgtatttttagtagagacaggttttcaccacagtaaccaggctggtctcgaactcctgacctcaggtgatccacctgcctcggcctaccaaagtgctgggattacaggcatgaaccacagcgcccaggctgatggtgtgtgtcttgtacaggaggctggggagggggatggcttgagcccaggagtttgaagttacagtgagctctgatcataccaccccactgcagcctggggaacagtgagaccccatctcaaaaaaaaaaaaaaaaaaaaaaagaacccttatatcttccctcggagcctgttgagatagttccaacggggttagggttttggtttctcaacccacaagcgttagaaggtgcaatttgggggatgaggaggtgtttttgggggcatcttcaaggaacagagatgtctggggtgttgagtgttgcaaccaacagccctcatatgcaccttctctggctgtaggagacgttgttacattataggacagcatagtaactgatgtgcataatggtgaccaactcatcaagaaaatattaaggccaggcgcggtggctcacacctgtaatcccggcactttggaaggccgaggtgggtggatcatgaggtcaggagatcgagaccatcctggccaacatggtgaaaccctatctctattaaaatacaaaaaatcagccgggcgtggtgatgcacgcctgtagtcccagctactggggaggctgaggcaggagaattgcttgaacttgggaggcagagagtgcagtgagctgagattgtgcctggtgacagagggagactctgtctcacaaaaaaaaaaaaaaagaaaagaaaagaaaggaaatattaaattgcatttagcataaagtgtagtgtagtatctaaaaacattttcctcgggaatggataacacaagtttgaacaaataaggattatatttggaaattcagtaatgtgggatggctcattactcagtgttactgagtatatgtccatttattcaccatgtgttttagttatccactgctgtgtaacaaacagccccaaaatttggaggcttaaaagagtaacagtttaaacctgggcaacatggcaaaactcttgtctctacaaatggtacaaaaatcagccaggcatggtagcatgtgccagtagtcccagctactcagaaggctgaggtgggaggattatgagccccggatgctgcgatgagccatgatcgtgacactgcactccagcctgggtgacagagcaagaccggtctcaaaaaagaataaaaaaagaatgacagtttattgtttctcatgatcctgtgggttgactgttcagctgggtggtttttgtgcttcacgtggcatgggctggggtcactcatttgtccacctgcgctgtttcattcacctgcagcattcagttgccagctatgctggcaagttctaagaagcctttactcatgtctggagcctcagagctcctcctcctgacctctccatgtggctaacttgggcttcctcacagcatggtggtctcagagagaaggtggaagctatcacagtttttaaaggttaggctcatcactatcggctacaagaagtccaggctaactcagatgcaagaggaaattgattctatcttttgatgtttgagtagcgtgtgtaagggagggaatgaattgatagcagctgtcttctgaggctgtctgagaaaccaggaggcacatgggggatgctggggagacggaactaattaaagccatgagattgggtagggtccaaaatactctgtgaccacagaatgcttcaaaagttagaaatgtggcccagagcccagtgtttttaactccattaaggtattgattctctgtaggatccaatacatcatttctaagatttttagaaagtttcagaaactgcattgtacagagagaaatggtggctcagaattcatctgtatagactttgccttgccttatttgggtgagaagtcattctcttaccttctcaagcatgcaacggcccctgtgtccaggacactgccctaggtgacaggatgtgtggcttaatcatggaccccagcaccattcctgcccctttctctcctcagcttaggttggcagcttggctctgatgtttgtattcctttcccaggaggtagagatttgcatgtgcacaagcttcagaaacaccagataggattgggtttgcatttagggggatcatcttggtggacctgaatgaagtcgacatggtgcaggaggctggtgagggagtccaggcgtggcaccatgagggccacccaccaggacggacgtaggggatggagaagatgagtttggtttgagttgcccgtgggacatccaagtggaactttcagattattcagtggaaagttattgaacaccttctgtataccagaccttgtactcaagatctggagaagaaaggtctagagttgcagatttgagaatcatcggcatttaagtggcacctaaaactgtagggaggctgaggggttgcctggggagagtgtgtagaatcaaaaaggaagggggcttagaatccaacacgtggagcagccaatgtgtgtcgggggggccctcagcatgggacatctgtaacccgcccctgcttcctgccgggacccatgattgtcccaggtagcctgtgctgggtagatcggccattaggaagcaggaagcagtgtctgtctgatggtgttttgcacgattgatgctcttgcattggggagacttaagcctagccaaggtggggccatggtgccagttgagggactgcttcccacagttctaactggcaaacaagggcacgggagtgtgactgtgttacctggttgggggaggggtgggtaattatatagaggcgctttaaactacaaagcactgtgcagatgctagttatttctttattacatttaatcttggcagaccatctctgatctttgaactatgaatgaatcagaccaagtttcttcattatccttttttcatctcttttctgcgtaatcaactagctctttttcttcattgtgaaaggattattgttaagaatgtttcaaattataaaatgctgaataatattgcagaatattgtactattccttttctgtagggcatttgtctacttttttttctttctttttttttgagacggagtttcgctcttgttgcccaggccagagtgcaatggtgcaatctcagctcactgcaacctctgccttccaggttcaagtgattctcctgcctcagccttcccgagtagctggggttacaggcatgcgccaccatgcccagctaatttttgcatttttagtagagatggggtttctccatattggccaggctggtcttgaattcctgacctcaggtgatctgcccaccttggccttccaaagtgctgggattacaggcgtgagccatcacgcttggctcatttgtctactcttaatttttgtatttttatttttattttttcttgagagagagtctcgttctgttgcccaggctggagtgcagtggaacaatatcagctcactgcatcccctgcctcctaggctcaagtgattctcctgccttagcctcccaagtagctgggattacaggagctcaccaccacacccggctaatttttgtatttttgtagagatggggtttcgccatgttggccaggctggtctccaactcctgaactcaagtgatctgcccacctcggcctcccaaagtgctgggattacagacgtgagctactgcgcccagtcttgtctattcttaatttattgattttatttatgtgtcacttgcattttatttacttgctgtcgtttcagcaggcccatcccctctctcctttcccctccttgccattttctgtctgatgactcttccttcttctgagcaggttttcagtcctttcttctaggaaattcctctttgtggttcctaaggaattcactttgattagaaatgaaactgtttctttccttttccccttcctctcctccacaacactttccttcttgtagacaggaaagtaaatgacttgtttcagaagaaatctacccctctcttgagctccattcaaaaccccaacataagcgactggacttgaactttcgcaagatttccatgtctggggtttgttgttcacatgtcacttcaggactgatctccaggaagtgtagtttggtgtcggctgagtcagatctggtagtggaagactgcgacagctgcctatccagctctcggtgggctcctggactgcccttgggggcagtttctcacccaaggggaccaggccctgaggaatttattcccatgagcctgattcctttcatttttatttttatttttttgagatggagttttgctcttgagtgcagtggtgcgatcctggctcactgtaacctccgcctcctgggtttaagtgattctcctgcctcagccttccgagtagctgggattacaggtgcgtgccaccacgcctggctaatttttgtatttttagtagaggtggggtttcaccatgatggccagggtggtctcaaactcctgatctcaagtgatccacctgcctctgcctcccaaactgctgagattataggcgtgagccaccacgtccagtcttgagcctgattcttataagacagattgctcaaggcctggtcaccaacctgcttatggtaggtggaccttcccaccttctctggagggcagcggggtgggagcagggggtggtaataccatgtgtgtcatttggtacatatttgctgccaattcctaagaaaccaaatcagtaatttcctgaaggggaatctgagcaaagcgcatggcatggtgccgagggttgttcatcctcccacgtggggctgggggccgaccccactgcccacaggcacattttctactgtggacaaccctgtcagctggagccagcccaaggagtggcacacagcctcacccttcagtgcctttttgctctactcctgcccatgcttacagtttacctttcattggtgcagcactgagtgctctggaacacacattcctcctgtagttgggcttgtagttgttaatatcatattgcccatctccagggacaaatttgggatattcactctttatttccatgaagagcccaatctagggtggttctttttattttttttttaaacagtctcactctctcgcctaggctggagtgcagtggcatcatctcagctcactgaaacctccacctcctgggctgaagagattctcctgcttcagcctcccaagtagctgggattacaggcgtgcaccaccacgactggctagtttttgtagttttagtagagacggggtttcaccatgttggccaggctggtctcgatctcctgacctcaggtgatccgcccgcctcagcctcccaaagtgctgggattacaggtggcatttcctatcccttccattgtgtctcagacctgctggccttcacaattacggcgtagtgaagggaccttgtgagtcttggtcgaccctcaccccgggtggctttctgctttggactctgggtcaaagcactggcgtcacagtcattcgacttgaaccaccaggagctcccccacttaccaactgtgagatctggggtaagttatttaacctctttgcctggtttctccttctgcaaaatgggtgtgataataatacctttttcactgggataggcggcaagcactagaaatggctgtttctctggctgtcactgtcattgtgatgattattggctctgataaggaattgtagaaaagcctggcccaaccacaagggagggaagagcagccccaggcttcttccaggatgtctcaagggcgcctggtggcttcaagccctgcccttgcctccctggttggggcggacctgacatccctccccgcttggccctatccaccctatcattgtttcccaacccctgactggggtgtcggaccctcagcccctgtttaataaatagccatattcaactttcctagacaatttttgtcttaaaaaatgtaaaaacggctgggcacagtggctcacgcctgtaatcccagcactttgggaggccgaggcgggcggatcatgaggtcaggggatcaagaccatactggctaacatggtgaaaccccgtctctattaaaaatacaaaaaaatcagccgggtgtggtggtgggtgcctgtagtcccagctactcgggaggctgaggcaggggaatggtgtgaacccagggggcagagcttgtagtgagctgagattgtgccactgcactccagcctgggagacagagcaagactctgcctcaaaaaaaaaaaaaaatgcaaaaacacactttcaattattcaccatttccccacagtaactaagaaagaccaaactgtaccttcccatctctctatagtgatcatggctttgcttgctggacagggctttggttaataactctaataatcagggaaaaagcaaaaacaacacaatagaggaatggcgcataggaggcaaaatagaagaaactgaccagtcgcattggctcacatctgtaatcctaacactttgggaggctgaggcaggcagatcacctgaggtcaggagttcaagaccagcctggtcaacatggtgcaaccctgtctctactaaaaatacaaaattagctggacgtggtggtgcatgcctgtaatcccagctactagggaggctgaggcaggagaattgcttgaacccaggaggcagaggttgcaatgagccgagattgtgccactgcattccagcctgggcgacagagatgctgtcttaaaaaaagagagaagaaacttacaagctgggtcaccgttttttttggttgccttctaaatgtcggagagaatatgctttccacatgaagttctccacagagacaaagaatcatgtacttttttcttttcttttctttttttttgagatggaatttcactctgtcgctcaggctggagtgcaggggcacgatctcggctcactgcagcctctgcctcccgggttcaagtgattctcctgcctcagtagtatggactacaggcatgtgccaccacacctggcaaatttttgtatttttagtagagatggggtttcgccatgttggtcaggctggcctcaaactcctgatctcaagttctctgcccatttgggccttccaaagtgttgggattacaggcgtgagccaccacacccggctagaatagtggaatagtgtacttttgatccaaatttctctctgcctcttttctttctctctctttctttctctctctctctctttttctttctttctttctctctctctctgtctccttccttccttcctttttgcattttggcaatggcctttcacttaatgtcttttctctttatgctccgtctttgggaggaatgcgtgaagagttggttgtgggtgggagacatggtgaagaaggctgctggcatggctgtagtggaggaagccaggtatgtcctttcattaggtcagatcatgtgagctgcatggagctcggttcctttcatatggagaacctggggttaggatgtccctgtggccctagatggcctcactttgttcccctgagctttagaatcttcgtcctcggcagggttagtgacgcacaacacctgaggcttcgagttgcatttagggaagaaagggatcatggcgctccctgttcagctggcgagccgtgctggagccctgccatggtgcccccgcaccctcctacccctgctcccattcctccccgcccctcacccacttcccttcacgatggcctaatgggtctgatgactctctgaggactagttacaaataacatttgcatggatcattgaagcgctttttatctcattatgtcacttagtcctcacacccactctgtgaggtggatattcttgtcactggcattttatagaaaagaaagtggaggaggaacagagggtgaagaaggcgcccaggctccccccgggaagcgcagacccggctggtctcagggccaagacttccagatccaaatgcaagtcagaagtcgtcttctctgaggagatcgagacagacggttgtggaagtggttacatgactgtgtgtcagaacatagaactgtacaccaaaaaagggaattgtactgtacatgaaaaaggggaataacaacaaaagatagatggtggagagcacagacggtcaaaagatggcttcagcatacagttgacccttgaaccacacaggcgttaggggtgctgccccccacacagtcaacatccatgtataactttttttttttttttttttggagatagagtctctctctgtgtcacccaggctagagtgcagtggcgcgatcttggctcactgcaatcttcgcctcccgggttcaagtgattctcctgcctcagcctcctgagtggctgggactataggcgcccgccaccacaccaagctaatttttatggtgtgatcacggctcactgcagcctcaacctcttgggctcaagtgatcctcctgcctcagtctcccaagtacctgggaccacaaatatgtgccacaacactcggctaattttttgtgtttttagtagagacggggtttcaccatgctggccaggctggtctcgaactcctgccctcaggtgatccacccaccgcggcctcccaaagtgctgggattacaggcacgagccactgcgcctggccaggaaaatatattgactattcattaagtggaggtggatcatcaaaaggtcttcatctgcatcttcacgttgagtagctgaggaggaggagaaagagaaggggttggttttgctgtctcaggggttgccgaggtgaaagaaaatctgcaagtggacctgtgcggttcaaaccctgttgttcaagggccaactatggtgtggtaagagctatggtaccttaacagacactccacggggctgggagagaagttgacttggatggggcaccatggcacatgttgggatgatggcagtctttcgtatcttgcttggagaagtagtcacacagctgtacatatttgtccatattcatcaaaatatacacctaaggctgggcaaggtggctcacgtctataatctcaacactttgggaggccaaagtgggaggatcgcttgagcccaggaattcgagactagactgggcaaaatagtgagacctcatctttacacagaattaaaaaattagccaggcgtggtggcacacacttgtggtcccagacactagggagactgaggcaggaggatcgcttgagcccaggaggttgaggctgcagtgagccatgatcacaacactgtactccaacctgggtaacagagtgagaccctgtctcaaaaaaaaaaaaaaaaaactacacacacacacacacacacacacacacacacacacacacagagttaaaatgtgtgccatctactaaaattcagtaggttttataaaaagtcagtaaaatacaggaatcacaaaaattgtgcatacatatatacatttatatgtattttaaatagtttgttttaattgaaaacatttagctatacagtcatttgccaatcttttgttgaagggaaagttctttcctttttatataggtactctgtttggtattccttgtggcctttttctttttccttcttcttttttttttttttaaagatgaggtcttgctatgttgcccaggttgggcttgagctcctgggttcaagtgatcctcccaccttgacctcctgagtagctaggaccaccggtgttagccaccaccccctcctatggccttcttttgcagctgggatgtgttgtgtgtcatttccagtttccttaaagtggagtaagaattaaaagtcacttggaaggaacctgggtacagaatccccctacatttttattactgttctttctttttggccaaattgttactgtcttgcctaccttgaattcaacagcaatttcttctagctacttatatttgtcaaaaatgttcaaaatactcactttactttttttagaaacaacgcgctttctttcacatccatattttatctgtgtaggttatatttaattaagttatgtaaatataataccaaaaacaactggcataaacaggtttgggactaaacataagtgattcttggaaaatactccgaaagttggagcagaaataaatgcatggccttcctagagaggagcttgcctgcggcacgtgtaacgtcagttgatttctggagggactggactatcttggtggatccagtgtctcggctctggggactccagcgctatcctgtgcccctgccccttcctgctcggctctgacctgctccctcctcgctgcttccattcctggttctttcattttccttttttttgagacggagtctcactgttgtcgcccaggctggagtgcaatggcatgatctcggctcactgcaacctctgcctcctgagttcaagcgattctcctgcctcagcctctcaagtagctgggattacaggtgcccactaccacgcccagctgatttttgtatttttagtagagatggggtttcaccatgttggccaggctggtcttgaactcctgacctcaggtgatccacccgtctcggcctcccaaactgctgggattacaggcatgagccaccctttcctggttctaatttgtccacaggaagtaatgcatgtctacttcttgttttctacacagcagcccttccagtgtttgaattcagctatgttgctctccctggatctcctcttcagcctcgcccatctccctttttcaagaagtcctcaggcgacatggtttccagaccttacatggtcctgggcactttctctaggtgtagactaaagcgcattgctcaggactgccttctcctgtttgcccaggctgctcacagaaccttgtccatcctgcctagctgcgggacacaaacactgcaggtagaaattctgtagctatacatttaagattgggggtatggcccccccatttctggaaagtttatatgtcaggccttaatgatagagctattgtctacataaacatttacgtttttaaaaaattttttatttaatttttttttttttgagacagagtctggctcttttgccccaggctgnnnnnnnnnnnnnnnnnnnnnnnnnnnnnnnnnnnnnnnnnnnnnnnnnnnntggcatgatctcagctcactgcaaccttcgcctcctgggtggtggcgcacacctgtaatcccagctactcaggaggcccccccaggagaattgcttgaacctgggaggcggaggttgcagtgagtcgagatttcaccactgcactccagcctggggtgacagagcaagactcctgttctcaaaaagaaaaaaaaaaaggcaacttcatttcatatgattcaatctaacataaaagtaacaaatgtattcactgtggaaagcctggaaaatactatgtagtatgaaaaaatattacccataatattatttctgaaggataactgctattaacattgaggcttctcttaaacgaatatcagttttcttctatattatgaagcactattgtaagaaaataattcaacctagacaggagtacaaagaataaaagtgaaagtcctccttccttcccttgctccccttctcataggtacccattgccaaatgtttggtgtggatacttccagagatctttctgtgaattgcatatttatgtgactctatgcacatttaggacagatacattctttatataagcttatgcaaatcggggaagcaaagctctacacacccctctatggtaactgtagtttcctctcaaggggatgagatgcctctgccgtctgcagccctgcctccatcagctgggtggtgccactcgaggtccacactggtggcctccttgagccacagccacctctcgagctgaggaagagtcagggctggtctagcaagctgcttctgcttgcttccatctgcagcagcaagaaggcatctttcaagggcctactgggcaggaaatccagggacagttcggcctggcaggctggtggcagaggtggctggggtgacagcagcattccagccgagagtgaggtcccgctcttagacaaacatgggctttggtcgcaagagaatggtttatttattgggattgaagaaggcatcaaaatcaatacagtcatcacctcacagggcagaagagcggatggtggtttggggagaaggaggcggtgtgccaggaggagggaagcgtggcccagagttggatgcctggggccctgggcagcgcagctgacctccctgggcctctgtgggtcagctgcctagggagttgcctaggcagttggcaactgcctagtggctctgcctagggagcagaggtagagacaggtgagctgggaaaaggtgggaggggtagggggacattggaagccagtgacaccgggattcagggtgacaaggggcatgaggggacagtggagtgtttggaggctattgagtgtgtggttgtgtggtgagaacagggagaatggtggtggagctggagggagggcaggtcacctgccgtggtcgtgcttggcgtccgcgctggagttctctggcggtgaaagggtttccagtgtgaactggagctatccccaggctgcagacctcccactgctgagctgctgttggttgcgtggtaaattttgcttttgttctcccagtcttaggaattctgtttgcttccccgaacctcccaggcttccccaggcaagggttgtctccccagagacctggagccgggagctgtgcggtttcctgggacctgtggcttctgctcctttgctttgtggaaaggaagtcagaggcggaaatgggagggctcctttccagtgctgcagggctccattgagaggctgatttgagagtgaagatcttcggaggatatttcctctggctgagtgtaattgacttaatctgtggtgtggctcatttttccttttggaaaaaggagagatggcgcctgactcaccccttcatgaagcactgtgtgaagtacacgaagcccctctccccgaggacagccctgcataggtgcattcccacacagtcagtgtcccgactcccatcccgcagacagtaggtccactcccttcctttcttctcggtgcgagggtggggctcaccccacggtgatggaaaggcggtcctcgagcctccccgggggcctctgtggcgcacgaactgggagagtggagagaaaagcccctcaggaggaggagtactgagctgggccgtgaagggcacgttggatttcgatcctgaggtcagtaggggaggggcagtggcagtggcttgtgaacaaaggtctgggggtgaacatagacggggtagtggagaacctctgactggagagttgggtgcagtagtaacaaagaagcctggaaggttatttgggatctgaaatggggaggagtaaaagccatatgagacagttctgactccattttgtagacagtgggcagccattgaaagctttggagcaggcagttgacctgagccctgctacctttcaggaagatgattctggcagcgaacggtgatggctgtgagcagcagagtatgtgagaacctgcctgaacgtggcgggatacaaggagctgacctgagccaccgaagcgggtataggagagagagggattcgttcagccagcatagacggagggcctgctggtgctcagcatattagaaggtgcaaaatggaaaagtctgggttgttgtccttgctgaacttcccgtgtgagtgtgaagatttcaacacactccccataaactgatgagagactatttcaaatcacccatgagaaggtggaggaagagaacagccagccacatgtgacatcgtgatggtagagttgggaggaacactgaccaagcacctgtttcgcgccgggcactgtgtcaggtgctctgatcctctccccaaccctggggagatttcagagagagactgaggtgctttctcagggacacacaggcccttggcaggtgaggctggtgttcagcttctgctctgtccagtttcagagtcttggctctttatgccaagggcagggggctttgaaccaggccttgaagttagtggtagcaatggaggtgggggtacattctataagaagtcccagaaagagagagggagagagacaaagagagagagaagagggaggaggaggaggaggagaagggggaggaggagaaaaaggagaaggggaaggaggaggagggtgtggctgaattagagaccaggaatggcagttagggaaagatggggtacaggtatggtaggcaagagggatatggttgaaagagggtgggtggctggtctctttcttcctctgatctaccatgatgtcatcttgcgaaaagatgatgagacttctgcttccagtcgagagtgagcaggacagcctggaattattctcccactgtaaacaactaggagctggataaaatatagggaccaggcaatggtggactgtgattccttggaaaaagaagactaaccgagtgagccctatcgttcattacctagcctttctacctgaagagaattctaccacagggagggagaacccaaacggagactggcgagattactaagttgagggaacagagatcagaatttggagacaccaagttctaaggtttctagaatctgtgggacagaatcctaaaaggaagaagctggaaagagaaagatctccagaaatctcgatagaggcctcctggaatctcggtgaatatcaatctgctcatgcacagggcaaccctgtgagaccagaagagaacaactgcagagggagctgtaagacaaacaggatagagccaacacaggaccagggttcactggagtcctctttaaaagaatatgacaaaattatgcattgaaaaatggtaacgtttgcagtgtgagacatccagcaaaaaattactagacaaagaaggaaatgtgactgacccactaacaaaaaaaaagtggtcaatagaaatagacctagcaatgacaaagatgtgatggaattatcagggaaaggacatgaaaataacttttttttttttgtaacagaatctcactttgttacccaggctggagtgcagtggcacgatctcggctcactgcaacctttgcctcccaggttcaagcgattctcctgcctcagcctccggagtagctgggattacaggtgcatgccaccatgcctggctaatttttgtattttttagtagagatggggtttcgccatgttgaccaggctggtctcaaactcccgacttcatgatctgcccatctcggcctcccaaagtgctgggattacaggcttgagccactgtgcacagcccgaatataacttttataaatatgtttcatttgatcaagcatgtaaatgaacacatcaggatgatgggaagagaaatggaaagtataagaagatccagtagcacctctagggatgaaaaatcaaaatatcaactacaaaatcaaaaatgaaaagctaggtagataggattaatagtagattagacagtgcagaagaaatgatcagtgaattgaagctagagcaataaaactatctaaaattaagcacataaagataaaatattccaccctgggcaatatggtgaaaccctgtctctacaaaaaatacaaaaattagccaggagtggtggcatgtgcctgtggtcccagctactcaggaggctgagacgggaggatcacatgagctcaacggcataggttgtgttgagccaagattccatcactgcactctagcttgggtgacagagtgagaccctgtctcaaaagaaaaaaaaaaagaagaagaaagaaagaaaaaacattgacaaaaggtaatactcagagcatcactggcatgtgggacaatataacagaccctaatatgtttaattgaagtctcaaaagaacagagagaaagacagaaaaaaatatttgaagaaataatggtgggaaaacgtccaaatttgatgaaaactcaacccatgactcaagaagctcaacagaatacaaacaaatataaggaataagaatgaagagaattggtcaggcgtggtggctcatgcctgtaatctcagcactttgggaggctgaggtgggcggatcacaatgtcaagagatcgagaccatcgacaaacatggtcaaaccccgtctctcctaaaaatacaaaaattagctgggcgtggtggtgtgtgcccgtagtcccagttactcaggaggctgaagcaggagaatcgcttgaacccatgaggaggaggttgcagtgagccgagattgcaccactgcactccagcctggcgacagagcaagactccatctcaaaaaaaagaaaaagaaaaatgaagataattacatcaaggcacattgtaatcagattgcttaataaagatacactcataaaagtaaccagaaagaaaacaaaaaggaaaaaaaagacacacgacatagagaggaacaaagataagaatgacagcagatgtgtggtcagaaattattcaaggcagaagacagtagaactgaaaaagaaagtaggtcaatctagaattctatacccaacacaaatatccttcaaaaatgaaggtgaaataaacactttttgatggacaaactgaagttgagagaattcgtaaccagcagacctgtagtacaaaaaatgttgaggcaagttttttaggcagaagaaaaatgatactagatagaaatttgggctgcacaaaggagtgaagaggcttccaaatggtaaattatatggaaacatatgaaagttatcttttctcatttttaatctctttgagaaactgcttaaagcaaaaatataaacaaggtactttggagtttagaacatacatagaagcaaaatgtatgacaaaaatagcacaaaggacaggaggggagaaatgaaagtatattgttataattttcttatttatctttatttattgttactagtttttagagacagtgtctcactctgttgcccaggctcgacagcagtggcacaattatagctcactgtagcctcaacctcctgggctcaaggtcttctcctgcctcagcctcccaagtagctgggactacaggcatataacagcatgtctggctaactttttgtagaaatagagtctcaccacgttgcccaggctggtcttgaactcctggcctcaagcagttctcccaccatggcctcgcagagggctgggattacaatgtgagccaccacacttggctgtaattttcttatatgcaaagtaatagaatatttgaactagactgtactaagttaatgtttactctaagtcccagagtaatcactgaaaaagcgtaacaaagagatatgactcataagccaataatggagataaaatagaatggtaaacaaaaatcattcaaaagatggcaaagaaagtgggaaaaaggaacaaagaacagtaagataagtagaagacaaaaaacaagacaacagttttaaatatagccatattgataatattaaatgtaagtgatataaatattcagtttaataggcagatattggcagtggctcacgcttgtaatcccagcactttgggaggctgaggaggacagattgagctcaagagttcaagaccagcctgggcaacatggtgaaaacctatctctacaaaaaatactaaagttagccaggagtagtggtgtgtgcctgtagtcccagctgtttgtgaggctgagatgggaggatcatttgagcgagcctgagaggtcgaagctgcagtgagctgtgatggtgtcactcactccagcctgggcgacagagtgagaccttgtcttgaaaaaagaaaaaaaaaaaagacaggtattgtgcagtggataacaaagcaagaaccaactatcaactatcataaagaaactcatcttaaatataaagacacagatagactgggtgtggcagctcatgccttcaatcccagtgctttgtgatgcccaggtgcaaggattgcttgaggccgggagatcaagaccagcctgggtgacagagcaagaccctgtctgtacacaaaaaagagaccctgtctctacaaaaagaaattttctcgctctgctgcccaggctggagtgcagcagcgtgatctcggctcactgcaacccttgcctcctgggttcaagtgattctcctccctcagcctcccaagtagctgggactacaggcatgagccaccacatctgtcctctacaaaaaatttttttaaaaattagctgggggtgatggtatgcgctggtagtcttagctaccttggaggctgaggcaagaggatggcttgagtccaggagtctgaggctgcagtgagctgtgattgcacaactgcactgcagcttgcatgacagagcaaggcccagtctcaaaaaaaaaaaaaaaaaaaagacacatagattaaaagtaaaaggatagaaaaagacattttgtgcaaaccctaattaaaagaaaaataggccaggtgtggtggctcacacttgtgatcccagcactttgggaggccaaggtgggcggatcacttgaggccgggagttcgagaccagcctggccaacatggcaaaaccccatctctaccaaaataaataaataaataaataaagatggtgtggctataagtaccagacaatatatactttggaacaagaaatattatcagggatagcgagggacatttcataatgacagaggaatcaattcatcaaaagacatcataattctaaatatgtatgcacctaatgacaaagctgtaccaaaggaatatttatagaaccctgcacccaagaactagagaacatacattcttttcaagtgcactgaaatgttctcaaagacacacaacctgttacaaaacaagactcaatacactttggctgggagtggtggctcacgcctataatcccagcactttgggaggccgaggcgggtggatcacgaggtcaggagatcgagaccatcctggctaacacagtgaaaccctgtctctactaaaatacaaaaaattagccgggcccacttggtggcaagcgcctgtaatcccagctacttgggaggctgaggcaggagaatggcgtgaacccaggaggcagagcttgcagtgagccgagatcgcgccactgcactccagcctgggtgacagagccagactccatctcaaaaaaaaaaaaagactcaatacactttaaaagattgaactcatataaagtatattctctgacaaaaatggatggaagtagaagtaacagactatatctttaaaaatcccaaaatatttggaaacacatgcctaaaggaaggaaaaaaatcacaagagatcttagaaaacatattgaattaaatgaaaatgaaaacaacatgctgaaattagcagacgcagacaaagcagtgctttgaggataatttgtagcattaaatgcttatacagtagttcccccttattcgtgggggctgttccaggatccccagtggatgcctaaaactgtcagtagttctgaaccctatatataccatatttttcctatatatacgtatctatgataaagtttaacttataaattaggcacagtaagagatgaacaacaactgataataaaatagaacagttataacagttggtacacattttctgtttgtgtcttccacccacaaacttaatacctttttcatctttaagccctttactatgcactgtagctgttacttttgcagtctgaagtgcaacagcaaaactcacacaaatttatctttcccttttcacaagttcacatatagaagatttgctcttaccctagatcttcgccacctcaacgtatgatctttcctttggttgagaaattttttcttttcacttaaaggaaacgctttatggcttctctttggcatatctgaattgctagcatcactacttttatactttggtgccattataaagtaaaataagggctacttgaacagaagcactgcagtaccttgtcagtcaatctcataaccgagacagctaccaagtgactcacaggtgggtagcatggatagtggggatatgttggacaaagggctgactcacatctctagtgggacagagcaaaattgtactagagttcatcacactactcaatttaaaacttatgaattatttatttcttaaatttttcatttaatatttttggactgtgattgaccttgggtagctgaaaatgcaaaaagtgaagccacagataagggagactactgtattaataaagaagaaaggtctaggccgggcgcagtggctcatgcctgtaatcccagcactttgggaggccgaggcaggtgcatccttgaggtcaggagttcgagaccagcctggccaacatggcgaaaccccatctctactaaaatatgaaaaaattgctgggtgtggtggcatgcctgtaatcccacttacttgggaggctgaggcatgagaattgcttgaacctgggaggtggaggttgcagtgagccgagatcgtgccactgcgctccagcctggaggacagagcagactctatctcaaaaaaaaaagaagaaaggtctaaagtctgtgatggaagcttctaccttagaagcttaaacctttagattgaagtagaaaaactagatccagagaaagaagcagaaaaaaaaattagtgggaaaacattacaaatcagtgactccaaagctggttatttgaaaaggtcagtaaaatagataatcctctagctagatgattgggaaaatgagggaggacacaaatgaccagtaccgggatgcaggtgagcatgaatacagatcatacagacactcagagagtcataagatgatgtcataaacaactctgtgccaatacattgaacgacttagacaaattggacaaattacttgagaggcacaaactatcaatgttgaatagccccatatccattgtagaaattgaattttggtttaaaaccttccacaaaggaaaccccagcctcagatggtttcagtgctgaatttcatcagacatttaaaaatgaaataataccaattccacataaattttatcagaaagtagaagaggagggaacatttcccaacttattttatgaattcaatattgccctgatatcaaaaccagacaaagacgttacaaaacaaaaactccagatgaatatccctcatgcacatgtaagcaaaaatctttaacagaatattagcaaagaaaacctggaaatatataaaaagaataatatataatgaccaagtagggatttgcacaggaatgcagggtggttttaacatcttaaaattggtgcagtttaacattagcctactgaaaaggaaaacccataagatcatctcaattttgtcaaatgcagaaaaaagcatttgacaaaattcagcatccattcagataatacctctcagcaaactaggaaaagaagataatttcttcaacctgagaaaaggcatctttgcaaaacctacatcatatttaatagagaaagtctgaatgttctctttttaaccaaggttggctttatgagcacatgacttgtgcagtctggaaattcttaacaattttatttattcatttatttatttgagacggagtttcgctcttgctgcccaggctggagtgcaatggcgcgaccttggctcactgcaacctccgcctcccgggttcaagcgattctcctgcctcagcctcccaagtagctgggattacaggcatgtgccatcacgcctggccaattttgtatttttattagagatgggatttcaccacgttggccaggctggtctcaaactcctgacctcaagtggcccactcgcctcagcctcccaaagtgctgggcaggattacaggcgtgagccactgtgcccagccaacagttttatttttgaacttatgttttgcagctgaagcctgctgagacaatggaacatgcatatgtactgaagaaatacatacaagatgagtacctgccatatgtttttgtgtcatttgcatatttgtgtgtgatgccccggcaacatggagttctggtgaattcacaatgtctgggagttgagcaagatgcaaaacaagcgcaaaataacatgtcgcatccacagctgagtaagtagaggtactgacagctctgagattttgtgctttctgttcaaactagaacttgcttcaaatacagaaagaaggcagtgacattctcagaaacatgaacatcccatgctgcttccctgtattggccaaccatttaatgctgaaattaatgacacagaaataaaagggaaggtaggacacaccctaatagctttcattccttcctcacgcattataagctgaagatagtgttagcagaaggtgcgtgtatcaataaatgaaataaaaacagttgagttttctgcagcctttccactgtttttgtttttgagacagagtctcgctctgtcgcccatgctagagtgcagtggtgtgacctcagctcactgcaacctctgcctcccgggttcaagcaattctcctgcctcagcctcccgagtagctgggactacaggcacatgccactatgcccagctaatttttgtattttcagtagagacggggtctcaccatattggtcaggctgatctcaaactcttcacctcaggtgatctacccaccttgacctcccaaagtactgggattacaggcctgagccaccacaccaggccctttccaccattttggtaaaataaaatacatatatacatatgagccaagaaatactaattgccatgtgaggcaattttccatgtgagaaggttgcagagggaggttttaagggactttctaaggagtgatagaacacaagccagtttggctccaaagacagtgcttattccacggcatcacactccctcctgttgtaggggctggaggaggacttgttgactaatggtgtgaaggttaattggtgtccccagacacaggcagccactgtgggctgggaggtagtcggtcagttcagcaccggcaggtggctctagcagctgctggcactgccatgagggtcttcccgataatgagacgtggaaagggatgggacaggagctgagccgtccagctgggtggcagggtcctggggccaggatgtgcagctacactgcagggcccaaaacccagccagtgcacagtgacacaggcagcattccacctcagaggctggacaggcaatgggggaggaccaggggatgggaacttacttgagagctgttgtggtttgaatgtttttgatgttccgaatgtgtttgaatgtttgtgatgaaatttgagttttgttgaatctgtggatacagaggacctactgtgtacaaggcagtgtttgaggatggagccttagaatgtcagcacagccaaatttggggaccattgacacacattgccttcccaggtgatgaaaatgaccttgactcactcaagcagactcagaaagctggagaattgggaataaattcaggagtaaccttgggaatttataatatgcctaacaataataggtaacacttagatgtattgtgtatctggcacagtctgatgctgggctctttacacacatcatagaggagtctccaacccaccctgagatgggcctgtggttatttgcatttcgcaggggaggcagcgagtttaaagtgtggcaacttccaaggcccaggcccatgatggagatgaaattccactccagcctgagtttggagctgcattcttcaccgccatgctttcctgccccgagtgttggcctcaccgagaggaggtgtgtgtgtcgggggggagtgggctgggacacgtggtcatgggggcccacagagccagatgccgggggaaccaggcaccctcaggagccatcacggctatcgctgcatgatgccggtgaacccctcgggacttggcctggttttcgacctcttggcagccccgagtgttcccaggctgtgaaaatccccccaggtgcagtggctggcctggtctccgagggaaaggagccgtggagctcgcaggtggaaggctagagagagtaagtgatacggttaggctttgcgtccccacccaaatctcatcttgaattgtaatctccatcatccctacgtgtcaagggagagaccaggtggaggtagttgaatcatggggtggtttcccccatgctgttctcgtgatagtgagtgagttctcacaagatccgatggtattataaagggctcttcccctttcgctcggcacgtcttcctgctgctttgtgaaggaggtgttttgtgaccctttcgccatgattgtaaatttcctgaggccttcccagccatgctgaactgtgagtcagttaaacctctttcctttataaattgcccggtcacaggcagttatttatagcagtacaaaaacggactaatacaggaagaaagctggggctgctagggagaagttaagaccaagagtgagccacggggtgtcacttgtgggggactgtcgagttggtgatttgcacccctttgtgccagccaggcccagcatctgcctagcagagccccagggaccggcttgccttgtgcagcagctaacctcacccactcagggcacatggcagcctccttgccagctgggcttcccccttcccctccccagggcaggctcatccgagtgagtgagagcagtgagtccgtgggcatcgcccggaaccagctccagtttctaaggagagtagagcttttgcgctgctgggagctggatgatgagtggcgagaactggcctggcagcgcagctcacacccatctcggggcgggggtcttctcccttcattcctggttgtcatgaccctgagcttcagagtttctgtgtcaaggcgaagcaggagggcagagtgaggtgactgggttctgtgcccaggtcttgtgggaagatcttagggaggtttatcttcccacctggccctttgcaaggtccgggtggaggtgaggcgtgtttgctaaacatgatgtagcgcaaggaggctcaggtgggctcgatggaggaggcggggttcagctagatttcgagggggaggcggaaggcggccaggtggggaggggcattctaagtgcgtgcttcccacattgggggtgcagggttgtgtttgctttggcgcatgtgaagccacaggatgaccgtggagttggcatttcctttcatcctgtgtcctccatgtattcattccttcacccagcagacagcgtgctgggtgctactgagtgctgggaacacagtggggactgggacagatgtcgtccctgccctagtggcacttacactgaaacaggtggagacatctgtttggcaaatatttttaaacacttaaaaatacaaatacaaacatggattttattgaacagaatgcagaatccacatatattagcaagtaaaatgagaagcttcctccccaggcactttcgtggggaagtttaagagctctcaaaataggggctacagcatgtgccgaggtcaggaggccagttggtgacatgctgaggacgtcagcttggctaaagcagatggtttacctcaggcagctgtgggggcggggtttagattcaagttcatggtaaagcccagagtatataggaccctgaatgccagaatgaagattttgaactcttggacaattggcagctattgaggtgttttgagcagaaggtggtacttgcaaaaatattattttggaagattaatgtgttccagggtggattggcaggaccagggagatgagtctgtccccagccctgtgggaagtaagggtgtgagccaggtggtggcagcaagagtgaggaaaaaggagacccagaggcttttacctggaaagaccagctgggatgaaggacctgctggaggcacagaaaggagctcagtgagagagagcaggctggcgctggttcaggcgttcagccaatgttactgaggacctgcgccgtgttgggtgctgtgttcctagctggggcgtagtgttggcagaagtgagacctgtggatcagggctggttaggggagaccatgacaagcttgggtgttcacattgactttagcgttttccactcctggtcccgccataaggtctcctggaaacttttcagcaataccagtgtctgggcctctggttccacttttgtggactctgcctgggcataactccccaggtgattctaaggcacagccaaagttgggatctgctgagtgagggtgaagtgagcacctgcaggtggtgctcatcaagacagtggaggctgaggaactggaatttaggagaggtgatagttcaccagggccttgaacttgaattttggaatttggaagtctctgtcatgtgactaagagagtgcattgagaggcctggtccatgacctgccatggtccttccagaccagagtctctcaggacaagaagaaggaaaattggaaaggactttaaatctgaattgaaaaccagggaactgaattaaacgcaggagacatgaagcagcatcaacaggtggaaagcaccgccgtgggtggagctttgaatgtgtgggagacatgctggtcagaagggaaaaaagatggtaaaagggtacctaactcagggtgagggtgaaccagggatcagaagactgttagaaaatgagggctgggcgctgtggctcacacctgtaatcccagcactttgggaggccaaggcgggcagatcacttgaggtcaggagttcaagaccagccaggccaacgtggcaaaaccctgtctctactaaaaatacaaaaattagccgggcgtggtggcgggcacctgtaaatcccagatactcgggaggctgaggcagaagaatcgcttgaacctgggaggcggaggttgcagtgagctgagattgcaccactgcacttcagcctgggtgacagagtgagactccgtctcaaaaaaaaaaaaaaaaaaaaaagattattagaaaataaagacaataaatgcatagaagaaaaataggggataggcataggaagatggcctaaggcagcagcatgagagtttggtttaaagacccaggaaggctggaagctctttgccttgttttcatatctactactccaccttgaacagtgattctgtagaagagaatcacctggaggagggcacagatgcagatgccggggattctgtgggctaggaccctggaatctcccattttaaccagctccctttgggacgctggtgcacctggcccagaaacactgaactggaaaaacagcaactcaggaacaacgccagaagggttgcatcagaaccagtgactggaaaaaaaaaatgctgaatgtccctgggaaggctgtgagaggctgtagggaagagggaattgctgagaaacccctagaaggactaaaggggagaaaaaagatgtatcaaatccccaggagaaagctgtgattcaggagagcagatgatgtgggtttttgttgcagacggtgtgcaaaaagttttactctcaaaatgtcattttctgaattgaaaggtaggaagttttggaatccaaagagtttgctgtgttccatggccacaaacacaagagaataagggcttggtgtttctgtgtcatcagtgatctgttcccttcaagtttttacattttaagtttgtgtgatgatctatctggattcctaaatatcttctgtctccagattatacacttgtcttcctccgagctggtacatttgctttcaagttcatctaaagttagtttcagaaagtcaggtgatctgtgtgataaatgtacccagtgttgcttataggtaagaaagcatgagcaaaagcatggagccctttcattcctgcctcacttagtattggccgtcagttagaaattggtttcaattttctttatcgtccagaatctatatgcttaaatatatgtgaaagctctgtgttttcagaacatgtgaaaactccaactgagtgtggccagcccaagctttccttcctcatgggggcctttgctgacttctcccctctccctcagaatcaagctgcacatcctctgttcactgctagcttctttttttattttttttgagacagagtctctctgtgtcgcccaggctggagggcagtggtgagatctcagctcactgcaacctccgactcccgggttcaagcgattcttctgcctcagcttcccaagtagctgggactacaggtgcccgccaccatgcccagctaatttttatatttttagtagagacggggtttcactatattggccaggctagtcttgaactcctgacctcgtgatctgcccgcctctgcctcccaaagtgttgggattacaggcttgagccaccgcgcctggccctttttttgagacagggtctcactccatcatccaggctggagtgcagtggtgtgatctcggctcactgcaacctctgcctcccgggctcaagcagttcttgtgcctcagcctcccaaataacttgggactacaggcatgtgccaccatatacccagctaatttttgtatttttagtagagacggggtttcaccaagttgcccaggctggtctcgaactcctgacctcaggcgatccacccgcctcggcctcccaaagtgctggaattacaggcatgagccacggtgcccggccactgctagcttctttactgccagtagagtcagctccttgaggtaattttataatctccagggcccagtatggggtccgccactcaccagagtattcaatagagttgaactgaccactttgtaaaaagacatgagaccaaacatgattcggctttaaaacggacttctttaaatagaattggaattatttggcctagagaaagagaccaaggtgactaaataatgaggtcacatcaataagagaagacaggaaatgctgtgagcagatgtttgtgtgtctagtgaagcagcaagagcagtgggagcttttgaggagttttgtggttctcagtcatctggagtaacagatccttaggagaatctgacaagagcaatggacttgcttcccagagacgggccaagtgtgatttctgccctactttaagggctcaccaactcctccaaagcctagtccaagtgagtaatccctgggttaggataagatgctacatttgagctgtccattcttgcatggaaatggggaggttgaccagatggccttctctggttttgaccatctacacccctgaaacgtgggccttctgggtgggtgcattgatcaggctgttgtgtctttatgttcagtaagtatcaggagcattctcctcttagcccacaaactctacaattgacataaaaataaatctacttgttcacaccattgcttcagagttcattattctctggtagaaaaggtcaagaaaaagttcattgtgaacactcaggaatcaaaaaggaagaaggcgttgttccaggccagggtttcttgacgttggctccgttgacatttggggctggatggttctttgtggtgggggctgccctgtgcagtgtaggatgttcagcagcatccctggcctccgcccactagaggccagtagcacccgctctcctagtcgtgactgtcaaaacgtctccagacacactgtggaatggcctcggtggtgggctgatcacctgtggttgagaaccacttctctgtttatcttcattttggctctcttatcaagggggaacacttcagtggagaatgaactgttctttcagcttctttttaccactgtagctgttcacacagctcacgtttgctatgttccaatagctgtgcaaggccctggggctacaaatgtaagtgacacccatgatctcaggtacttactgcatcctcttgggagatacacacagacgcatcaggagctgcactgagggaaggctgtgcctcatgctgtaggggggtctcctttgcactgctagtgtcttctccacccagaatgcccatccttctggcctctcccgtggctggatcttgcttggcattcacttctcagttgaaatgacactgcttccgagagacctgtcctaacgtcggtgccagctgttttcacctaatgctgcataacagcccagaactcggtggctcatgccaggcattcctcacttgcacatctgtgggttggctggggtggggctgatctgggctgggctcggatggctttggctctaagctgcagcttgggatcagttctgctgtatcagtttattgttctgttgtaccagtgaggttcttagtgtgtggtgttctggtgacgggagaagcacaaaacaaaaagccagccctcatgggcatttcagaatgtgctgcttttatagatgctgaagtctttttggccaaagcaaatcacgtggtcaaagccagcaggaaggaaggagactttttttttttttttgaggtggagtctcactctattgcccaggctggagtgcagtggtgctatcttggctcactgcaacctccgcctcccgggttcaagcgattctcctgcctcagcctcccgaatagctgggattacaggtgcctgccacaacacccagctaatttttgtacttttagtagagatgagtttcgccacattggccaggctggtctcgaactcctgacctcaggtgatccacccgccttggcctcccaaagtgctgagattacaggcgtgagccaccatgcccagctggaaggagactttatactctgcaaggatgtggctgtgtgatgcttttgcgggggagtgaagaactagggccagctgtcttcctcagacctcatctaaagcagctacctagtcactttctaccacttttattctcttttgagctctgatatgcttacatttgaaatattatttctgctaagagcttgacaagggtaaggtcacagactcgtcataacatgtggacctccacaggcagcagaggcaggctgttttggttggagccttggatccctgaaatagcacatcttatagggaggactggagagaggcccattgtgattggagggaggggagcctgttgaggagcaaccagagtcaagacagtagagcctggggccaaggccgccatgttccgtgtctggggaagccatcacgacagatctgtgtagtggcacccctggcagtgcgcaacctgagaagctgctctagctgcctggcagatcatgagggacctggcctaacatgtcagatgggctggatgcctattctggaagtcctctttgttttggaagagggtagactttgaacatctcttaccaaaggcatgcacaagttataagcagaaagcttctggaggcccctttgttttgaggcacatggtggaaacttggcagatacccagctcggaagggcatggcagcagcaccccaggcttgagcctcgtgttgtattgattaaggttgcatttattggagatctcagagtctctcttggtgcagcgatgcttagaatttgcccaaggcagcatgggagagtcactcactgtctgcagaccttatgactcctccttcccacctgcccagatgttccaggtcctaactggatccttagctcttggggagccccctgtgccgcggctgtagccccgccttggcagacacccatcacagttcagctaaggtgatcgtattgagggaggggagccctggccccggggtaagggggtctgggttccggtctcagcgctgctgggagactaggggctcggaagcttatttctctgactttaagtctcttgcaaaatgagaataagaaaactctgccctgcctcctcttgttgtgagaaacaaatagaatgatgaacatgaagattcttgtaaaacgtcctcaaagtgttattattagttactaatttgccttcaatggaagcaaagaaaaagtcatgaaaggggtattttgtgccaagccctgtgtgaggtatgtgcagtctttcagtcttttttttttttttttttttttttgagacagagtctcgctctgtcgcccaggctgcagtgcagtggcgcaatctcggctcactgcaagctccgcctcccgggttcatgccgttctcctgcctcagcctcctgcccaccacgcctggctaactttttgcatttttttttagtagagacgggatttcaccatgttagccaggatggtctcgatttcctgaccttgtgatctgcccacatcggcctcccaaagtgctgggattacaggcatgagccaccgcgcccggcccagtctttcagtcttactggaacagcctgtggggttactgcaagggtgaggagccatgtcagagaggcaggcgacttgctccagggcacacagcctgcgggcagccgtgtgcaggtctatgtgactgcgaggcctgacctcttcccgcccctccatctgccagttgttgcctatggctttctatgtgccagtcccgggtgctggggagccagcagggaaacaacccgtgtcccggctgcatggagtttgctttccaggcgacgaggcgaaggagtgaggacagagaagggcaagtgcagaacattctgtgctgggcctcaaagcaggactggagaatgagtaggggtgggcagggaaggcctctgaggggtagggacatttcatagggacttaaggagccactgcagcagcctctacaggcgtctgcagcgagagtggccccagaagtgggacccatctgtgctgagtggcggcctcacaggctctggctgggcctccttgggtgggagaaggctggttgcctttggaggggccacctcccctcctccttcctgccccatggctgctaggagactttttcctaaagcatctgagtaagttttaatgacgagtttcccgtgcggctggcctccagccgcagaacgtcataggtctctgtgggcgacacggacactgcaccctgagcagctttctcttgctcagcttcttctccacagttccagagtgttctggaaccttcaggctggaatgagcttataggaagagattggtttgggcaagagagccaccaaaccgcctccagtggggtgacttccactcgacagtcccacttagagcagccccatttccctacgggttgttagcaaacgtgaaggatcttgcgatgcgtaaacttccaggagggaggattttgtaaaggaatgttctcatggttgcgttctgagccgggatattagaaacactttatcaggctgtcatgggttagatgacactttagtccaagtgtttatccatttgggagatgcattttattattctaaaaatgttgtatattttaaaaaagcagaacaattcttttgaaataagttatttccaggaaaactttaggattaagaaacttgtaaaaagatctataaatagagaccccaggggctgtggacctctgtcaccacagagcctgatcgtgctgtgcagtctaaaggggaccacggggcaagaagaggtgactttggtggtgtccagagcaggcttctcaacctcatgggtttggtgagtcaccccaggacccgggactgggcagtgcagtcagctcccaggtacagctgttgcccttgggcccagaagtaaggcttcgagcgccagctgtctcgccccaggccaaggagcctcttccctctctgtctggtggtcagatggtgcctgtgtgtgtgcagaacactttgagcgggagccctgggaataagttgctcttcatgattccagagagggaggagtctcctgtgtgccactcacccagtgtggtgtctgagctcgtcttcgtgtttcagagagacccccatctttctttaatgctcacgtcttcgtgaagccatcctcagcatcaccctgattggatgtgatctccccaactgttcacacctctcctcctgcctgttggtctgctctgtctgatgttctagatcactcccaaaatgtaccctgtccgctgtcctcaggggagcgaccgagccttgttcctctttgttcttcaggcgggggtggactggggtaggtaggggatgctcactggaaggctagaagcagcaaagctgggtcccaggaaggatctagggccagaaggtcatgtttactgatggcttctgctcagctcgcctgctgaccagaggctgaaggggggaggggtgggtggtgagtctgtgagtgtagagtcgtaacccacatctgtgccacccaacagcgtgaggcttcctgggcacctagggctggatggggccaggatgggctgaggacacagatgtgaggacagtgcccaccttcccgcacacagtggcagggccatgtgtgggggacatgggggaggaggaggggctgccttgggtgcagcagtacaagtgatggagcagatgggaggtctctgcagggctcccaggtggacaggagcctgccaagtgggccaggttgggtagaatgggatgaggggtttgcaaagtggtgggtgtggggaagggccaccctggagggagaagagttctaaaaaggaaggtcacttctcactcgtaccttggagtgggaacaccggaaaattaatcccagatcagcagagctcaaggcctggtgcagagaaacccatgtgtcatggtgacgtgaaagacctatttcagattctcgctagggttcaagttttccccagaggcagaattttttcctgggtcttcagttcttcacctgtaatgagaggcgatcctgatggatgcattttagaggaacggcagctgccctgcttacccagcatcaagttcttcctgcggccacacctgcctggccctggggacagggacgatgtcacgccaccgtccctcctagggccagctcagggccctgctcatgctgaaagagtgaaacttactttttacagacatattttgaggggcacattcattttgctaagtgagatacacatttatgaatatgaaacaggaaatttctgaatcttattagcttagagataatggccaccactgtgtatggaagctgtggaaatgataatggccaccactgtgtatggaggctgtggaaaatctgcaagtattgtttcagatttaaaatgcgtgcagctcacacctaagtgctatagggctagtatcttcgtgactatctaaatttcagttttaaaaatctctaggccaggtatggtggctcatgcctgtagtcccattgttttgggcaactgaggcaggaggatcacctgagcccaggagttcaagactagcctgggcaatatagcaagaccccatctctacaaagaataaaattagctgggacaagtgatgtgcacctgtcatcccagctactcaagaggctgaggtgggaggttcgcttgagctcaggagtttgaggctgtggtgagccctgaatgtgccactgcagtgcagcctgggcaacagagtgagaccctgtctctatctgcaccaccgcccccctcccaaaaagaagtccacactcctttctgggaaaagatggggttgtgaaatatgtaaataagttgaggagtgctttagggaggggttttgaaccatagaataatgagatttgaatgctggaggagatctcaccctctagttttaacaccttgtttaatttaatctcaattccttctgtaaaaccagagtgacatcacctgcctcagcactggttgtaaagttagaggagatgaggctgataaagtgcgtgcttgtgtctaggacttaatgttgtgatgctgaggtgaggatacaggtgaggaaactgaggccgggagggggactccccacccaggctgcacgtcagtgttgcctgggagcactgctgccaccctcgcctcccgtcgctgcgtgagcaccccagggtgctgccaccttcccaggtgaccctgtcgggagcctctcccaccacaagcgcagctcctgcggctcactctggaatcatctctctcaaagctggctcctgcttctgccttgaggttttctgggcttggcagcatcacccagtgggatttgtggcctggccctggaggctgtgagttggcctgtagggttgtggctgagcctcccatcagctacacccacggggggtggggtgggggaggttgggggttgccaagctccctgcaggccttgtagccacgactttgtgggagagagggaccatagggatggaacagggggcagcgccccagggggtcctcctcctcagttgaggcaagttgagagaattgggggtgctttaggaaacccaagacctggcattcacagaattttctagaatcagctcactggcaggcagggagggagttccctggtagggatggacaaccttgcctggccatctcatagggacagatgggacaggctctatcgagtgaacagcactgagcttgtgcaaggagttactgtcattaccccctcggttgtctacctaagacctgctgtgcagcccaccagaacaactgtctcagaaaaacttcacaccaatcaccaaagattatgaccccaggctggaagcagggtcaggcttggctcatgcctggtgacctcctatgtaggacagtatttctttcattgatctgcaagtttttaaaaataaaatctgctttttcactgcacttgtaggtacatacaatatggggacataaattcggggggaaccctggactctgatcctgcccctcaccggctgggcaattttccaggtccaaccactactctgagctccagtttcaccggtgagctgagaatcagctcccctcaaagctccctccagccctgacactgtctggtctttgtccgcctcacttccaaggggaaaagcaaggccagaagaagacctggcccacagaagcccagccgggaaggaggctggagggaaggagaggtggccagctcccaggttggccagagagttaggctggctccagtcccggagcctcccccaagtcacagaggcctccccttcccaacctgcactcacagttcccttctggccccaataaggctggccattcaggtgttgactgggtggcctgaggacatatggtactgaccactcagacaggggtgggttgtcctgccccaacagacttgccccacaaacggggtaggcgactggggctgctcagacccaagaggtcaacaggtcattacaagctggaaccagacgccagcagagcttgggaatctacacccggtgacttgctgaccagcactgagactcgcctgacctcctgattcgtcacgcaacgggcccttgttgagtgccacagaggctgcaggaacattctgccgggtgtggtggtggttgatcctcagggcaagtgttgatcagctctgatgaaacacaacacagttcagggaatatggcataaccaagagaacccagaaaattcatgtgagaaccagcttcccttgttgtctgttagaccatcttgtttaaaaataaaaaattgacttccctgcctttttcacctaccccagaatacagtctactctgaggccaatcttttatcccctgagggccagaaattgagaaattcttccgcttctcttcccatctcatttctcaactccaaactcggttccgagaaaccacacctagcaggcgaggcgtcggggatccagggctgggagggtggccacagcctcgggggaagggcatggagctggcgccagggaagctggaggagccagaccaggaaagaggccttgcttgaaaaggcttactgaggccagtggtcttggaggaggaggaaggattagcacttggtccagccatgttggggcccaggcatggccaaagattggagtagcagcagccaggcctggccgccaggcagggttgggatgttcagatctgtatccaaggttaccccagcaggagaccatcagatctgcagtccctacagcctgtggaagtgggccaggacacctggggcatcttcagggtgccagggatggggaataggcacttgatgccccagaagccctttgagccggggtactgaccttgcaggcagtgggggagacctcaagtcccaggacacccccacaatagcttgagacctgagtattggtactgggcacccctcacctgctggcaggtggggttagctgagaggatacctgtgaatcccagaaaactagaaacctatgacacatgtgtaaggtaaacattgtgactgccgaatcagcctgagacctcttcaggggtcctgccgcatcccaagccatctgagcttttaggattacacagtcctgctcagtgggacctgggatttgtgcaccctccttaccaacaaattggcagagcacctgagtgagtgctgcttgagcaaatgcgtgaaggaatgaatgggtggcagagggtctgctcaggcgtcacaggtggagggactggccagccttgctttgttgggaagccggaggggggatccacagcccctcagccaggcttgaacgcctgcaccctgcccctcgtggaacccttgagcctttcaggccttgagccatgcccctgggtggaccacccatccgtggtacatgtggtggtgtctgaggctctggggtccaaggctgtgctgggcccctccctggacattgggcaacttgaggtttgattttggtcaccacccaccccacctcctccatccccttctccatccccttttctgaagacgtgccttcacccctggccttttctctcttcttccttggggtgcagatcctggccaacgtcttcctctacctgtgcgccatcgctgtgggcatcatgtcctactacatggctgaccgcaagcaccgcaaggccttcctggaggcccgccagtcgctggaggtgaagatgaacctggaagagcagagccagcagcaggtgaggctctcgggaggcctcgggcctggagcttgggctcagggactgtggccttgtcagagggagaggaaccagagcggcagcccctggctccgtggggcttggcgttcatccaccctgttcaggtgtttgcttctgaactttgtcttctgggctcctcactattagagggcagcttctgagcttcagggagcctctcactcctaaatctgcttctgcttgacccagatctctcctcttctgccttcctgctctttgttttgttttcgtaatgtaaaacttttccctttcaagaaatgcattgcccaagcagccagctatgacttcctgcattcctttctcagatgaccttctcgggaccaaggtcagggtcaggggcatcacgggcattccttcacgtcacgcctccaccaccactcttgctggtccaaccgcagatccaccctgtgcacctgctcatgccgtgggtggggccttgacccatcctgcggcctcagggccctgctgggtgaagtgtgtcagcctcacacccccactcaggggagctcctccctcccttaccttcccatctgaggtcactgctgaagaaggaaaaccagcctgttccccggggatgcccttgtttacattctccatctggagagaggcctcgctgtccctgcctcggtttcctggctttcctccagtctcttccatggccgcaccatcctcccagttctcatgtcactcaggcttgtacatagttttggcctggattaatctcacatgctttttgaaggtctccagaaattacacccaccaatttcctgttatccatagggttatttccccttcaaaaacaaactcaataggttgacactatgattctctgctctgggaaccatgtcatctgtgttcaggaggttctgtgtgctcctgattcactgaaattgctgttttcatagatgctgccactcgggtggacagggccttggtttcgggggccactccggagcccttggcttgcaggagccccaccgtcgggcctcactcacattctctagacagtgctgttccgaggcacacactaagtcatttagctgatgggcctccgattccactgtcctggggatgttttcttcctccccgtttaccaatctcattccttacagaaggcccccataggaggggattttccctggctgccattgtgacaaaggtccaggcttagtagcccatcgtattcgccccttcccctgggccctgtgacctgtggttattgaggagctgctgtggcctgtgtatatttaaagaatcctcctttcctggcttgtaaagccccttgaaaggcattcttcaactctgtttttttttaatactgtctcatttcttgtttgtatctgatctcgcactgtggaggcatccctctgggttctctgcacttaaaaaaaaaaaatgcatgtgtcaccgcctagctaggcgagcattctttttatataacatttgcgcagttttcagcatgtctgtctgcattgatcttgtctgtctcatattgtacaatctaggacatcttaactcacactgaaccgtcttgtggaggccccctggtgtgatgaggaaggccctgtgtttcaccctggggctgttctcgtgtagataatttagataagttatccaccctacagagcctcacttttcctcatctgcaaagtggaggtattgacatttgtcttgtaggtttcttgagggtcaaatgagaaacccagaagtgctttgtaacccatagagcttttttagaggtaggccgagtgcacggggccatgaggcctgctttctaacacccagggccatatgcttcctctgggcagggtcagtgcagggagcctgggcaccagcagagagggtcatccctgggtgccccagggctcctgagggtgctagcagcctgcccgggccacagtggtgcttctctgcattgcctgcccacgctgcagcggcagagcagacattggccccaggatggagaggtccaggttaggtggaagggaggtgcagaggtgtggggggagttgaggggtaaggtgcatcctcaggcctagctgggcacacagccggagcctagaattctccaagtgggatgaatttgtctagccaggctctgtcctgagtgtggccttgggctcgttgctgcccctctttggacttcagtatccccatatgtaaaacttttgagagatttttttttctttctttttttttttttttttgacatggagtcttggtcttgtcacccaggctagagtgcaatggcacaatctcggctcactgcaacctccgtctcccgggttcaagcgattctcctgcctcagcttcccaagtagctgggattacaagcacctgccaccacacctggctaattttttttttttttatatttttagtggagacggggtttcaccatgttggccaggctggtctcaaaactcctgacctcaggtgatccacccgcctcggcttcccaaagtgctggggttacaggcatgagccaccgtgacctgctgagagattgttttaagggtaagaaggaatctatgtgaatcccactgggattggtaaagcactgttaccattgggaaggatggaatcctgccccctgtgagtttccatttacctacattctccttacgtcttctgtctctgttcaagagagaaacctgcctgccattttccttcctttccatgtgcttgacaggttttggtattacggttatgcccaactcattaaataatttgagaagtttctaacccctgatagtttgaagataatttgggttattccttaaatttggaagtcacagccaggcatgtggctggcctgtaggtgtggccaggcaggtggctatgcctgtaatatcagcactttgggagattgagacaggaggatcacttgggtccaggagttcaagaccagcctgagcaacaaagcgagaccccatctctacaaaaaattaaaaaattagctgagtgtggtggtgcatgcctgtagtcccagctacttgggaggctgaggtgggaggatcgcttgagcccaggaggttgaggctgcagtgagccatgattgtgccactgcactccagcttgggcaacaaagtgagatcctggctttaaaaataaaaaaataaaaataaaaaaggccctaatgaagaagtcctataggcctggagtgttctttaggggaagattctgtttccgtcatagataataaggttgttcagattttatatttccttttatataggttttagagaggtttttttcccccagaaacatgtccattcaaattttcaaaattttggcataatattcttaatattttctttttatcttttgtctgaaatgggtaatgatgttcctttttttcattactgaagataatttgtgcctttttaaaatttttcttaatcagtcttgctaaggcttattgttttagcctgttcagcagaccaccgttaatctttgttgctttctttgtacatttcttatctctgatttatttatttattttgagacggagtctggctctgtcacttaggctggagtgcagtggcgcgatctaggctcactgcaagctctgcctcccgggttcacgccattctccagcctcagcctcccgagtagctgggactacaggtgcctgccaccatgcccggctaatttttttgtattttttttttttagtagaggtggggtttcaccatgttagccaggatggtctccatctcctgaccttgtgatctgcctgcctcagtctcccaaagtgctgggattacaggcgtgagccaccgcgcccagcctcttatctctaagttaaactttgtcattgcctcttttttctttgggcttaatttgtgtccttttttaccttcttaaaatggaactttattgttgttttttggagactgaatcttgctctgttacccaggctggagttcagtggcgcagtctaggctcactgcaacctctacctcctgagttcaaggtatcctcttgcctcagcctccgagtagctgggaacacgcccggctaattttttgtatttgtagtaaagacagggtttcaccacgttggtcaggctggtctcgaaacctcggcctcccaaagtgttgggattacaggcgtgagcccccaggtccagccaaaatagaacttcagatgaccgattttcagcctttctttcctaaaacatgcatttaatgctacagatctcactcattacattgtttgagctttatctcacaagttttaatatgccatattttcagtgtcgtttaatttaaaatatttactaattttcattgaaatgcctttgatccatgggcgacgtagaagtgcactaagttctaaacatttgaggatttgtttacaattatgttgttttttatctttattctggtcagagaacatactctaatttcaagtctttgaaatttcttggaacttgatttttggcctagcatgtggtcagttttgatgcacttgagaataatgtatattctgccaaatctgtcaaaatctttaaaaaatgaaataatgtcaactatgtcatatttgcatctgccccaaattagtacttacctctttagtcatgatgcaaggacctcacaaccttttaacttcatttcacaagcctctgccccccactttctgcttattagtataatgtgttttagttcaacatattttaaaccccacaagtccttattgtgattattttatgtaatattcttattaatattctttacttatatttacccacagttttgccctctcaattgctcttcctttctccatttctttgcttcattttcttgaagaattccctttagtattaccttttatgctgatctcttggtaccaaattctctccatttctgattacctaggagtgtgcttattttgctttcattttcgaaagatacctgtcttcatccgttttgtgctgctacaacagaatacctgaaactgggtaatttataaagaacagaaatttactacttacagttctagaggccgggaagtccaagatcaaggcaccagcatttgctctggtgtccatacatggcagaagggtgggctagctgaatgttatgtgatgccccttttaaaagagccttaaccctcatggcctgatcccctcttaaaggccccacctcttaatagtattacattggcagcacctgaattttgaacagacacattcaaatcatgccaagactttttgcagataattctaggctgccattttttacttctagccctttaaaagcatttcactatccttcccgcttccttcattcctgttgaaatgccagttgtcagatagactgttgctcccgttacattaatgcatactttttcctgtggttgctttcccaatgctctttgtttttggttctcagcagttttacgatgctgcgcctgggagttttctttgcagttgctctgcttggtattcaaagagcttcttgaatgttggtttgacatctctcgtcagttttgaacattttcagccagtatctttttattgcttcttcccattcgctcctttcctctaggactcaatatccttgttagacatttttaccatgttccagaagtatctctcttctttttctgaatctttttttctttttgcacttcagacaatgttttgatgggcctaatctacagtttactaatcctgtcttcctctggtttgtcagatcagtggttgagctcttttattgagtcatcaatttcaattatatatttttctgtcctagaatttccatttgattttaaaaactggacttaggtccctaacgatgtattcctattttgtcatctattttttagaatatattaaacatttattttaaagttcctgactgacaaccataataataccaatgggtatgcatttttttgttgttgaaacctggcatcttggcctttttttttttctttttttttttttttttttttgagacagggtcttgctttgtcactcaggctggagtgcagtggcttatgcatcttcgagttcctgggctcaagcaaaactcccaccccagccttttgagtagctaggactgcaggcgtgtgccaccatgcccagctaattaaaaaaatggttttttgtagagatggagtctcactgtgttgcccaaactggtctcaaactcctggcctcaagcaatcctcccactttagccacctggcatttttaaaaattaaatactagatattgtggatgggaaatagtagtgcttctgaataatgttgtgtctctccagggaagatttacttttcttgtggcagatggttagagcaggggcagataggaaatagcttctcaggggtcttacctgaaaggctggtgcttttctcatggtatcttgaactcctcagcaatgtgaggctactgaaagcttagcctcttagtctcactttctgcttggattcttggtctcttgccccatgcaaatactaaagggtaatagtgtacagaaagtcagactcactgttgtatggttctctttccccggggtcttagcccctctactctctctgccttggaatccttgctcacagtccttgtttctccagccccttgaaagccctcatcattgctctctctccagcctctcgaccctggtcgcaagggaaaagtggtggagtgcattgggctcacttaaatgtgtttcccttcccctgagatcttggcccctcaaatcctggctgctttggttgtttccattgcctttaaagagctaggttctttttatgtattttatccagcttttatagttgttcttggctggagggttggcctgctataagatcctctatagcaaacgtatacatgtataaaatcgtaaaagtatgaaaaagggtatactaggaaaagtaagtcatcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacagagtctcactctgttgctgaggctagagtgcagtggtacaatttcgactcacaacttccgcctcctgggtttaagcgattctcctacctcagcctcccaagtagctgggactataggcatgcaccaccacgcctgcctaatttgtgtatttttagtagagatggggtttcaccacgttggccaggctggtcttgaactccttacctaaagtgatctgcccgcctcggcctcccaaaatgctgggattacaggcactagatcttttcacctactatcttagagagcattctaagtctgtattgcattgccacaaccttcttaatgactgtgttcagtcattatacaaaagtaacaatttattttgttgcgctctccatagatttctaggttatttccaatcttttgctactgtaaacattgctgtaataaatatccttgtagcggtatttattatatcatagtatatatgtgcaagtgtatctgtggaagaataaaaacctagaagtggaattgctggatcaaaggacatttgcattttaaaaattatatatatagctactgtaaaatatacatagtataaaatttaccattttaatcattaagtatacaattcagtggcattaagtgcattcacaatgtcgtgcagccatcaccactgtccgtttccagaactttttcatcatcccaaagagaaactctgtgcccattaaacaataactgcccattctcccagactctggtaaccactgttctactgtgtctctgaatttgcctctactaggtcctttatataagcggaatcatgtatttgtccctttttgactggcttatttcacttagcatgatgtcttcaaggttcttctgtgtcgtcgggcagatcagcatttctttcccgttaaggctgatatctccttgcatgtatacaccacgttttgtttgttcatttggacatttgggtgttttctgcggctttgctattgggaatggtgctgctgtgaacacgggtgtacagatatctgtttgagtccctgttttcagttcttttggatatatacccaaaagtggaattgccaggtcatatggtagttctgtgtttaattttttgaggaatctggaatgtgctttttttgttttgttttgtttttttgagacagagtcttgctctgtcgcccaggttggaatgcagtggtgcgatctcagctcactgcagcttccgcctccgggttcaagctattctcctgcttcagcgtcccgagtagctgggattacaggtgcccaccaccactcccagctaatttttcttgtatttttagtagagacggggtttcaccatgttagacaggctagtctcgaactcctgactctggtgatccgcctgcctggcctcccaaagtgctgggattacaggcatgagccaccacgtccggcctcctatagagcttcaaacaatttatactccaccagcaatgagtgagagtatacttaggcacttaagttttccttgtttatctagaaaatacctcattgcttttggaaaccctccccaaaggattcctatttgaaaaccccagccccagggaaccagcctcaaggcaggagtgacatcctgtgggctgtttcctgccttatcctcatttggctcaagccacagacagataaactcaagtttggaagagttcctttgctttcttggcctacactgtgtaatatttggcaagaatatacaattataaagaaataaaaaagaggttggcatagtggctcaacgcctgtaatcctaacactttaggaggttgaggcaggaggattgcttgaggccaagagctcaagaccaacctggccaacatagtgagacctccatctctaaaataaaagactgatagaggctgtattagggttctctagagggacagaactaatggaatagatatctatgaaggggagtttattaagttttgactcacatgatcacaaggtcccacaataggccatctgcaggtaagagcaaggagagcctgtccgagttccaacactgaagaacttcaagtccactgttggagagctggatgcatccagcacaggagaaaagtgtaggctgtatggaggctaggccagtctctcttttcacctttttctgcctgtttatattctagcaaactggccactgattagattgtgcccacccagatttagggtgggtctgcctttcccagcccaccgactcaaatgttaaactcctttggcaacaccctcacagacacacccaggatcaatactttgtatccttcaatccaatcaagttgacacttagtattaaccatcacagaggcatattccttcaagccttttttttggtcctgatatttgagagtgtcctagccatgttttatcctgattaagagattataaatgtaacaccttcctctcacatagtatagcagctgagagccaagtaccagagtctctgcccctctcctatggccttaggggagataagtgttaagtagttattgcacagtgcctgcacatagacactcaaactctctaccatcatatgattgttggatacaattttgaagatatagaaaagtagaagaggccaccaaaacctcccttaatctgggactttttttgaaaaataatttttaaaaatgaatatggtattataaattagatatgcagttagaaaaactcaggtttgcttcatttttttttcttttttatagagctaaaatgaaaccccttgaaagtggtttagtacactcaccatgttgtgccaccaccacctctagctagttccgcaacatcttcccccaaaagaaaacttgggacccgagcttgatttttatttgtttttattttttttaattaattaattttttttttttgaggcggagtctcgctctgtccccgaggctggagtgcagtggcacgatctcggctcactgcaagctccgccttccgggttcacgccattctcctgcctcagcctcccgtgtagctgggactacaggtgcccgccaccatgcccggcaaatattttgtatttttagtagagacggggtttcaccgtgttagccaggatggtctcgatctcctgacctcgtgatccgcccacctcagcctcccaaagtgctgggattacaggcgtgagccaccgcgcccggctaccgagattgatttttaaaaccagatagaaagggacctggtgagccctgggacaggccttgcacgtgaggacaagggacccagaccctagcacagtcccacagtcctatgctccagcctcaccttgtggtggatacctgtctgtactgggggttggggagggatgaccccgctggtcatcttggacctggatttgcatccacagcctctgccagcgtttttgggggactgtgagccctggctttctctgtgtggtgttggtactttacctctctggtctttagtttaattttctgaaaatgggattaaaaataataccattgttaggggatagtttgggaatcacatgaaataaggcagaggggagtctaaaaaccatgaagccctttggggctccaagatgccgtcacgctggcccccagcccctggggaggcaccggctgaagtcagggtggtgaggtaggatgggagctggctggggcctgtgcatccttccccttctctcttccagccaggacagaggtcactccctcccaaggcattggggctgacgttgggagtggcgtgggctctgggctgatttgacgtttcagaaacatcagctgacgggtcttcggagctgagtgcaggccggtactagaggctgcatgaccccgtttcactttcctcctgtaaaagctcctcatgagaataaaaatgagataatagatggaaaaacactttggaaagggccgcagacagtcctggtatgagaggaaacagaacctggtttggaagtggctccaaagagccatttgaggtcagtgtcagagcaggccatcccttacttacatgtgtgcttaatgtcttttttaagaaaattctccatttaaaaaaattatgagtgtctcctataaaaacaatcgttaatctaccctctgcaaaaaaggggcctccttccagaattgagtgcccagggtccatgtctcactttttatttggtcaggtgctcttatcttttttttttttttttttgagatggagtctcactctttcgcccaggctggagtgcagtggcacgatcttggctcactacaacctccacctcccaggttcaagcgattctcctgcctgagcctcccgtgtagctgggactacaggtgcccaccaccacacacagctaatttttgtatttctagtacagacggggtttcaccatgttggccaagctggtctcaaactcctgatctcaagtgatctgcctgccttggcctcccaaagtgctgggattgcagtcgtgagccccatgctcggctatttatcttgttttctaagctgccttaagagtgtgcggctgaagggcagccctggccatgtggctgtcccagcaggtgtctcctcgctgggcctcagcttcctcctctgctgtgaagtgaggtgtagggatgcgctggtgacctgagcccgctctctctcttgccatcccctgggaagttgtaccttctgttatgaagatgaccagcctcctaatgacagtcaactcccagatgggtgggcagccagccatggtccaggagggtgaggcggcacagtccctcaagcacaggcatccctttctgcctcctcactggggtgagcatgtccacatgtcaaagggtgcattgaggcaacagagcatttgggtaatggcaagggtctcagattccagtggctttgctgctttaacctccctggctccagtctccttcagggaggtagtggagcctgccctgccctgaggccttgtggatttggagctcttggtgcagccctggcatgcgaagcgtcctctttgcctctgccgaacacatatctggcttcgcaggcagtgccatggcgcttccctgtggtgcggggccgccagggtgcatgctgaccttggtccagcctcccggctctgtgggcatgtgagggtagagcaggaggcccagaggacagaactggagttgtttgtctttattcccatgtgaccacacttcaggggttagttggggaccttgagggttgctaagcaccccagccgccacctggcaacaggcggcacccagaaaacccactcagcacacacctgctgccaggtggagctacaaaactgagcctctctgaatcatactcagaatcacttcccagggatcggaacatggttgacggaggatgtgggaagatggagggatgacaggggcaggcctatgcttccttcacacgcgtcctgtgtggttaactggccctgtgcctggtcctccctcggaggtgaggactgtccacagtgcccaccctcagacaggaggatgctgcagccagggcacgtagagggagagcccagggcagactgcacagggtctagggtagaaagccatccccatcttcacccttgggatcctggggagacagctgaggtggacgctgggtgggtttccattcaggtcttgggggactgcacagagacacagctgcctctccccacctctccttctgctttaacccacttgcagggtcacctgttactagggatggtgtttttccttcaggccggtcttacagggaagaaccgcccattgaccacaagcgtcaggcccctctcctgggagccccggagcttgggacactgggaggctgccatttcctaagcttggattgtatctcttgcttttctgaatgttcttcctctgtaacctttgcccaagcctggtcactgtttccctcaagaccttttgctattaggacaaggtgtcatcaaccctgagccctgttcttataggcgcttggtaggggagaggggagtcagagccagaggccagttgcctcttggcctggggttgggcttctagtgccaagccccaccgtgccactgttatcctggcaacagtgaggtcggggcagggggaccactaagagtgggaagaggagacgaagctggtgtcgagtgggagggctgtgcctctgcctgtggatccatagctgctctgcgtcttgctcgttgcaccgtggctgcatcatggcattctccgcgtctaatgtaatgggtcaaatccattgtctgcttcacaggagacacacagacacgtccccacccccagcatcagccttgcattgtactcgctatcttcttcacagaaccacccacaaagatatctaatatttttagtttttcttttagcctcgaatgcctctcagtgtgagaaaagccaggtgcgttccccataatgcgaagtaggcactggtccttctgttggttccaactctcacctcttggatgtcacagaatgctcttcatttcaacattccaggacttagcaaaacaaatccacatttcagataatgcagatgatgaacccatagaaaacaggttgtcctaaagcagtggtgggttcctggtggcagtgggaggatgttggctgtgtcagggtggacctgagcagagctggtgaggacagtcctgctgacggcccatgcatgggctgtgtggcctctgagctgggctctgctgggctgtggcaggtcttaagcctttgccacatcctccagcagaatttttctccaaacagttgtagaattgctggagaactgtagagttgtagaattgtagaattgtgcattgtggccagggttgtggcgcattttatatttatctggctgtaagaatgaagttttgttagtaatgagtgtagttttattgaacatttattttgtgccaggccctggatggtgttttcattggattatttcatttaataatgagatctctcatttaccagctggcacttcctcctggctctatttgggagatctgttaattaacaggaagaatcagttaggtagtccttggaccacagctggcctgtgggtatctgttttgtttgaccttcccagagtgttaacattttctaatacttaaacatttgtacattctggataaaaacctggatttttgactcacttagaaaatggaaagatctgtcaacaaaggttgcaagtaagacttgcattcacattctaactgggtcactgagcccctcttgagcccaggagtccaacaccagacatggcaagaccttatctctacaaaaaaacttaaaaaaaatccaggcatggtggtggtgcgcacctgtagtcccagctacttgggaggctgaggcgggaggatcacctgagcccagcaagatcagtgtgcagtgagctgtgactacacttcagcactccagcctgggagacagcgggaccctgtctctttaaaaaaaaaaaaaaaaaaaaaaaattcagaccacaagtatttcaggacttttctaggcactggggatacagttgtgagcagaacagattctagtgtgggcaacacacattaaacagacgagtatgtgctatgtcaggagctgggaagggctgtggagagaaagcagaggacggagcttagggagtgccgtgggtaaaggtggaaattttgtcggtataattttcttgggcctttatgcccagggtggtactgagttgctgcatctgggtcaaggagagaatgcaaagggtctgctttccgccagtcacagatacgaaccctccgcatccttctcaacacagggctcgaggcagctgctctctgcccatcagagttggcacagtacttgtgactacagtgttctagagctgcaataggtagcagtatggtagccacttgtcatatgtagctatttaaattaaacttaattaattagaaaatgttagtctttcagtagcactagccacatttcatgtgctcagtagctaaatgtggctgccatattggacagcaaagatacagaacatttctgtgattgcaggaagttctattagcgctgttctagaggatggtggcttgccccttgggccaggtctcctagttgacagctcgttaactcttcaaacctctaaggagtagtacctgctctttgccaaataattcgtggtgagggctccaggtaccacacacgtggccatctttgggcccagtgggctgtctcctgagactgcagtcaccttggcctacacggtggcccctgtctctggggactgcacaggagaccaggccagtgaccagaagtcccacatgttcggtgtcccctctcctgctctggcagggtaagagctctgggctgaccctgggtctgtgtgatttccgcactgttccagatgacatggcctggtggcttgttagtctggccccgccaacactgagattaaatgtggccctgcttctcttggggcctgttgatctggggactctggggacactggtctggtgcctgttctcatgctggaggccttgtttccaaatatgctgacttttacagttatgcagctcctccctcctctacgttcctacagcatttggctgaagactgtgaagcactcctgccctgggagaccagtctctcccacgtgtgaccattgccccacccatccaagctctttggagtactgtttacctttgaccttcccagcatttagctcagggacatgcatagatgaccagtgactgtccttcgagtgactgaggtggggaacacatctcttgggcaggggcagcacacgtgggccccctagtctaaatggcggcagtattggagtttccagatttcacacattgtggtacttcgtcccctcatccgggagaggtgagctgtttgggctctggcctcccaaggttactaggcctggtccttctctccattccctgcctcccacagccccctctgcttaggtagtcaggccatgatggacgccctggtggggtgcagtgactttttggcttccaaattggctggacactctaagaatctggattaatcgggaccaagacagactggtttgtgaaacatctgtgggtatgctcacagcctgtgatgggttacagtgacatgtatttgtcaagcacatggcacttagaacacatgaacacacatggacacacctaccctacagacaaacagacttcatatacatacctcatgcagacactgtagacagtagacacgtacatgcagctgcatgtgtgtacatgtgcaagcgctaacgcatggacacacacacacacactctccacattcacactcattcccagccacctgagcactatgggtctctctcgacctaactgtctccctcttacaaggatgttgtagaaacttagcttctcaccagccaacctcatttatccaaatccctcctggcctccttgctgtaattaactcctgaatgcctcatcagagcctcagctgtaacagctcgggcccctgggaacagtgctggctgcctcccccttctatctctgtcctgagccagtgcgaaccaggcctggcatgagtcatccctgagtagaagggggcttgggtggttccttctcggagccctgtggaggccatgccgacagattgccctggggtgagaagctcaacacatctgctctcagctgagatcccagcccaggaggcccagcatcttgccccaggcccttctcaactctctaccccactgcaggcctgggtgcttcttcccaggatctgggcaggttcttgctttacccaggaaacctactaggaacttccagggcttgttgttttttctctggactttgattcttttcccagagagggtcagggccttgacttttattaccatgctgtatttttaggataaccatcaaggacttgaaggctgaggagaatgaagactttaccctccttcttctctgtgcagaaccacatctgggcacccaggcctcggcccccagggtttggccacatccccctcctccggtccagccttccacccctgctcggctcttcccgcagtcttctctctcggtttctgggaatgggagttcaccacctctcagggcagcacattctttgaactgtttgactctttaaaaattcttccttctctgaaagcaacattctgttccccagcagcctttcctcattagctttctctcttggggcctccaaagcaagtcttgtcccttttctacatagcagctttcctcagacttaaagacagcttcctaagaagaagggggtgggggggacctggggctaaggacacagcctggttaagctggaccggggcctttttatttttctgtcacacagcccagagccaaggggcttgttcaggcagctactttatgctgggaattcattttattttattatttttatttgtttcgggatggaggctcgctctgtcacccaggctggagtgcagtggcgcagtctcagttcactgcagcctctctctcccgggttcaagcgattctcgtgtttcagcctcctgagcagctggtattacaggtgcccgccacgaagccctgctaatttttgtatttttagtagggatggggtttcaccatgtggcccaggctggtcttgaactcttgaccttaagtgatccgcccacctcagcctcccaaagtgctgggattacaggcgtgatccaccatgcccaggctgggaattcattttaaatctaacagcatctcaaatggtaggtgtcccccttctaccccccgcaacattggtacattgtgtctctcccattctgttctcctgcatttggtttgggagtctcaggtacagactatgacctctatcctttttgaatttcatcctgtatgttgcaccagatttcagcagaacaaaagccacgagccacttgtcccagtgacacgccagccacacatttctaaatacatcctctgtatcttctgagaagttctccttctggaaagatttacactttaaacaaagaggcctaagagatgcccattttatagataaggaaccaagcccccggggtgaagtacctgcccagggcatgggggcctttgcagcctaaccccagatcagtgagctttgctgtaccccccaaaacccctgggtgatatggccactcctctgacagatgttctgattttaaacatgctttgtttcttcagcaaagccacctttgggattagtcattactatcttacgtcaacagatactcctctgtttagtccaggccatcagataaaaagtagcttcaagtgaaggaagggtcctttttccacagtccggttctctggaaccctgccaccccctaccgaaagtcacagtccaagagtgaagccaccacaggccacagcttcaagacaccacagcctgaacaggtgcagtcctgggagaagtggcctctgtgtcctcaagtaatttttataaaggagagacaacaccaaaggggcctgaaatggatcacaagaattcacatcatgatgaatatcaccattcaattgtgtactgattattgtatatcctcattcaatggctatagtcattgtatatacagattcagtatatatgaatcagtatgtatgaataatgatgttcagtgatgggcattgaatagcgatgaaatgcccagtgccaggagctttcaagagataaggctcactggccgggtacggtggctcatgcctgtaatttcagcaatttgggaggccaaggcaggcagatcacctgaggtcaggatctcgggcagatcacctgaggtcaccaggctggccaacatggtgaaaccccgtctctactaaacatataaaaattagccaggcatgatggtgtgcacctgcagtcccacctactcgggaggctgaggcaggagaatcacttgaacctgggaggcggagcttgcagtgagccgaggtcgcaccattgcactccagcctgggtgacagagcgatgccatctcaaaaaaaaaaaaaaaaaaaaaagatgaggcgcgtttcaatctgaaaatcacactataaaacaattgtaacaataaaaaaggattacaggaaaagaaaacatacaaagaatatggaagctgccaagtgacccctgccccctgggcgctgccctgttgcaccttcccctgcggcagctcctcacagtggggtcctgtgccatccttgggctttgggaagggggcaaggtcgccatacgtcgtgtcctgaggcgcgcagccatttccacctcaaaacacatcgcactggctttgagggtcttgttttctgcagcttccttataccccagtcctcggttacaggttttgcctcctagtttgatatggctggaggcagtgcctttagtaggtagactcttccagaatgttgtacaaataacacccctacacacacacacacacacacacacacacacacacacacacacacacacacacacacacacaccctccagctgttcctttccttcaaatcttgttcctcaagagagacttctcaaacctcaggtgcacaggtgtgcctcacggtccgtggcttccccaccctgatgagcacgggtgatgctgagtccacagccccaccagccacactctgggtagggcagcctgaagtcctggggatgggctcggctgaaccagggctgcactcccagcaccggctcggccactctgtgtggcagtgacgagggcaacccaagtttccgcgggcgttggcagctcgggtcctcgggcagcggctcctggccgtggagaggcaggcaggcgtctgctgggggtgttggggagcagcaggcctctgtcgaggtccggggctgtcctggcatcaggcctctcacgctcagcccagttgagtactttctgagtacacggtggccactcatgcctgctctgaggccgggctttgccacgtgggcccctcctctcctcagcctgtgaggagtagcacagggcagtgaggccggggaggccgggtgacccaccagtgtccttaggccacagggtggggagggagccatggaggcagcactctcctcctccgcttcctcttctctgcttaatgtgggtcccagggaggactctaggagccgccaccaccactgcccctgtaccccccacccctgcctggtgcctggcaatggcagccacaggacgtctttgaggacatcagatgccgtggggacagtggattgcagaggaggagcggaccggggtgctgggagacacatcagaggctgttgcaagttccccccgaggcagccgctgggccgtttctgtgaggaaggacccaccggaaggggctgcctgattcccacgcccaggtggcatggagccctggggagggtgtccagagccagagccgcactgtcagggccttactatgttacaaaacaccagggcttcggtctgggtcctgctgcttgcacagaaagccaatcactgtgacagcaattattgccaaggaatacggctttaatcgggtgctgcggtagaggatatggggactcagtctccaatccatctctctgacctgctaaatccggggtttacacggcagggaagaaatggaacaacgcgcgagacaataggaatgaggggtcctgagtctcattgtctggatgtggtgacctggttggtgagtttcagttattcagtacttcatttgagaggcctgaaggtcctttgctgaggaaggaactcagataagtagaagttttaagccttaagagcagaaggatccatttctatgtttatttaaaagaacagtctatgggacttttggaaaggttttaaccgatgcccctgggcactggggggaccttcacatctgtagcagaacaacattaaagcagatgagagaactggggtgggaaaagcacaaaaactcacccattccaggggtctcagagccctgggttcagggtctaccgctaaccctttgggatgtgtaacagacaacttcatctctctgtgcctaggctttgtcacctgcaaacttgagacaatattgcacataaataataccgggttgatgcagaagttttagcaaaggagagggatgattttgactgggtggatggtgtctgtcacctggtgggtgctgggttcatgagagctacagagcgaagccagcccagggtgaccgttctgtctttggcttcctaggaggaccactgccttcccccacccccattttggctgtgtgtctccttggttcgtgcctggccataggttccccctcctcaggttatgtccaagctgactaggaagtctggagccaagcccaaaggccttgagggatgttccctttctaagaaaactgtggtccttccagagaagccgaggtcagggataggatcacagctggaggcaacaggaagttccatgtttatttccagtttaaaaagtatttttaaaaagaacaaccaccagcaccctatagcaactttgaaaaacgtttcaggttttccctaattcggtcgtccaagttaaatgagccttttctctttgcatatagccttctgcctttatttctatgcacacatagatcccagcgtcagcttcacagaacacaattttgtcccgctcttctctctctgtactttattgcaatgataaacaatactgttgtttcattatggtcattcttaaggttgtagaatcttccatccagaggatgtgtcattttaattagccatttgctgggtatttgggcgacttacagttttttccacaagggttaagtcaagttgcaatgcagatcaccttctacgtatatctttttacttctgttggatttggggggataaattctcagaagagctattaatgggtcaaaggtttggaacattcttgtgactcttgaaacgtatagcaactgctatctttggaagagcaggctctgcttccacgctggggagaccaagccacattgatcatccctggggccctgagcaatcctaggctgctatgggtggcctctctcccctgcactcctgtcccccactgtgggacccatttgccagttcacctggatcccagcctccttccttcccccaggaacacaaatgaaggggtgtcggagtctttagccagggctctggaatggtaatcagggatcttctgtgtgtgtatgagcatttttctagaaggtccgtagctagcatcacgcactcatgaaaggggccaggatccaggaaagggtttagaacctctgaactctaagggcaaacaaggccagcaccaatcgagaggcaccaacaaagtgggtgttagtgaggagggaggaacagacacccctgggcaggggccaggggctctctggagaggtgacatgtgaggtgggtgtcgaaggtgtggggagggaggaatgttccacagagagtgacaccagaagcagaggacagggaggggtaccgagaagaggaaacagtccagctcatctaccctaaggggccacaaggagagcagtgggggacaggactagaaagacaggtcagtgccaccactgagggtgctgggcaatggtgtcgcacagcttagaggacatccagataccgtgccaaaggtggactgaatgagaggagccggccggcacctgggagacacattcagaggcggttgccagaggccctgaggcttggggggtggcagggggagggcccctccctccgtgggccttcgtctcccagacccccctcctcctttcccctctgtcaggttccgtgtgtcctttcttctgcacgcactgacgtcttgtttaaaactcgtcttgttaccagaatgactccaggtagactgttggcctgcttcactttttgagcctgactataaggtttccacaaaccacacagggaattggcagcctgaatttataagcatagctcctttcttgttatttaagtttgattttctgctttcagaacatatttgtgctcttagcaaaggttatggaaatatataagggaaaaaaatggaaattccccctgtcccacccccagagagaagctcacggccgcttcactcatgtggcccttccgaggctcctgttttgggctccagggctgccctggttttgtgcctctgccgctacttttgttctgtattggtagacagtctccgagaccccagccataccgggaggaggctcagcagtgtctggagggagaaccagtactgtggtcaggggcatggagctcccacaggactggattggactctcaggtccccaaggttccaagagagcctgaagaggcttttctgaagggacagaactctgaggtagacccaggagggcaggaaaggcctgtgtgggctgtggctgcaggagccactgcatgtaggctgggagggaggccagcacggtgctgtgacgttcttaaacctcacgttccacgtccctccctgcccacacacctgaccacgcctccccatgctcctcacacatctgcgccctcctcacccaagcagcaccctgaatgcacacgtggcggggggggctgagactcaaatggaaggcagggcccttccttgtatccctttgttgtcccacctgcagtaagcagagctcaggagaccaggctgagtgacccagagggtttgtgctgaccctggcacatctcactggaactcaacctaaaaacttctggccaacttcaaagcccagaggaacattaagccctgtctttttgagccacctgctgtctccacaccctcagtcactcagtcatactttctatcatgtgactgtaggaaaagctggactatggtgagcgcttcctgtgggccaggcactgttctaagtgcttgccggcaatgaattgtgtccttcctgctttcctgcctaggaaaccaaggcacagggaggtttagtatcctgccttatgccgagaccagctcggctggggagaccctaacccagtggtgctagagaaattaaagacacgcacacagaaatatagaggtgtgaagtgggaaatcaggggtctcacagccttcagagctgagagccccgaacagagatttacccacatatttattaacagcaaaccagtcattagcattgtttctatagatattaaattaactaaaagtatccgttatgggaaacgaagggatgggccgaattaaaggaataggttgggctagttaactgcagcaggagcatgtccttaaggcacagattgctcatgctattgtttgtggcttaagaatgccgttaaggggttttccaccctgggcaggccaggtgttccttgtcctcatttctgtaaacccacaaccttccagcatgggcgttatggccatcatgaacatgtcacagtgctgcagagattttgtttatggccagttttggggccagtttatggccagattttggggggcttgttcccaacaccttatagccacagtgagtgcaggcagggctgggggctgagccaggccagcactcatgatcctgacggctgcctcctcctgccccgcgagcctcaagcacaccagggccgcacactccagtgcgggctgggatccccgggattactgaccagagaaacccagccccagcccagtgggtgctgcctcccacctgcctcctccagactcctcagctctgcctgcccctcaggactcccagcagctgtctgccttgagaggctgccctcaagagctggtggggccccatctctggcttttcttgaaaaccttcctagaggctcatcttttctgcaaacccagagctttttccacaatgtctggttagttaggttccgagacgggtcctgtcccacccagcacttcacccatttctttgcattgggcatcctctcaccacacttgactggcagagagaggggagttgccaagcaccaaggctgcctaagttgctatccctgggctgcagggccctgggagaactggatgccacttcccaggcttcggtggagccagggcagggcgtactgggattactttgccttctcattcctgagctgtagtgccatgcttgaggttaacagtgaagagatattgctgtggaaatggaagaataagagtgtcttagtccacattcatgctgctgataaagacatactcaagattgggaagaaaaagaggtttaattggacttacagttccacatggctggggaggcctcggaatcatggtgggaggtaaaaggcacttcttacatgctggcagcaagaggaaatgagaagcaaaagcggaaactcctaataaacccatcagaccttgtgagacttatttgctatcacgagaatagcacatgaaagtctggcccccatgattcaatgatctccctctgggtccctcccacaacatgtgagaattctgggagatagaattcaagttgagatttgggtggggacacagccaaaccatatcattccactcctggcccctccaaatctcatgtcctcacatttcaaaaccaaccataccttcccaatagtccccccaaagtcttaactcatttcagcattaacctaaaaatccatagtccaaagtctcatctgagacaaatcccttctgcctatgagcctgtaaaatcaaaagcaagcggccagacatgatggcttacacctgtaatgccaggactttgggaggctgaggcgagtgaatcacctgaggtcaggagttcaagaccagcctggccatcatggtgaaaccttgtctctactaaaaatacaaaaattagccgggcatgggggcaggcacctgtaatcccagctactcaggaggctgaagcaggagaattgcttgaactggggaggcagaggttgcagtgagctgagattgcactacagcattccagcctgggggacaagagcgagacttcgtctcaaaaaaaaaaaaaaaaatcaaaagcaaactagttacttccagatacatggggatataggtattgagtaagtatagccattccaaatgggagaaattggccagaacaaaggggttacaggccccatgcaagtctgaaatctagcagggcttctttggagcttaaattttaaagctccaaaatgacctcctttgactccaggtctcacatccaggtcacgctgatgtaagaggcaggttcccatagtctcgggcagctctgcccctggggctttgcagggtacagcctccctcacagctgctttcataggctggctttgagggtctgcagcttttccaggtgcatggtgccaaggtgtcggtggatctaccattctggggtctggaggacagtggccctcttctcacagctccactaggcagtggcccagtagggactctgtgtggtggctccgactacacatttcccttccacactgccctagcaggggttctccatgagggccccgcccttgcagcacacttttccttggacatccaggcattaccatacatcttctgaaatctaggcagaggttccccaatcctcaattcttgacttctgtgtgcccacaggcttaccaccacatggtagctgccaaggcttggggtttgcaccctctgaagccacagcccaggctctgcattggccctttcggccacggctggagcggctgggacacagggcaccaagtccctaggctgcacacagcatgggcaccctgggcctggcccacgaaactactttttcctcttacacctcagggcctgtggtgggaggggctgccgcaaaggtctctgacatgccctggagacattttccctattgtcttggtgattaactttcagctcttcattacttacacaaatttctgcagccagcttgaattatcagaagatgggatttccttttctatcgcatagtcaggctgcaaattttccaaatttttatgctgtttcctttttaaaactgattgccattaacagcacccaagtcacgtcttgaatgctttgctgcttagaaatttcttccatcagataccctaaatcatctctcaagttcaaagttccacaaatctctagggcaggggcaaaatgccaccaatctctttgctaaaacataacagtcacctttgctccagttcccaacaagttccttatctccatctgagaccacctcagcctggaccttattgttcgtatcactaacagcatttttgtcaaagccatttaacaagtctctgggaggttccagacttccccacagtttcctgtcttcttctgagccctccaaactgttctgacctctgcctgttacccagttccaaagtcacttccacggttttgggtatcttttcagcaatgtgccactctactggtaccaatttactgtattagtccgttttcacgctgctgataaagacatacctgagactgggaagaaaaagaggtttaattggacttagagttccacatggctgaggaggcctcagaatcatggcgggaggtgaaaggcacttcttacctggtggcagcaagagaaaatgagcaaaaagcaaaagcagaaactcctgataaacccatcagatctcgtgacatttattcactatcacaagaatagcacagaaaagaccggccactgtgattcaattacctccctctgggtccctcccacaacatgtgggaattctgggagatacaattcaaatgagatttgggtggggacacagccaaaccatatcaaagcgcaaaaccactattactgcttcaggcaggggccagtgccaggcatgctcaccttgtcctaatggtgtgattccctgcaagaaaggtgataaattctccccatgaagccacagagtgcagaagatggggacctgtagcagagctgattctcacaagggaggcctctggtttaccaggtgctgagggcccaagtacaacagcagactctggggacctcttggcagctccacccagaggagtggagttgagccttcacctcctcctgccccaaagcaggtgcatctgacatgcaggatgagctggcctctctcgggcctcagggacccctgaactcagcagagtcagagcacttgcatggtgcccccctgcccaggccttgtcaggaggcaaggtccctggctcctgctcctgtggcctgggacccacagccatccagccaggccctaggtgctgaggaccaagccactagttcttggttttctggccacccaggacccagggtggtaatgcctgggacctgcaccctaggcacagagctcctgggggtcctgagttcccgcccatgcactcctcacctttcagcagccgaccccatggcgacacgggcctggccacccggaagcactccaccctgaaggtcagcgggcacctgtcctccagccacatctctgccttccggttccctggcctccccctgtgcctgctgcggtttcatttgtatcttggccccttgctggacacactttctttagttgtgtccctgccatgagctagttctcatgccccttggccttttacagtttccatcttgcaaaacctcaacttgggattctcccccaagtgccccccaccatccttcaccagacgccatcatcaccctcctcccctcagggatgggggcagtgctcccctcttgaccagctccctgctgagcctctggtccctggcttcgcctccgcagcaccacattctgtccctggttttctctctccgtactgcttatccaacccatggcttccaggcggatggttcagcccactgcctctcctgagcgctgcctgcaggtgcccgcacagaggccccacagcgcctcagaaccaaaccctgtctttgccctcatatctgccgctcttcctctgttccctgttccagagaccggcaccgcccaagccacagacctcttctgacaagagccacatagtaaatatctttggctctgtgggccatacggtctctgtcgcatctaccccactctgccattggagtgttaaaacagccagagacaatatatcaacaaatgagcatggctgggtgccaggaaaactttatgaaaacagaggatgatttgagcgcaggagtccaagaccagcttgggcaacatggcaagaccctgtttctacaaaaaatgtaaaaattagctgggtgtggtgatgcatgcctgtactcccagctactccagaggttgaggtgggaggatcacttgagtccaggacgttgaggctactgtgagccatgtttgcaccactgcactccagcctgggcaacagagcaagaccctgtataaaaagaagaaagacagcagcagtcagattgggcccacaggccacggtttgctgaccctgatctaaaccatgcccagctctcaagccatgtttctgtttttacctccacagaaatccctgaaggaccctggtgcgctttgcgtgtgtctgtgcgtttgtgtacacggctgcctccaacaggagtgccctcagcgtcgcgtcttgggctcgaccaaggctccttcaggaaggcctccttgatgcctcctccccggccgaccttggcccctgcttctctcttgcgccgtcctctgctctctcctttctgggcacagaacttgccatgctgcgctgtgctgggcatggttacctgtgtccccgtgagaccctccgctctctgaggtggacgttcttgctggttttgtgtcgctggcgcctcgtgtagtgcctggtctgctgtcagtctttgatcaggtcaaagcagaattttgtgagcgatggctctgtgcagccgtggcgggtggctgaggtgaccccgcagggctcctgccgggagggctcacggtgcagcagcccacgcaggactgctgcgcttcttgtggcacgaggatgctgagcacagagccacgttgggatgcttcactgcgtttctggctcccctcagttgctctgaaggggccattgccaccctcagccttgtcagggccagaagctgcctgtcccagacccctggctgctcccgaggcagatctgtgaggtctctctggagggcagcatggttccctgctcacgtttcttgccaggatcggggcatttcttcccagaagtatctgaacttgcctctagcagggcctacctttgcctctgaccctctcctgcccctcacaggagaacctcatgctttccatcctgcccaagcacgtggctgacgagatgctgaaagacatgaagaaagacgagagccagaaggaccagcagcagttcaacaccatgtacatgtaccgtcacgagaacgtcaggtacgccggcccggggcgcgggctctgatggcagagcaggctgtggagggctgcatctttgtgggacccgctaggtgctgtgggcttcaagaggttttccagggactagaagcaaggcctcccacagcattcatcagcctggcggaggaagctgccagcagatgttgaagctacagtgtgctctaggctgcttggtccaaccccatcatagaacagatatcacctggagcggggaagggactcctgtgaggtcacccagctgttgagggccagcactggggctagagccctgacctgtgattctaggaagaaggatgagttcagcctgggcaggagtgggcagtgtggggtggtccccaggcaccacagggagggaggcctgcaggggaagtctgctaggacaagtgcaaggtcagagccctgactttacctggaagggtcagggtctcactgtctgggggtcgtgagggaggaccttctcctgccctgatcctggctgccctgtgggttggagagggagctggcagtggggtcgggtacacctggctgcctggagcgtcacccccacggttccttcctcatgcagcatcctctttgccgacatcgtgggctttacccagctgtcttctgcctgcagtgcccaggagcttgtgaagctgctcaacgagctctttgcccgctttgacaagctggcagctgtaagtccctggccccgcctggctctccagcggggcctgccctcatggcctctgcctggcccccatccccggccccatgattttctcccactgtccttcctctgctttcttggccactcctccctcactgaggaggggctggagcacaggccaggccctcccctttcagaaataccaccagctgcggattaagatcctgggcgactgctactactgcatctgcggcttgcctgactaccgggaggaccacgccgtctgctccatcctcatggggctggccatggtggaggccatctcgtaagtgggatgcctctgggagggaggctcccagagcaagggccccggccctggacccagggagaagcaggtcttccgcgctggccatggcccctgggtgggggatctgctggaagcagagactgggacacagcactggttgatgggtggcgcaggctcccgctctagaagctgggatgtggcttaccttcctcacagcccaggggacctgcgaggctcccccagcctgtggggcacacttttccagccttagtccacgtattctctttttgccagaagttgcagttgtgaattttctcacgcctcctcacacttgctgggacccccacaggggctccccatctctcctcagtgttttctcaccgtgacccccgaaggcactgccctctccatctcgtgatgcagtgactgtaagaccctggcagaggggctcagggatgaggctggatcccaccccggcctctgtgctccagccttaggctgtgagggaggcaaactctcctgccctcactgtcccctactcttgcccctgctccaagtgggcttgcagctctcggatgggcagtccctctggttgacttccagcctctgcgggacccggggtgacatcaggcaccaacacggaaagggaagctcctgccgaggcccctcccccatgggatggagtccaggaagttgcctgctctttacccccttctccgagggggcggctttgcatttttaccatcttccaggttaaagcccgtctagtattgccctggaaagaaagcagtgtggcctttaccccaggggtggtagtccaggaactctaacattctctccctgccctgtcagacacgttcaggcagggggctgttcacggctattttcttcacctctgtgtctgcagcaccttgaacgtgcctggcacatacttgatgctcagtgaaatattaactgcacgaatgaataaaagagtaattggcagagagaaactgaggcccctcgggaagtggggatagggaggaaagtcgcttggtgccctcgtcctgctggcctgtgatgcctgactctgggctggccctggcctgccttaccccccacccaacaccaagctgtggggaccttgccaggccccctcttgtggaggggaagaggcccacaatgaatttctcctgcaggagcaggggcagctggctgcctcgtgaaggccacaccctgaccctcctttctgtgtgtacctggcaggtatgtgcgggagaagaccaagactggggtggacatgcgtgtgggggtgcacacgggcaccgtgctggggggcgtcctgggccagaagcgctggcagtacgacgtgtggtcgactgatgtcactgtagccaacaagatggaggccggcggcatccctgggtgagtgccattccaagggggcaggtttgaggactggggaggggaccgtcccctccatcccccagggctgtgaccctgatgagggacagggggcctcagagaaggcccccctacaaccccggaacagcattcctcctgtctcgccctggtcctggccctggctaaggccgttctgacctgccttggggtgaggcctctttgggcctgatattggatgtggcttttccttcctggaccctgcagtagcctgtcctcctgtcccctttaccgacttagggggctgcctcccctttacccactaagggggctgccccagctctccttatgccagagcccaggtctccccaaagggagagtaatgagcagtcatcagctagcgggctcgcaggcagcgttttgcaggtcgcagtgcgattacacgtcttacttgagctcccttacaggataatggaggccctgcctttagcagggcgaggctgagggaggatcagcccagccttccccatctgggccagggagcttccttcagtggcatttaggattcttggcctcagtggtgactcctcagaaacaggttttattatctcttggcagcaggggttgcaactgagaaacatgcaaggtgggggataattggatcttgtggctcacgcctgtaatcccagcactttgggaggccgaggtgggtggatcacctgaggtcaagagtttgagaccagcctgaccaacatgacgaaaccccatctctactaaaaatacagaattagtcgggtgtggtggtgtgcacctgtaattccagctactctggaggctgaggcaggagaattgcttgaacccgggaggcagaggttgcactgagccaagatcaagccactgcactccatcctgggcgacagaacaagactctgtctcaaaaaaaaaaaaaaaaaaattccttatcgcatttgatctgctttacagcggatcaaagattgaagaaagattgtactcctgtgtcgtggctccaacactgaggctgagatgggagtaagtgccatacggcccacacagctagttagcggcccacacagctagttagcggcccacacagctagttagtggcagaactgcctccacttggcctctgccccacatgcccgagagacacggggccgagcagcagccggtgcagccgtggtccgtggactgtcccctgggggtgtgagggccacctctggccgacgctcagggcctctctctctgcaatccaggcgcgtgcacatctcccagagcaccatggactgcctgaaaggggagtttgatgtggagccaggcgatgggggcagccgctgtgattacctagaagagaagggtattgaaacctacctcatcattgcctccaagccagaggtgaagaaaacagccacccagaatggcctcaatggctcggtgagttccccaccccaccccacccaccccacccaccccacccctggattagggggttggaaaggaggagattaaggaaagattgcagaagaggtggcaggacccagcagtggctggctgtgagaggtgagtggcaggctggcacccttcccaagggagagctggtttctgggggagatggtgagtgtaattcatggcaggttgcaatggaggtgactgaagcatatcccaagaccacatccaggagggggccgctggagatgtgtcggtggcgcccaggagagcagctgggttggggctcagggtctcctgcatggaggaagtgagtgaagccacaggagtgacgtggatgctcagggagaggctcagagaggagggtgggggtggggtgactggtcatgggggaggaggaccaaggccaggaaggtttcctgagtgggaaatgagggaggaatgagatagaagtaatagagcaggggtgtctaatctttcggcttccctgggccacattggaagaagaagaattgtctcgggccaaacaaaaaatactgtgggttgaacaagcttgcaatcgtgcatcctgtgggcctgccctctggtctttttgtgggatcccccgaatatctacagacctgaagcactcagcagcttccccaggtctgtccaccaacccccaaacacctcctgtcagtctgattagaaaccaccagcagctgttgcagaaatggatccctttaccatcccctgctgaatctggaggttgtcttattttttgtaatctcatgtcaaaaccctttcctccagttatgagagtccatctaacaagacttggaattaaggagcttggtgactgtcagggaagtcgtgtcatttgagactgctctatggctgaggctttgcctaattatggctaaagcaaagcccactctggtgaggctgccggagtgaaggctgatactccccgctgattctaacctcgatgtcagtctcatccagtgtcattttaaaggctgtctctgacaactcccaaatttgtatctccacccccagtgtcttccctgcactcaacatacagccacttgtacgtctccatttgtacatataataggtatcttaaatgccacctgcccaaagctcctgccctccttcccactccataacctgctctccctcggtcttcccatctcagttaatggcagttccatccttttattaacaactgctcagaccaaaaagtttgaaatcatccttgacgcctcactttgcaatccacaagcaagttctgtggcctcagattgctctctaatcccaccgcctcccacgcccttgtcacttccagacctgtccacgccactctcatcccatgcccagatcatggctgagctctcctttcctctaggccctgcccaatggagcaccagcttcctcaaagtccagctcccctgccctcattgagaccaaggagcccaacgggagtgcccacagcagtgggtccacgtcggagaagcccgaggagcaggatgcccaggtatgtgcagggctcagggcagggggtcactgagggccagatgcgggcaggcaccaggaagcaatacgttcctgcagcaggagtcctgtgctggggagacctggccaccacccaggacctgctcctgcttagcactgtaaccatggacaggtcacccctccagccccgcaaaaccccactgtctcctcatcagttacatgccggggtgagtaaggtcaaaagaggtgcttagctcggaggcctttgtagctctgatggcccggaatcctgtagatttgagatcagtgaggacatccatggaaaattatataggatctgagaccattttggaagtgagatatcagacctggactcacccctctggctaggttcaagccccacaagttccatgcaagatgggatatttccttagcccccaaaggcgaggaattagcatgctgtcccagagtgcagggtgcctcttggggagcacccagaactggtccctgaccgcagggcgtctggagcacgttcactgatggaggtcagtgctgcagagatgggatgtctgccctgctcgggctcaccgcgtgagggggacaggagagctggccctggtgccattagagcagatgccgtagaacaagagggtagatggggctcagggtaaattaggtttttcttgagtcccccaacattcagtaacttttccttgttgcagttttcttgatagaaagtgggggtccagactcagggcactcactagcaaggaggacacagatgcagctttagcagcctgatttttcgggccctgatcctcagccagggccacgctgctcccggatctgcttcaggaacaggttcccgctgctgccacagaccatccacgtgattttacagaaggggaagatgtggctggggaaacattatctggggtcaaactgtcaaccagtggcacacctgtgcctgtgcttaagaccagggagtctttttttttttttttgagatggagtcacgctgtcacccaggctggagtgcagtggcgcgatcttggctcactgcaacctctgcctcccgggtgcaagagattctcctgcctcagcctcccaagtagctatgattacaggcgtgtaccaccatgcctggctaatttttgtatttttagtaaagatggagtttcactatgttggccagtctggtctcaaactcctgacctcaagtgatccacccacctcagcctcccagagtgctgggatgacaggcgtgagtcaccgtgcccggccccagggagtcgtgactgtggctcccagatgcactgttgaacccgttcagacagctctcagcccgtctcagtgactattcagactgatggctgtgtcatcacagccaggattcctgtttttggagttgatgctttttctttggaactgggaataaaagggtagtgggtgccccagctccacctacccgccccttgtcagccctctagtgatgaggacattcttctctctcccatcactttccccctcagatcttcctttccaaatgagccagatgtgagttcctttaacagttccctgaagccctagagttgggagccattcatgtccccaggctgccaatgtatatggcccccacatcaatacagcaggaagtgccaggactgcctcagcccagcagctgtctccgattacaggtctcctgctcaggagccaggggctgctccctacaatgctgtcattagcggaccctccctgcagagctctgggtggggggcccggggagccaggaaagactggagctttgggtgtagatccaggccacatggagccacgtgggagcatggggaagacttcccggaaagggattttagagctggagggattggtcctccgagtatgccctcttttgttcctttcctcctccacctctgtctttcccagctcttccccaccactctgtcccatctgccccactcacgctgcctccctggctcacaggccgacaacccctcattccccaacccacgccggaggctgcgcctgcaggacctggctgaccgagtggtggatgcctctgaagatgagcacgagctcaaccagctgctcaacgaggccctgcttgagcgagagtccgcccaagtgtaagcgccacccggaagcgtccaggcccaccactcctcccgggccctgacaagggattcaggaaactgagcatcccaaatacggcccccctgctaggccaaggcagatgtggcatttgggattcatggggcttgttcccactgcagagtaaagaagagaaacaccttcctcttgtccatgcggttcatggaccccgagatggaaacccgctactcggtggagaaggagaagcagagtggggctgccttcagctgctcctgcgtcgtcctgctctgcacggccctggtcgagatactcatcgacccctggtgagggaggggccggggagggccacgagtttcctcggctgcggtggtgccgggcggggggcgggggcaggtgtctcagcgggagcctgatattggggagcaagccagtctctgctccctgacccccactgggacggcccccacaggccccaggagtgctagacggcaccctgggcatccttccttttccctgccccgcgttttggagcagtcctagcgtcagaatggggatctggccaggatcaagagagctgagggacagaggcctccagaaggctggagaccttggctagatgggcccacactgattcttgggacaaagatggggacactgcgtcagtctcagtcaccaaggctgacctggcccctctcttggctcatcttggtaaagatagattttaggctgtgggcacagactgacgccctctctaacgcagcagtaggttctccagggcaaggtgtggcctcctggagtccccagctggtgaagccctgtctgagggtgacgaccactctcttgttctccctttctcccctcggccaatcggggattccccgtcacagaggaggggtctggaaccctgctgggattacagtttgtcaggagccttgggctgggtcacactatctaaggttgcgggtgtgtgaccacgtgcaggccactgcaggctccggcagcatctgtttcctcatctgtgaaatgaggagaacaacccctgccctagcggacactcaggactgtggtgaggctcaaattcactcattccataagtattgattggttgtctgcttcatgcgtggggatcaagggctggggctatggcagcgatgcggcacacagaaacccctgctctcgtgaaacttgggttctggtaggggaagctacaggcaaaagcaattaaacaattaaaatatgcatccatgcgagagtaagtactgcagacacagggaaggcaaggaagggaggcgggtatgctgctggggagctttgttttgttttgtttgcattttgatgtgggatggtcagagcaggacttgctggcaggataatatttcagtaacgcctggaagcgggtgaggggcgagccttctcctatctgggggacacctgcttcggatagaggtgctgaggctggagtggcctggcccctggaggcacagtgaggaggcatcgcattgggaacgggccacaggaagagtagcaggagtccagcacagacgtggggcctcctacacgccactgcagggtgccagcttccactcttaacacaggaggccgccagaacaagggagcagaggagtcccctgttgtgacatatgcctggagaggctcactcctgctgagaacagcgcttagtgagcacagcgggagcagtgagaccaaatagcggcccagacaagccactgtggtggccaggccaggccgaggatagaggagtatcagtggttggattccgtcgatagatgctgaatgtattttggagacagagctgacaggatttgctggcagattggttgtggggcgtgagtgtggagttgaggatgtctcctgggcttctgatctgagcaactggcaggatgggggtgccgttaaccaagatggggacaaggtggaaagatgagagtggagaggcaaagatgaggagtttgctttgggacacgtgaagtttgcagtgcccacaagccaaggaggccagcatccatgatctggagtttggagggcgggtggggttggagacgtgaacctggcatcgccagcatgcaggctgtgctgcaacacgagacttgctgagctcaaggcagcgtgtccagatgcagagacagaaaaggactcaagaaaccaagcgagaaaagtgtctcaaggaggggtgagaggtgactgaaaatgggacatggatttagctaccaggaggcttctggggctcttggcaaggacaccttccagggaggggttaaacgggaatgggtgtgagcagagggtatagagaacaggtttccgggagttgtcaggttaaggtggatgtgttgagtgtgtccactgtgaagctgggggcggctgtcacaggcagactcttagcccccggcagcgagggagtgatgctgctccgtgctctgtcctttcagcacagcgacatggcaggggtgcattcctaagatccctgcccaagtttatcctgggctgtgcccaggccacctgtgagttgttccctctctgggaaatgtcccaggcagcagctgcagctggagagtggcccgctcccaggccggcactcagctggcggcccgtctcatcagggcctttgtcctgttctgcacggcaggcagcagcaattccctggcaccgcgtggagctgtacaggctcgtgctgtgctgagaggcctccccgtcccctgcccccggcccctgtccccttcccccttcccccggtccttgtctgctggcccctgcccccggtccctgtctgctggcccctgcccccggcccctgcccccagtccctgtccgctgccccctggcccctgcccctgtctgctgtcccctggcccctggccactgtccgctgtcccctggcccctgtccgctgtcccctgccccctggcccctgtccactgtcccctgccccctgtccgctgtcccctggcccctgcccccatccccgtcccttcctctcctagcccctcaccccatctcactgtcccctctggcctctcccaattgtcttctctctgtcacaggctaatgacaaactatgtgaccttcatggtgggggagattctgctcctcatcctgaccatctgctccctggctgccatctttccccgggtaagaggcacttttctactgagctcagaagcctctggaagtgagtggcactccctgtaaaactgggcagtgatggagttattctttctgtcaaatctgacaggcagacactcctctgttaggacggtccaggcacttgcccatccattcattcaccatcagcagagcactccctctggctgggccaccaggctgtggcaggctgtggtgggccacggctgggccgtggtgggccttgttgggccgtggcgctgcagcacgtatgagtatggcagagtctgggtaaacaagaacctgggtagagaggaagtggagggccggctggaaggtgggttggccccgatggtgaaggcccttagaagccagactaaagggattaaaactttctcctgtaaggcactgaggtaccaagcagagtttttttttttttttaatcagaatgacaaaggtaaagcagtgtttaggaacataaatctgacaggtggctcgccaggtcacttggagccaggataggcaggagtagctggccagagacgagcagccctgaaaactgttcctgccctggcctcacctcgtcaccacgtctgctgtggaaagggctgcgacctggaggctgtgctgttgaacaggcacatcgaggaggtccaacacagcgtcagaactcccacgccctcttctcagctctgccccttggtcagctgtcaggtgactcccaggcagagtccgttttgaggctcctgggactggaatacgggaccagcctgagttgctgtcagtcacgtcgcaggagaaaggactggcaaaggctcatggcccttgaaattctgttccttctaggcctttcctaagaagcttgtggccttctcaacttggattgaccggacccgctgggccaggaacacctgggccatgctcgccatcttcatcctggtgatggcaaatgtcgtggacatggtgagctcctgctgtccttgttgaagggacgcccctgttctcagtggagaagggcttctgtttgggtcacacaagcagtttctcagtccatccctccaccgtcatgtagctttggagtggctcttaggttcccaaacacatcatccccacctagtggaaggagtcttgtccctgtcatccagggagcctctgggatggacttgtttccttgaagctcctctcccagagtccgagagcacagttccatgtgcccaggcctgtgctaggtaccttatgtatgttgattcatttaatctgtgaaaaagtcctgagcagttgtaccagtatctgcagtttcatagggagaaactaactctcaaaaagggtaattggttgggcgcggtagctcacgcctgtaatcccagcactttgggaggccaaggtgggcggatcacgaggtcaggagttcgaaaccagcctggccaacatggtgaaaccccatctgtactaaaaatacaaaaattagccaggcatggtggtgcacacctgtaatcccagctacttgggaggctgaagcaggagaatcgcttgaacccaggaggcggaggttgcagtgagccgagattgagccgctgcactccagcctaggcaacagacagcaagactccgtctcaaaaaaaaaaaaaaaaggtaattcacttgctctaggtcacacagccaggaagtgacagagtccagaatggaggcagttctaagtcccagtcctgtgtattcttcctccctgagggggcagccaaatgctttcttggggaaaagggacaggagttgggagcccagatctattggtttagaaccactgggcacgtattgagcactacatgcctggagctgtcatcagtgttctcttgtcagttgtcacggcctcctctaattgtggtagtaccatatacactatcttccttttttttcaaatataatgttattgttgtactttaacaattggagcacacggtgccgggcgcagtggctcacgcctgtaatcccagcactttgggaggccaaggcgggcggatcacgaggtcaggagatcgaaatcatcctggctaacacagttgaaaccccgtctctactaaaaatacaaaaaaattagccgggcgtggtggcaggcgcctgtagtcccagctactcaggaggctgaggcaggagaatggcgtgaacccgggaggtggagcttgcagtgagccgagattgtgcactgcactccagcctggcaacagagtgagactttgtctcaaaaaaaaaaaaaaaaaaaaaaaattggagcacacaaatacaaccaacatggagacttattctgccagtggtataagtgaaaaagctccagggctgcagctaatcagaagtccagtggggggccgggcacggtggctcacacttgtaattccagcactttgggaggctgaggcaggcagatcacttgaggtcaggagtttgagaccagcctggccaagatggtgaaaccccgtctctactaaaaatacaaaaattagccagccacaatggcacgagcctgtaattccagctacttgggcagctgaggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacccagggaagagaagccccaggccccctgcatgtcacaacatgcctggaacctggcacccaggtgtggaggtcaccactgcatggggtcctggacactgtacaggacacctggagatgctgtcactcatggaggggtaaaaagctagggaggtgtaacaactgctcatgctagaatgacatggcgggaatcgcgcaagcaagacaaggttgccctgtgggtgaaagttacaaaaagggggggttgattccggttctggatgcgctttctcccggccgcatctgcccagtagcagaaccagtaaagaatccagaaggcagtgaacatccccccaatggaaggatttgggcagagactagctgtcatcacggggaggctgtgagtggggctcatggtcccgtggcccctcctgaagcaacagtgtgatatggggaagaacatgttggatttgaagcctaaagacttggctcctacttttggcttttctgcttgctaattgtgtttgggcaaatctggcccgagttttctgtacaatagggacagtactaaaaatactcgagagagtttttgtgaatgtcaaatgaggcaatggcgaggctcttagctgcagttactaactttcatatgattagtccctggtaaatttccccatctttcccggtatttctgggggagccgcgggaggtggcagctgagcgtgcactaccatgcacagccctctgtgaccagcacctgctgttctcttgaacgtgtgtccctgcccgccgtcctggcctccagctcagctgtctccagtactacacgggacccagcaatgcaacggcagggatggagacggagggcagctgcctggagaaccccaagtattacaactatgtggccgtgctgtccctcatcgccaccatcatgctggtgcaggtcagccacatggtgaagctcacgctcatgctgctcgtcgcaggcgccgtggccaccatcaacctctatgcctggcgtcccgtctttgatgaatacgaccacaagcgttttcgggagcacgagtaagatgaagcgtgactggggatctgtattgtctccttcctcccgcccgcaaagtcctcagttcaagctcatgggcctgtgctgaggtggctttctgccactaggggtcctcaaaggcttgttcaagaaccagttcctggctgctcacagacgtatcactgtttggctaggacctgagaatagattcttcccattctccccgagtggaggacttgggataccccggtgcctggctgggcatcaggctcttgttcccagatggggcctgactgtgctgttatctgtccaacagcttacctatggtggccttagagcagatgcaaggattcaaccctgggctcaatggcactgacaggtaagggccacggcttcccctcctggcctgcactcacagcccttcttctagagacaggaatataacaggcccaagccccgggatctcaccctcccgggaggcacgtgacctgatacgtgcaggttagagaagctggcatgggttcctccaggagggctgcagcagtgcagtgaggagggaaggaaataccaggtggatggcagctgcatgtaactggctggcaggacagacaggcagcaggaaaatgaggagggaggaagacgctttggatttggacctggcttctgagcctgcagcaggcagtaattctctgtgggtcacaggcaggtccgtttccatgagttgcaatttcatctcttgaggaggatactgaaccagaagttctctaaggtccctgccagtgccaaggttttaaaattttatgattccatgacttgaacagaccttcaaggaagtttagaaataaaaagatgacctaatagaagaggggtaaaacctgcatagcccttagcaaaagaagaactctaaatggccactaataaatggcactcaagtaatcaaggaaatgccagttacaccctagtgagataccatcacacacgtaccggtccagataactctgacaatatcaagtacaatagtaactcttacactcctggtgggagtatgagttagtacaaccgtgttagaaaatattttgatctatttagtaaggttgaaaataaacctgtgtcccagcaattccactcctacatacacacccacgcagacgtgtgtatatgtgtatatatatatacacacatcttagagaaattcatgcacatactcatgtcccaggatatatgtatgagaatgtccaaggtggcactgttcgtaatagacataccccctcccccaaaacaaatgaaaacaacccaaatgacatcaacaggaaatggatacataactggtatattcatgcagtgaaataccatacggtaatggaaactaaccacagctccacataaaaatatgtatgaacaaggtaaaaagccatggtgagattgtaccccagtcccatggctatgaaatcccatcactgatgtctcttgcttctccaaattcctgcatggttgtagctacctctgtgatcagtcaggcaatgcagtgtttcttaaatacctggggagcagccctgatgtgaataccaggtgcagccaggaggggccaggggttgcctggctgttggagaggagcccagtgagttaagaaaactttactgcccgggggagcccgacttgatgtgaaagggcctaaggagccggggtgagctctagggctggggtggcaggaagcagcaccatctagttggagggaatcaggccccctccaggaggcagatgacagccctttcagttgcacacgctctgcccagcaggctgcccctggtgccttccaagtactctatgacggtgatggtgttcctcatgatgctcagcttctactacttctcccgccacgtgagtgccgcctgcacgatccccgctctgtgcccacagcccacagggcctcctgagaagcagccccgggacctaagagcccaagctcctaaggaatggggcttcccttcacccagccccacacgtgagcctggtcaggccaccgccttctctattcaggctccttcctcagtcacacaggaagacagttcctcacctcttccgtccgaccccctccaggatggtgaaggaagcatgggagtgaaggtgggaggggatagagtgaaggcacaaacatcttgaatcaaatcaatatcccctaggccaggggctcatggcccccgcactccccgtggcgctgagggacattaacacaactgaccacagagccagaagagaaagagaagggagctgatggactttctgttgggttaaaaggaaaagagaaggccggtgcagtggctcattttgggaggctgagggtggaggatcacttgagtccaggagtctgagaccagcctgggcaatatggtgaaaccctgtctctactaaaaaatacaaaaattagccaggcatggtggcccgcacctgtaatcccagctacttgagaggctgaggcaggaggattgcttgaatctaggaggttgaggctgtagtaagctgagatcacaccactgcactccagcctgggtgacaaagtgagacaccccccccaccccgccacaaccaccgcactcaaccggacaaaaaaggaaaagagaaggaagagagggaagagaaagatcctctgtacttagggcccaatgttagttcaagtgccccctactggctttccagggaagtacagccttcccaagccacttcttacccaaatggcgcctgctagaaagggggactccaccctgagttgggagatccccactgctgccacctccacgagacagacctgcagctgaaattaggtcccaagaggccccctacacacggaaggcctcctggatctctgctgtaactacggaggctgggaaccgcaccactattgggtggccttttgatgaggtgcaatctttgcagggtcttacttcccttgccatttagccatcttccttccagcctttccaaggggagttcctccattcacgttcctgtttttcttctttttttgagactgagtctcactcttttgcccaggctggagtgcagtggtgcgatctcggctcactgcaacctctgcctcctgggttcaagttgattctcctgcctcagcctcccgagtagctgggattacaggtgcccgccaccatgcccggctaatttttgtatttttagtagagacagggtttcaccatgttggtcaggctggtctcgaactcctgacctcaggtgatccgcctgcctcggcctcccaaagtgctgggattacaggcatgaaccgccacgcctggccattcctgtttttcatccttctatccagtggccagcttagagcacatgcctcgccttgtctgtgtctgtaggtagaaaaactggcacggacacttttcttgtggaagattgaggtccacgaccagaaggaacgtgtctatgagatgcgacgctggaacgaggccttggtcaccaacatgttgcctgagcacgtggcacgccatttcctggggtccaagaagagagatgaggtgaggggtgtggtctcagcccggaaccatgaggccatttgtctccatctgttctttctttcaggcagcccccgctgggcccaggccttctcagggacaggggactggggcctaggtagggctgaacctaaacagcaaacacaaataagcaaaagaggaatttctccggcctcttataaagtgcactgctgtaggcatcgtgatgtgggccgtacagctctgaggccatgtgtcagaagacaagactttggctagagcccacctttctgttgcctgtgaacttctccaaacagagtggttcccagctctacggtaccctcgtcttcacagctggggctgttagaggaactagagaagctgttttaaaatttattcaaagtagtggctgggcacagtggctcacgcctgtaatcccggcactttgggaggccgaggcgggtggatcatctgaggtcaggagtttgagaccagcctgggcaacaaatagtgaaaccctgtctctactaaaaaatacaaaaattaactggacgcggtggtgcacacctgtcgtcccagctactcgggaaactgagacaggagactcacttgaacccaggaggtggaggttgcagtgagctgagattgtgccactcaactccagcctgggtgacacagcaagactccatctctcaaaaaaaaaaaaaaaaaagtagcgatgagctatttttaaattattcagagttggaataatctacagccgggcatggtgacatgtgtctgtggtcccagatacctggtgttcaaggccgcagtgtgcttcgatcatacctaattgtgcttgtttactgccactgcactccagcctgggaaacacagcaagacccactcttaaaaaaaaaaaaaaaaatgctggaataatctgactgatgtgtgagtccaaaaagctgagtgcacatgtcatgcatggaagatagatgcatttctccaacacatcatccagtcagtcggacatgctttgagcacgttgtccgcacctctttttaggagctgtatagccagacgtatgatgagattggagtcatgtttgcctccctgcccaactttgctgacttctacacagaggagagcatcaacaatggtggtattgagtgtctgcgtttcctcaatgaaatcatctcggattttgactctgtgagtgcccatcccaccctgcactctggccatgaagccggcccattccacatcacatcctacaataggctgcagaggccagagaaactggcttcattttcccagataagccccttccgcaatacatggacttctgcagccacctggaactgctgggctggggaaggggaggtgaggtgggagcccgggaaatcacccacagggtcacaggataaggataaggactggccaagcaacatctcgagacctctctgtcctgggactgtctcctcaaattcagagccggtcagcattgactgggtgacctgtataccagggagaatgcttttacacacgcgcggagcccccctaggagactgccgattttatgtcagtgttgaggttgtggaaacaggcccagaaagttaggaagttctcccaggatcatgtggcagataagcggtagactaagtaacaactttgataggaaagtgtctcttgggtttagtggggtccttgtaaacaggtacatctgtcactgggttgggtcattcctctcccttgactgctgacaattctttcctgaatcctggcctcagctcctggacaatcccaagttccgggtgatcaccaagatcaaaaccattggcagcacgtatatggcggcttcaggagtcacccccgatgtcaacaccaatggctttgccagctccaacaaggtagctaaccccagtagccagagagatgaggctctgcccccaaggcaagagattggcagcccagacctagcatgggggaaataagaactgctgtgcaaagtggtcccagacacacaccaccagcaccacgtaaatataaataagaaatagggtttattgagaaagttcggcaagcagagaaacagaacagacacacaaccccctgctgttcacagctcaggcctaagatggttgtgttctgtggccaggccccctaaggctctgtgctttcataggaactggagagcaattgtcaacaagggaaactgaaagcatggccttcagaactctggctgacggcagcctgttcttttgttaagctaatttagacctttgttcagctaccaggagagaaaattaggtgtaggagccctggtcccaagctctggtcttaaaacaccatcatcctgctttacctctacaaccatcccacggccctattatatggatgaggttaaagaaacacgtccaaggcgggtcatccccctccagtgcttatcacctagttgagggatccaaacaaggacaacctgacaaaacctaaggaccaggaccaggcccagccaaggtgaaggggtccgcctcgtggtcagactcacaggtccgtctcctctgctcaattgcccagtctttgcctagacctgctacgtgaactttgtcacagtggcaagtcagagctagcgtggctgcgactcctttgtgggaggaaaagtaaggccttgaacatctaggtgtagggaatccacccccagaacactgccagggaaggcagcagagcaggctgctgcagtgagcggcccctgacactttctccacggtcccctggcacaggaagacaagtccgagagagagcgctggcagcacctggctgacctggccgacttcgcgctggccatgaaggatacgctcaccaacatcaacaaccagtccttcaataacttcatgctgcgcataggtgagcacccccagctggcctgccccgcagcaggctcccttcccatgcaggggcctggcccaccaccaggagagacatgaggctcaggacaactgaggcaattcgggtggggaggttcacgcactcacagggcaaggagacctgaaagacctttagtccagacgactctagatgactaaaccaaaaacccagctgatgtgatgatccgactatactgtgcctactgttacaatagaagcttggcctgcctggctgagaagtgagtttgtgatccatttccagaggggttgctgtgcctgctgaggacatggcttcccagacaggcctgctctttgaaaggagttaagatcacctgctgcttctactgagggggtatcattcctgagtgaggtcccaggagacttgaaataccagctgtgttagaagctggccactaccatgccgagtaaatctgcatatggggggggggtggcggctgacacctaacaagcacacggataaacaggagatgtgatttccaccctccaatagcatacagccaagttgaatgaggacaatgatgtgttacattaggagctttgtggtacaggtctggagaggagatggcttctgaggcccataacaaggtgtggcctgtggctgtgctgaactttatgcctctaccctaggcatgaacaaaggcggggttctggctggggtcatcggagcccggaaaccacactacgacatctggggcaatacagtcaatgtagccagcaggatggagtccacgggggtcatgggcaacattcaggtatgtccagtggcacagctggcacgtgctcagactcggcatgagaacaaaaccggaacagtgctttcccacgtgcccctgcctcccaccctggccctgaacagtaagtccagaggcagagacgtggggcaagtggaaaagaatctctgcaatagctagcctcagcacaggaagaaacacttccacccatccacaaaatctgggctgaagttctagatgcatatggcctacctttgggtatgaaccttctaataccttgtgatctgtctcagtggcgtctggcagaaaagctccacgaaaggggcaaagggacagaagagcaggcagtggcagtttccaggtaacagtgctgccacccaggtgaccatggccatcctaggagagaagtctctggatgagaggaggcccccagccagtcactccagggttctccttcccacccgctgctcgccacgggtggaagggcttggccctgggaggtttggggagtgtcccgtactgcttgggacccatggatcagtgctcggctccaaccacccaaagcccccacccgccctcagtctaggctccccccgtaacgccacgttcttgctccccctccctctccaggtggtagaagaaacccaagtcatcctccgagagtacggcttccgctttgtgaggcgaggccccatctttgtgaaggggaagggggagctgctgaccttcttcttgaaggggcgggataagctagccaccttccccaatggcccctctgtcacactgccccaccaggtggtggacaactcctgaatggcctcgagcctgcaacagtccaaaccggaagggagaatttattttttgaaactgaaggaagtcccgaccttcctggattgaagtgcacactcatggactttaggtttagaaacctcctcagccttcatttgttcgtggatgtgtgagctctgagggtggccctgctattcctctgtgtgcctgtagtgtccccagcataggggtcttaggcatagggctgaacagtccttccagagccctcgttccaatccctgccgtccttgcccctgaggggccctgaccactgtgagcaggagggtggcagagctgggacaaagctgcctttgccgctgggctttccgggactgtggagggagcacaggcggggaagctccacttcagacagggcttggtggggcaggacatggctcccattttgaagggaggtctccatgtggtccgagtgaggtgagacggccctcgtcctggtgttcctgatcatcttgaaaggttcttctggaactcctgtccccttagtcatgagaacagaaagtgcaatatttcctttcacctggcaggggaggggggatttatttctgaaagaaaaatatataaacagatcttctacatttatatttttaatcttctgttaaatacactttccgatattgccttgccttttgagctcttgctacagtcgcctttgctactgctttaagagaatttacaggtattgataaagaacaagactgttttattaaaagctttattcaacttgaaagtgattgtggaaattctgttaatatcacttatctgaggagtgctggtactttgctgactcatgccactggtccccaccacaggcctggaaggcaagagcttgaaggtctcatcatagctcactgtaccccggaacgcctgctgcctggccctgtctcttttattcttaaactttcttctaaagggtactccaagctggctttaatcccctgcactgttcctggagctctcccacacggaggttacttcgtggccattgcagggttaagtctgaacgtggccttgggccagtcatgactcctatctgtgcctgggcaagggagggctacaggagaacctggtcagccagacacaggttttcatatctgtgagtgacccacacgccaaggaaccagaggtgccagcaggtcagaggcccatggttacggcaaatcaggacactaaccggagagcctgcaggagagggaagacccggggggcgcctgagtccccctgagtttatgggcagatttctaactaactgtgctttttcagaggggacttcctagtacattcacagctctactaaacttttaggaaacaaaatatgagacacactgaactctgattattttatcctactgctttctcacaccatatttataaagcagtggcctagaatacactgcgcctaaccaaacactgaagaacttccttttcaaaagtttcaaacaggaaaatgaggaaaaattacttaaagctttcataaaagctaaaaatactttccttttttaaaaaaaaaaatattgggtcttccttattatcttcattagtgaatgtgggttatttttccatttatttagatcagtgtttctcaacagaatcaagctattgcagtttgagtggagtgctacatttctgtgagagccctttctgaaaattttaggatttttggcatctctattcctggcattaaattagtagcagttactgtgacaacttaattgcctggtctttcccagaagttaatgccctcaataatttgatatttttccataagtacttcttgagtgatacacctttttcaaaaaatggcttttattgccccacaaatgattttcaactaaaatgtatgatcaactaatacctttaaaaaacatcttgagcattttaagaagggaccaggtgatcatgggaattgttcaaaaatgccagtgtctatactcaaacctgctcttccatccagatgaacaggtaggtgtctgttttcatcagaagggtgatgtacccttcatcagacagtactacccacctggtactgtcttcagtactggttacttacctctgatgtgctcccagtgcagtgaaaacaatctattaggagaccagactcatatccaacttttctccttttcttgtaaatgaggcaaacacttgatgcaagggcttcgtacagaacagagtttcatgagatgctcgttgctcctcccatgaagtggataatacttccactcctaaaaagaaagattccatcaatctcattcagtgcagctgggggaatcggagcctggatcactgatattcaatctcattcagtgcagctgggggaatcggagcctggatcactgatattcaatctcactcagtgcagctgggggaatcggaacctggatcactgatattctggacccactggacccatacagttttttttttttttttttggtctggactaaggctgccccttactggaccaatgcaatctagagactggggactggaatctaactgcgcagagaaatcaaagaccgatggtgt

SEQ ID NO: 13554 - DNA, 11713 bp, Human
acacctgtaatcccagcacttcaggatactgatgtggattacttgagcccaggagcttgagaccagcctaggcaacatagtgaaaccctgtctctaccaaaaacaaaaacaaaaacaaaacaaaaaaccaaaacccaaaattagctgggcatggtggcatgcatctgtggttccagatactcaggaggctgaagcatgaggatcacttgagcccaggaggtggaggctgcagtgagcagtgttcacactgctgcattccagcctgggcaacagagtgagaccctaattcaaaaacaaacaaacagaatgagagagagagagaagaaaagaaagaaggaacccagttaaagaagttgggtccatttggatttttcctggtttgttttatctgctgccaccagcagcctcctgaagttacaaaaataacacaaagtaaaataaggcaaaaccaccatctgcttgaaagagtttacaaacctgatggtggtcgtggggtggatggaagattaaaaaaatggggacagaagtgaattagtgcaagccacttgcactgacaagatggggatggacttctgtggaaggcagaggaggtcatgcctcatgcccctggtaggaaaagtggccaaagagggcttcagagaacaggggctgatggatgggctacatcttgatgtgagtcaagctcctggatggctggagagaggaaggatgttctagttgggggaacagcttggacaatggagacccaagaaagccatgttctagcagtgtgaatgttgtggatgctgaagtgccaggatgcaaggtggagaactgggaaatggccctggaaaggggccaaagccgggtgatgaagcaccttgtctactgtgacggagcttggatctctcttgtggtccaaagggaaaggattgctgaatgtaaagccaatgtcaccagaaaagctgaatccacaagagagtcctggagtccaaaagagcatctcatggggaatcaggaaagttctggcatttggcagattaagcaagtgtcttgatttgaagtccagtttagtcccaatactccctcccacacccaccacatcgcacaatttggttttgtttatttactccaggttaaggtagagtctcttagcttggtttgagtgctgtactcttctctctggtctgatatttggaactaaagccaagccagaactccagggccaagggggatgttgaaaattgtctgagtccccagaccaccctgccagctcatggcaaagggagggatcagaggccacagggaaagcacttcagctgctcttcacagcatcaccctctccccatttaatggtttaggttaacaggactttttccttgaggcttgggacacggaagggagcctcccctaaaccaggcccttggagagcaggccccaggggagcagtgcaactcaccttcacacccacaagacggctcctgacttctgctccctcctcccctccccaaagtggaacagagagaatatgattccccacgacttccacatcacagtttccaaacaatggggaaatcggaggcctccccgtgtgcagacggtgatatttaccgccaaatgcgaaccaggcagatgccagccccagcacgcacgcaggtaacttcaccctcgcctcaacgacctcagaggctgcccggcctgccccacacgggggtgctaagcctcccgcccgttctaagcggagacccaacgccatccataattaagttcttcctgagggcgagcggccaggtgcgccttcggcaggacagtgctaattccagcccctttccagcgcgtctccccgcgctcgtcccccgtctggaagcccccctcccacgccccgcggccccccttcccctggcccggggagctgctccttgtgctgccgggaaggtcaaagtcccgcgcccaccaggagagctcggcaagtatataaggacagaggagcgcgggaccaagcggcggcgaaggaggggaagaagagccgcgaccgagagaggccgccgagcgtccccgccctcagagagcagcctcccgagacaggtaagggcgcagcgtgggggacccgtgctctttccccgggatcccctgtccccgtcctcgcgatgcagtcggccggctccggctccgaaggcggacctgggcgcctctggctctccgcggtcccgagttctcgacaaactttctgcgccgactgcggcatgagaagccgccagtagctgagctggagggcccacgtccggcccctgggcggacggccgcgaagctgcaggcgctgtctccagggagccggcggcctcctctcccccaggggctcgcggcggtccggaggctccgagagcttgctaggaggtcttgggacaacccggtctttttttttttttttgagacggagtttcgctcttgttgcccatgctggagagcaaaggggtgatctctgctcaccgcaaccttcgcctcccgggttcaagcgattctcctgcttcagcctcccgagtagctgggattacaggcatgcgccaccacgcccggctaatttttgtatttttagtagagacggagtttctccatgttggtcaggctggtctcaaactcccgacaacaggtgatccgcccgccttggccccccaaagttctggcattacaggcgcgagccaccgcccccggccagcccggtcttttagtatctcttgctcccagtttccaggataggtgtcacatcttgaaagtcaaattccatacacgctatcgcaaattaatgttggaaacggggcagcagagaaaaggataaaagtcataatgaacgccctgccttccggattttttcggattcagacccctgaatccttgtttccttgcccaccttagcgcacccgaggtggccgcgctatgataattacatgataactgggtcaattacaatgcagaatagttgggtctcttctctccaagacctagctggggttaaaaacaggtggccggggcgggagctgtcctagatcctgaaacgcactgtctagtttcggatgccctcaacagaaccggggtggacggtttatggcgcagatcctgggttgagggcacgggcagccatttggaatgatcaaggctcaggtaaggggcgtttccagcgaaggagagacagtccacttggcatttggattccccaaattcttcatgtttaaatggggcagggagggttcttacagaatggctggaaggagccaaggaaaataaaagtgtgtgtggattttttttgtgtgtgtgtcagtttataaactctgcacagattatggccactttaatgacttactgttcctttgatgcttttgttataggactcgatgcatgtatgtcatggtgtaaggacaaaactcggcccctgtgctcctctaatctttacaaaaggtcatggccagcgtgcagttttacagtaacaagcaaaatgatttgttgagctcatagagagcccctcacacctatgaagttctaataagtgtagttctactataaagttaatctcaggatgagcaaatttcaagtttctatttttccagagctttccatttttggattataatactttccctacttaaaaaagcacaacatttgatatttccccaataatttgttgctttaaaaatgacacaaaaggtactatttgttcattgtagagaactgaaaatacacataagcaaatacacatacacataagcaaaatatacaatacaaacacaagaccatctttcagggaagaatctgaagttttagcaatagcagccatctaaccagtttagcaacagaatataagctctgagagggtgggagtgaatatgttaccacattgtacaacacagcacatagggcataaggaggggaaatgctctctggggctttccaggaaggcctgaagtcattgcttctagcaaatggaaatcactccagagtagttatctttgacaagaattgaaatataattgagggaactatcagacctgtaagattttgttttttcctttactaatatgttactttacatttgcatttggtgacatacgtaactaccatttttctgtgactgtaacatctgggcatttttcagagctaaatgtgctatggtcaacttggagctttaatctaattgcctggtccaccaagttctggctgtgtacttgaatagatcactggcagggtacaatgggaacagcctgtcccttggagccaggagaggacaccaaggttgaccaaagctcgttcagttgcccctttagccgaagcgcacctgggccagtcactggctgccagtgccatctaatggctgctctgaaaatgctcagccttgcccggcaacccttcagaagctagcaccgtgcaggcccagcgcctggggaatagggcgagggtggggtagagagaaggaagtggcctcctgaagtagaaatcagcgcttcagaggactttcacttccaaagcctcccctatataaaaaagatttggcccacgcctccccaaatgagagatttattttaggcaaacttattttaaaatgccagcgttcattaggagtgacaagacacttagtcatccacgctttaatgtgaattacttttctcatctaattacatttctttctagcagctggctgagaagatcttctgaaatccaaaatgattgtagggttggcggtgagctgatctccggcctcgaggtggcttcagggggcccacctggttaagggaaatttggcagtgcgagggtagtgctggagagaggggtgggtacagggggctaggggcaccatggatgccccctccttactgtcccctggtgtcttgacctcagcttctgcccacaggcacttgctggattctccaaaagtatctgcagtggctgttccaccaggaggtaattcccttctggtctctttcccctccacatctgcatcctcttcaaatcctgccatttcagaccacatttgagagctctagagaacaagacatctgacacgtgacgtgtccagaagatgagccagatttcaaagaactgagatctgctttaaaaacgaagctctccaaagttactggagtctgggtaatagtgatcaccagagtaatttgtgtgcaggacatcaaatcaggctgctcgaaatgctgcctaaattggccagtggttttatttgcttttctgtcaacctaatattcataggaaatagagtttcagaggaatgataggatcctggtggaataaaaagggaaaagaccatcttgagcaggagtttcagggtcctccgtttttcccaagttactttcactcctgagatcttgcatgttagaactacagcttaatgtagtgaaataggaaagttctctgttaggagcttagccttaccttgtcatggacattaaagtaattgtctctctttgggcttcaattttcccatctctcatgggaagggctgaaccaagcaatccccaaaatagcttccagccttaacctttttaggggtctcgtttaaatagaagataacagggaaatggtcacagtttacccaggtccattccctcctccttatcacaacttataccaccgctgtactgcacacctcctttctcagcattgctgctgtccttaaaatgcctttaactccacaagagagtgtgttgttaatgttggctcaaggtccttcctggtgagtggccaacattgttttgctccttgcaggggtcccaccaatcttgtttgcttctgcagagcctcagcctgcctggaagatgccgagatcgtgctgcagccgctcgggggccctgttgctggccttgctgcttcaggcctccatggaagtgcgtggctggtgcctggagagcagccagtgtcaggacctcaccacggaaagcaacctgctggtacgtgggccatgactgccatcttggcttagacattagatgggactggagctgggaaagctcaaaagaaaagggtgtggggaaagggaaattcattcccagtgataggcgtgattcaatccagggcaggagcaaaactttgcagtgaagtaagaaatgggagaagaaatcagggaaggaagcagcttcagggagaggggttgagtccacaatttctgcttggttatccttacttcttgccccatcttttatggagaccttgaaccctttaagctagagatggtgctataagagcaataatggacccctcaatctattctgtactttaaatctttagcttcccaaactattcctttttaagaagctcatatcacttgccattttcattccatatttcttacccttttatctactaccggttgcaaaaccagccaggtagttcttcaaatcatctctggaagaaggaaaaaccaggggcccttttttttttttctttaattggtgccaaatgtctcatgtttattctggaggactggccttctgctgtgttcctctacagtctttccagagcatgtgaaggccctttgcatcaggcaggagctccctccaggtcaccacagggtgtatgtatctgcctgtggggggtgtgtgtgtgtgtgtgttggggggcataaatgagtaatgatgccaaatccagagattaaaaggcacactgagaccaggcgagatggctcatggctgtaatcccagcacttttagatgctaaggtgggaggattgcttgagcccagggattcaagacaagcctgggcaacatagtgagacctccacttctacaaaaaataaaaaagttagccagatgtggtggcatgtgcctgtagtcctagctacttgggaggttcacttgaggccaggagtctgacgacacagtaagctatgatcacaccattgcactccagtctgggtaacagaatgagaccttgtctcaaaacaaaacaaaatgaaacaaacaaacaaacaaacccccatactgttagtgtcagtgaccggaattttaatcttgttgccatcacctggcaggtgctgagggtggaatgtacataactacattctgtgtattttgtcaatgcagaagctgagttaaggtgaagatagaatgaggtcctcaaagacacagaccagttttcatgtgtaatataaaatagaaacaaagagcccaggggattctgtgagttccagtttggaaagacccaagagtctcttgacttgagacacccacagcacagctcaccagggagggtgcactggacacagtcaggacccatgggttctagacccagttttgaggtgtgggaccttgaccaggtcctatcacctctctgagtctcctgtttcactatctgtccacgggaggggagtgtaaattagttttttccattgttaacgttccacagagttgtaattctgaacacctggagtaggcaatgtccagctcaacagagtgggtaggatccttttattttctcctttgctattcccaagaaagagagcagccagtgagcttttcatctttttatcactgaaaactcaaggctgcagcctatgcagccattttcctaagctaatatgtaccacaatagagtcctctagggacaaggagcagagacacaggttccacagacggtgcaatggaaataacgctagctttccacccctccctccagtcagaatgagattacagggaaataagcttgccccagagctcactgggggatctctcagaaatcagctcagaagtcgtgaaagaaccaaggtgcagttttggaggcttagtgcagagatggagctggggtagggcataaagtaggttttccatcactgaggtaaggttgaggcattattttttattttttgtttatttatttatttttttgagacggagtctcgctctatcacccaggctggagtgcagtggcgcgatctcccctcactgcaagctccacctcccaggttcacacaggttgaagcattattaaaaatatgtttaaaaatatgggccctagtagccagacttctatcacctggagagattatcccccaaatttcagccccactcccctcctggacttgaattaaaccatatgtatttattcaatattctttttatttatttatttatttttttgagacggagtcttgctctgttgccctggctggagtgtggagtgcagtggtgtgatcttggctcactgcaacctctacctcccaggttcaagcggttctcctgcctcaggctccagagtagctgggattacaggcgcccgccaccacacccagcttatttatttatttatactagagatggtatttcaccatagttggccaggctggtcttgaactcctgacctcatgtgatctgcctgccttggcctcccaaagtgctgggattataggtgtgagccaccgtgcccggccctcaatattcattaagtgccaacaactaccacccgtctgcctttcttggagccactcctttatgtcaggcatataacagtaagactttggtcctgttcacaaaagctaggggtggctagatggctagacaaaccatggaatgggatgggaagtgtgttgcagttgccaggcagaagcatgaaggggatgggacaaaagaggcagtggcaagatcttagatgcccacgagtgccaagaaagcaggtgggcagacctgctctgtagggaggcctcgacgcttgacacgcccgacactgtgccctgtgtcctcggcacgtggcgagggcggccagggcctaggcgcagtgacgggcgcggcagccgggccggggtgcggggcacgggctgccctcatgccctcgcgtcttcccccaggagtgcatccgggcctgcaagcccgacctctcggccgagactcccatgttcccgggaaatggcgacgagcagcctctgaccgagaacccccggaagtacgtcatgggccacttccgctgggaccgattcggccgccgcaacagcagcagcagcggcagcagcggcgcagggcagaagcgcgaggacgtctcagcgggcgaagactgcggcccgctgcctgagggcggccccgagccccgcagcgatggtgccaagccgggcccgcgcgagggcaagcgctcctactccatggagcacttccgctggggcaagccggtgggcaagaagcggcgcccagtgaaggtgtaccctaacggcgccgaggacgagtcggccgaggccttccccctggagttcaagagggagctgactggccagcgactccgggagggagatggccccgacggccctgccgatgacggcgcaggggcccaggccgacctggagcacagcctgctggtggcggccgagaagaaggacgagggcccctacaggatggagcacttccgctggggcagcccgcccaaggacaagcgctacggcggtttcatgacctccgagaagagccagacgcccctggtgacgctgttcaaaaacgccatcatcaagaacgcctacaagaagggcgagtgagggcacagcggggccccagggctaccctcccccaggaggtcgaccccaaagccccttgctctcccctgccctgctgccgcctcccagcctggggggtcgtggcagataatcagcctcttaaagctgcctgtagttaggaaataaaacctttcaaatttcacatccacctctgactttgaatgtaaactgtgtgaataaagtaaaaatacgtagccgtcaaataacagcagcatggatcggaggagcacagtggtttccatgcggtaggatatttcacaggacttagtgagcgtgaaaggaaaatgtgcttcctgcccccacccccaaatggatcttcgagggatcagatagtttgggtgaaggcacagggtggctccagcacctctaggatggccgtattttccacacactccactgagtgggagactgctcagctagcacacgtgtaaaggcaggattcctgcaagagtgaccccgggcgctcaggggctccccggctccggtccacctccaaaagccagttggacaggttgaggcctacccacgcctgggagtgctctggactgtcaggtgagaagtcttggtaatgtctccggggaactgctcgtagcaatccatgggaccttaggcaagtctctgaacttctccaaaatttagttctttcatctacccctcccttcccagtatgagggttattgtgaagattaaaggagaaaatggacataatcttctttttatcatagaagctaagtgtgagagctgagggttagtatcagttccaatttcactcccaggctactcacagatacgctcagacatacggtctctctcacacacacacactcatggagacacacatctgtttaatacaacatactctacgcagttgcttcttccagcccctagggcttaagccctgactcaggccctctgacccctcctgccgtgcccaggctcctccctccccgcgtgtttcagctccagcccttctcatccttagtacttcccccaggcctctctgataacagcttcccaaccaactggtctcctagtttccagctgctctccccagcccatcatatacgaattcttcacgttagtttacacaaaatcttgctttttcccacagtcccaggctcaagagtcaaaacagtgcccccaccccaatttctgtcaattccaaactactaagcatggtgggcagggcccttgtagacgggcactctctccttaccaaaccctgcttcccaagtttccccggatgaaggcgctgcctcacactcgttggtctcctcacaggtctcgcatcctcctataccctctgcctggaaccccccaccttcccctgccattttgttgtcattgttgttgtttttgagatggaatctcgctctgtcacccaggctggagtgcaatggtgtgatctcatctcacttcaacctccgcctcctgggttcaagcaattctcctgcctcaaccttccaaatagctgggattacaagagtgcgccaccacgcccggctaacttttgtatttttagtagagatggggtttcaccaagttggccaggctggtcttgaactcctgaccccaggtgatctgcccaccttggcctcccaaagtgctggggttacaggcttgagccactgcgcctggccagaaagccagattcttaagacaaggtgttccccagtatggcttacatggaatgtgctagaatgaataatggcctaggccttcctgaggatgctcccatgctgggcatgctgggcctgaggtttccatcttggtagcctcctttcccccacaccttctccctctgagacaggtaaagtcatggttggtggaggtggctaaatgtcagtggtatactgttggtattttcagatcccgtttgcttctcaaaaaaaccatttactttaaagaaatcaaacagacagccatgtggtgacaacattaacatttatttgaaaagggcatcgtgatggctcactgggagatcgcgactaatagtcctagagaatgattttgctaagaatccttcttcctatacttccccccactccgcctttcccacttccctaaaataaaactaaccaattcaatgggtttaaaatacagaaaaccgccacgggcactaattctgcactcacatataaatacaccagctattatatacacatattgtcaactacaaactatactacacacacatgcacacacacagcc

SEQ ID NO: 13555 - DNA, 17021 bp, Human
agggcagagctgtggccacaaaccatccaggtacacagcagaagcagcctcaaaaagcttggaagctctgcatgatgcaggaaagtcataaaatcattacagtggtgacttatgtgtttatagcccctttactgtctataatctgcaaatgaactcacacagcattgggactttggaagaattatcacccttaaggtttaaattaaactgtgaatttcagaatttctaataaggacacaacaaagagtgaaagcattgctatgtctattctgcttgcccagaatcttggtcctaaaaaatgaagagtgtttgggtgtggggaggagcttcagtgtgcatgtgcatgcaaagtacctactctaaggagaagaatgagagggtaccctaattacctgttaatatgtcccataggacaccaaaactctagttagctgtttctctatgatcctctaagcacatccccaagtatggctggccagtgatgtgtatggttcaaatgttgggatctgtgcagttatcttggaattgtatagtacagcagtatatcccccccaaaaagagtgtaatacttccaattctggctgcacaatacttgccccatagtccatggtcaataaatacaaatttgagttgtttttgctcatctttcccttttgacttcaaatcagtcatcagaatttccccaaatgcctttcccctggatcttgggccagtggaatgagtacaatttaacttaattgaatttgcttatctatttggtttcctgttgtgaacaaaagttctctgaaaaggaatttggaagaaagagactttgttctagtgaacagtttgcaaaccagggagttacagcctctggtacgcaatgaaggtgagttccacagaacacaaggcaggcaggtttcacggcaaaaagttccttcccaggttcccaatcaggtccatttatgcaaatgaaggatggaaacttgcttagttcttattggtcactgcagctgcattctgattggttgatgaagctgagccctgagtggctgaggtgggtgagctttaattggttggttcaggtgagcgctgaaaatctcaactataaaaaggtacaggttttcaggatactcagagtaaccgtgtgacctgtagtaagcaaagggccagttggctctattttaaatccaggcccagttagccactcaagatctatcttacaggactggctctttcaggttcacactaataaaggcctgtccttggggaagacttctgttcacatgcgctccagtgaatttccctttctggtcattctctaccccagcacgccccccacccccgacccgccccacccacccacctgttcatttccttcttagcatgcttcacgatttctaagttcctgctcatgtgtttaaattgtgagtctggctcacctcatggcgcgtgctcgtgtggtgggctctgctgcagcctcaagaccccacactgtgctggactcaataaatattgttggacgaaggaatgaaacacatgatacaagtgagcaggcagtaccgggggagctgtggagtgggcactcttacaggtttccatggcgaaagcgggggtacagttgtgttcttttctttctaaaaggctttctaaaaagccttctgtttaatttctggaaaagaagcctaacttgttcactacatagtcgtccttcttcctctctggtaacacttgttggtctgtggaaatactaatttaatggatcctgaggttctggaagtactttgctgtgttcactcaagaatgtgatttgagtatgaaattccagccagttcaactgttgttgcctattaagaaacctaataaagctccaccttctttatctctgaaagtgaactccctgctacctttgtggactgacagctttttatagtcacgtgacacagtcaaacattaacttggtgtatcgattggtttttgccatatatatatatataagtaggagagggcgaacctctggcaggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggtgtgtattggagtgggacttttacatgcgtatattctttcagatgtattactttggatcgattaactagccccagatatatgctgagcaagcattctgagataatttaaaatgccctcttttgttaatttttgactcctaggtttgagtctgtctttggcatcatcttctggatgatttcttggtatctgagatttcgggaaagcattccttggacattttactctgtgtgctccagtggatagtaatcaattagaaacaacaagctgttaaatgccataggcacagaatgctgggtttggggcaccctgcagaaaactcagttgaagcctgcaccttgccctggattcagtcaggcaggcaatgttcaggactgatgaaatcattctttgatgatgatagatcctggaaatgaaagttgcctttgtgaccctggttaaagctccagtttctaaatattctgataagaagctaaatcctgcagtccgttctcttctaatgagtgaatcaccagacagtcaggttctgacatgatacagaaaggttgtaggtttcattctcaagctattaggtttatttttcccctacagagtttgaagtatgcaaaaagtagcattcacatcctcatcgaaatctcagcagaggatagaaaagaacaggagaggctccttcagatggagcgttagggaattactctttgaggaggtgacatttcagagagcgttcattcacttatcctgcaaagattggctgaggatctactggcagcccaggcacttcccaggtgctgcgtctggctcccattaaggggactgatatcaccttcggaggtgaccttatttccactatacctccaatgtgatttgtattttattttttttaattttctgtgcattttccttcatagcacatcaaatatggcagccatttcacttagatagttgttgattgtccgcttcacatcatgagccatgtggggacctgtgtgactttgcattaatcacatccactgtatgcggcgtcctcaacacctgccaatgggtctgcatgtatttggcgccccataaatctcagcacctaaggcacagaataggcacccaccgaatatgtgttacattaatgaatgagaagaaaggtgccaaccgaggtctagttaatgggtcgagagtaatccacaatagctctttttagttctttgtactccagctattacataccaatatgtatatagaaacatatgtaaaattttttggttgctttttctacaaaatagagtaacagtgtattcccactgcccacttaccgataatgtcatggatatcactccagttttaaatgctattactttttaaactatgaaatagtatttcatggtacttgtgtaccacagtgtattctgctggagatctagtctagttccccacagaggaacattacaatttgtattccaggagttttgttgttgtgacctcaaacacttcctttaaaaagataagctattttgtagtttaaaaaacatttgttctgtttctttctcattcatcttttcttaagtattttacacggttttttttttttggtcactactgtgaatgtgttatttttttgcatttctatctctagctgattatctactcattactcagctatctcatcaaaatattgattttcataataaaaaataataggcagtcatttgctgataaagaaattttggtttcttctcttataaattccatgccaaatatcagggctattgaatttattagaatctctaaaaacagttgaataattctggcaataggaaagatgcccgtcttgctgctattttagtggaaattgattatcatttcattattttgcattatgttagccattgttttctgaacaggctttattgatttagataatttccttctttgcgtgaggatgtttgtaggagaggcaccgaactttatcagctgcctttctggcatttattgatataaccataaaagtctaagtggtgaactgtgttgactacatatttgttgttgccttgtttggtgcagtcaggcttaggtgtgaaaatatgtttttaaattgtaccttttagtaacctgttttgtcttgttgcatgttttaatctgaaattccactttttggatattaatattaccacttctgtattatttttgtttacatttccctagcacatctttagtactcctttgtcttcaagctttcttcctttttaaacaacatggcactggtatttttaatccagtcaggcagttgctttaataagtgcattttgcctatttgaatctaacaattaatagatttgattgtaactctctcagtttactttatgtttagttgactttgccattctcctttttccggatttctactggttggtcaagttactgttcttattttctctttcttcctttgttaactaaaaatgccactctgcactaccattcctcttgtgttgatggtcctattctcaatactcttgataaaactcctgaactttaagaataaagataaaacttttattgcacaaagaagtccatagagaaagcacaacctggcattggcgtgtctttggtgtgtctgaaggaaaagagatagtggaacaacattgggagaaaaggaatgaaactcaagaattccaagatgttcctcccctgccagggtaagatagcagtggttcacagacaatcgcaatgctgggtctgagaaaaataactaaacagaagattagtgaggaccaaggcttcgagatggccaggagaggaaagcttgggagcagggaaggttgagatatatgtgggttactgggaatgcgtgatggtgaagtcacagatgacccacatggtgtctaagtgctaaagaagaattctgggaaaatgaaatgcatttgggaagggaaaatctaattaaaagcctaaactaaaaatacaaaattcttggtaaagtttaggagttatgttaaatgtctcattttggctggtgaagtctcatcagaacagggaaattctctcattcaggggcatctcatcttttctttgaagggaatcaatggtgggggattggagtgttattttcagttaatatgttgcttcactctttggtcattccggtaactgtgaagtcagggtgaagtttaagggaagctttgccaagtaggggatggacttcacctttattgagcctcatagtagctggctcaggtaggagttggccgtgatgacaacttctctgcagtttgccctgcgtgaatctccagatgaacttttgtgccatttaaactttcgtgatctcctgctatttaacttcgaatgtttatggacctgtgggttcaattttgtgtgaatcacatcctgctgattgctgagtgggcgtgtgggagggtgtgcctggaggagaacttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcccaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttgggcaagccctgccacatcacacaatcatattagtgccctcagtattctttgcaaacataaaaccatagactcagtaatcccattactgggtatatacccaaagaaatataaattattctactataaagacacatgcacatatttgtttattgcagcactattcacaataacaaagtcatggaaccaacccagatgcccatcaatggtagattggataaagaaaatgtggtacatatacaccatggaatactatgcagccataacaaggaatgagatcatattctttgcaaggacatggatgaagctggaagccatcatcctccacaaactaacacaggaacagaaaatcaaacaccgcatgttctcactcataagtgggagttgaacagtgagaatgcgtagacgcagggaggggaacaacacacaccagggcttgtggcggggtgaggggtgaggggaggaacttagaggataggtcaataggtgcagcaaaccaccatggcatatgtatcccagaacttcaagtaaataataataataataattaataataataataataataaataaacccataaagccatttgagagattcttgggggattcattggaccactgaaaatctacagtgagaaaagaattgccatgttgatgaaacaggaaaactttccttgtccccctcacagagcatgtgacagcgggaggggctcactttctcagtgcgccactgctcaaacctctaggggagcatacagacgggcaggttgtggggctctgacctcaccggcagtgtctagaggtggatgtttacagctcctgaagctccagtgggcgtgggttatggccttcttttagttttgccctctatagtcagcttgtgttaaccagctcaattacaccctctaccttgtcgcaaggacagagggctttctgtatcctgggggcttgccttggtgtaccagaagaatcgaatcccacctgggcttggagaatgagtgcaaggatttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgagttcttctcaatgtccagctgtccttgcgtccctccgctgatgtgctcctcccgatgtccagctacctgtgtgtctgcctgctagggtcttggggtttttataggcacatgatgggggcgtggcaggccagggtggttttgggaaatgaaacatttaggcaggaaaacaaaaatgcctgtcctcacctaggtccatgggcacaggtctgggggtggagccctcgccagggaccacaccctcttctacccagcacttcccttccctacttccatatcatttaaagggaccacgcccttcccagctcttcccttctgtatcactgatgccttgctctgtgttctctaagtggaattatcactgtgtgtatgtacaggtgtgtgcatgtgtgtgcatgtacctgtgcttttcttttggaaaactagcacattacctggattttgcatctcaaggataattctgtaagcaggaacccttcctcctttagaaggaagtaaaggagaggaaaatgctgtaaaacttacatattaataattttttactctatctcaaacacgcatgcctttaatcatagtcttaagaggaagatatctaattcataacttactgtatgtagtcatcaaagaatatgagaaaaaattaactgaaaatttttcttctggctctaggaatttgaagcctacattaatgcttctggagaacatggaattgtggttttctctttgggatcaatggtctcagaaattccagagaagaaagctatggcaattgctgatgctttgggcaaaatccctcagacagtaagaagattctataccatggcctcatatctattttcacaggagcgctaatcccagacttccagcttccagattaattctcttaattggaaccttagatttggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatattaaatagaagtatttctccaaaaagctgttggttagaacactgaatttatgtcttacatttctgctcttatagttctgcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggacccctgttttctagttagtatagcagatttgttttctaatcatattatgttctttctttacgttctgctctttttgcccctcccaggtcctgtggcggtacactggaacccgaccatcgaatcttgcgaacaacacgatacttgttaagtggctaccccaaaacgatctgcttggtatgttgggcggattggatgtataggtcaaaccagggtcaaattaagaaaatggcttaagcacagctattctaaaggattgttgagcttgaaaatattatggccaacatatcctacattgctttttatctagtggggtatctcaacccacattttcttctgcaaatttctgcaagggcatgtgagtaacactgagtctttggagtgttttcagaacctagatgtgtccagctgtgaaactcagagatgtaactgctgacatcctccctattttgcatctcaggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaaggtaagaaagaagatacagaagaatactttggtcatggcattcatgataaaattgtttcaaatatgaaaacatttacgtagcatttaatagcgttgtttcaaatataaaaacaaatacataaaaatctggatttttatttcttctttttttttttttttttttttgagatggagtcttgctctgtcacctaggctggagtgcagtggtgcaatcttggcttactgcaacctccacctcccacgttcaagcagttctgcctcagcctccgtgtagctgggattacaggtgtccaccaccacgcccggttaatttttgtattttttagtagagaaagggtttcaccatgtttgtcaggctggtcttgaactcctgacttcaggtgatccacctgcctcggcctgccaaagtgctgagattacaggcatgagccagcgcgtctgacctggatttataaataagataatttagaggttattattcactttataaaaggattctttagtttctatataatttatcatataatttatttagaattttatttcccccattagatttaaaactccaatttacataaaaagttgccataatagacatctgatccataagtttcctgcacagaaagaaatactccattataagaagcatagtatctttaagagaaaaacaactcaaatgcttagaagtacagctttttgcagcactggaacctgtgagaaattttgtccatggagtttatgaatgaaggagctataagatatcacagacaaagtcttagaataagagcaaaggaaaatttgctcaaatgtggccctgaaaacgattcaaagggcaaatgatttctggattaaagttagtatattactgtcaagctcactggtaataggcttattagaaccttatgggaagaagtggtggccagtggtagatttcatccgacaatagatactgtgtgcatatgtgcgtgtgcgtttgtgcatgtggctgtgctcatgtgtgggtgcacacgtgtgcattcatatgcgtgtgtgtgtgtgtgcgtgtgtttatgagagtgtccattgctttctcccatggttacctcctttagaaagaagcagcagtcaggaagacagatgtgaagagctggagcatgttcagatgagaggagacggaacacggggacacaccagcttgagcaagggacaacaggggaggactgatgactgacttcccacctttgaggtgctaatgtgtgtgtggtggcactggataaaagatcaatgttggctaggcaccatggcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccctgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaaccaggccataataggtgctcaattactattgaatgaatgaatgaaagttctggccaggtacggtggctcatgcctgtagtcccaacactttgggaggccgaggcaggtggatcacttgaggttaggagttcgaaaccaacctgaccaacatgaagaaaccttatctctaccaaaaaaatataaaaaaattacccaggcatggtggtgtatgcctgtaatcccagctatttgggaggctgaggcaggaaaatcacttgaacctgagaggcggaggttgcagtgagctgagattgtgccactccactccagcctgggcgacagagtgagactccgtcttacttaaaaaaaaaaaaaagaaggttccaagaaaattcatcttaaggtttatgtaaaaggaagatgatatttaacatgattcatggccaagtactaatattacattataataatgtttccaaataacattatagatatgtttaaagacagtgtattaggctgttcttgcattgctgtaaagaaatacccaagactgggtaatttataaagaaaagaggtttcattggctcgtgtttctgcaggctgtacaggaagcttagtgctgacatcacttggctgccgggggaacctcagggagcttttactcatggcagaaggcaatgcgggagcttgcatgtcacatggcaaaagcaggagcgagagagagttgggggggaaggtgccacacactttttaatgaccggctctcacaataactcatgaaaactcactatcaggaagacagcactaaagcacaagggatccgaccccatgatccaaacacctcccaccaggccccatctccagcactggggattacaattcaacatgagatctgagtgtggacaaatatccaaactgtatcagtcaacagcgatcataattagtcctgaataggagtgcctttttttttctttcttctcccttttcttttctacttcctcctccttttccctctcctcttcaatctcctcttcattcctgtagcaccaagggttgaagcacctaacccgttttggattgagatgttctgattgggcaatgaacactgtccagaataaacagaaatccattttgcactaagtggctgcacagaccctgcctcatgctaaatctagcacccagatagtttaatgtttcaatgactgaattacaaatatatcatcaccttggatttggcacttacaaatggctgttaatttggccagaggtggttgtttacaacttcaaataggagactattcataatttctgacgtgacattttcctttctttattttactgtatgaaaatataatgaaatttctcacaaaatatcactaaaaagaaaagaagaagagtaggaagcaaggttaaaatatttctaaaatataattttggtctttctttttctcccttccttcctccgtccctctctcctttcctctctccctccctccctccctcccttcctcctttccttgcttccttccctccttctcttccttctttttcaagagatcaataacatttattaagaataagtttcttaattataacctttcaggtgataatagtaacacagcctgggcaacacaataagaccttgtttctacaaaaaatttaaaaattggccagacatagtggtgcatgactaattccagctactctggaggctgaggcaggaggatggcttgagcccaggagttggaggctgcagttagccatgcttgtgccactacactccagcccgggcaacagggcaagactctgtatctaaaaacaacaacaacaacaataatagaaacaggtttcctttcccaagtttggaaaatctggtagtcttcttaagcagccatgagcataaagagaggattgttcataccacaggtgttccaggcataacgaaactgtctttgtgtttagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacacgccttcattgcgtgtgcatgcataaatgcatgagaaaagaaaaataaccagtaatcacatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattgggaggctgaggcaggagaattgcttgaaccggggtcagggggttcggaggtcggaggttgcagtgagtccggatcatgccactgcattccagcctgggtgacacagccagactctgtctcaaaaacaacaacaacaacaaaacaacaacaacaacaacaacaaaaatctcactggacatcctagtagctaaggctttccacatattcatgattacttctgttggaaagtgctttacaacaaattgctagttgtctcagtctgggttcccctgagatgaggattcaagggccaggagtttatttaggaagtaaaggaaacactgatagaggagtggcagagtgagaaggggtgatggtcatccacagctggctctcttgtggtcaatcggagcttaatcctgctgggtgactctgggagccagtggagaaaagacaccccagacttatcccaatgaggaacacggctgttgggtgcctgagtacttgcctcgtcagggattgaaacgtactcccaggtagtagtaatttctctgcccttccattaggccacaaagggggctctgacagagagagctgacgagaaaaaacacacgcccttgtcactgaagaggtacacaggggatctgtgtggggcaccacctgcactgctaccctggacaaatagcttaagaaatccccacactgcatccccaaacttactatcagcgtgtgagggagacaggttcccacaccctcattagcacaaagtactatcttgaaaaagaaagcctgtcagtttgataggagaaaagcaggatcttgtttacaatgtgcttttattattgttattattagagattgtatttcttttcaagctgatgagccgtctgtgtttattttttggaggataccctttgcccactttcctattggagtgtattaccctgaggatttggtaagagtgcttattgcattcaccagaatgtcctttttgtcatttactgtattttctctacttttttttttttgccttgttttactttttttgttttgtattacaagcagaagttttaaatttgtaagcttcaaattggagctggggtggtgcagagcgaagatttcagctggttccctgaccccagctccatctccttccctaggcagtggctggaacacattctgtccactatttccctctctacatccttgaggctgtgcagtcacccctcaactacgttcaccctccttcaaagcccttcctggtccacccggggaccatctcccggcctcactgcccctagctccttgacgccccaacctctctcagggaccccaagttgccatgacctctagccagctcatgttcatttgcaccttcgtgtctgcagcactgaggcac

SEQ ID NO: 13556 - DNA, 23219 bp, Human
ttgtctattttggcttttgttgccattgcttttggtattttagtcatgaagtctttgcccatgcctatgtcctgaatggtattgcttaggttttcttctagggtttttatggttttaggttttacgtttaagtctgtaatccatcttgagttaatttttgtataaggtgtaaggaagggatctagtttcatctttctgcatatggctagccacaaggaaaaaacaaccaaccccattaaaaagtgagcaaaggatatgaaccgacacttctcaaaagaaaacatttatgcagccaacactcacatgaaaaaatgctcatcatcattggtgattagagaaatgcaaatcaaaaccacaatgagatatcatctcacgccagttagaatggcgatccttaaaaagtcaggaaacaacagatgctggagaggatgtggagaaatagtaacacttttacactgttggtgggagtgtgaattagttcaaccattgtggaagacagtgtggcaattcctcaaggatctagaactagaaataccatttgacccagcaatcccattactgggtatgtacacaaaggattataaatcattctactataaagacacatgcacaggtatgtttattgtggcactgttcacaatagcaaagacttggaaccaacccaaatacctgtcaatgatagactggataaagaaaatgtggcacatatacaccatggaatactaagcagccataaaaagggatgagttcatgtcctttgtagggacgtggatgaagctggaaaccatcaatctcagcaaactaacacaagaacagaaaaccaaacaccacatgttctcactcataagtgggagttgaacaatgagaacaaatggacacagggagaggaacatcacacaccggggcctgttggggggtggggggctgggggagggatagtattaggagaaatacctaatgtagatgatgggttgatgggtgcagcaaacaaccatggcacatgtatacctatgtaacaaacctgaaggttctgcacatgtgccccagaacttaaagtatatatttaaaaaatctctctttttctttccctctatattttggttctcctttctggagaaccctgactaagaacacacctgacctctaaccatttatgcctattttatagatgagaaaattgaggttcagaggtgttgagtgccatgcccaaggggatactcctggtacatggtagagccaagatctcagtccaggtctttctgagacaaaacacagcttcttatgcgtgaaatccacaaataagaacacaatgacctacatacaacacaaactgtacttccaattaagtagttctcctttttaatcattcaaaaactaccttgggatcttacagtgcatgggaatcatcaatatgtaaataccttattatccaggtgatgtgcaaaagtgtccagtagcacagaagattggttaataggatggtgtgtcccagctttttactgcacttgtacttgcttcgaatatttaggacccctatataaaattatcttctccaaagtcataatttccaagaagatcttatacccacactattttcataagtagtcaactgcaagatctttagaaccatgaggggatctcaatacacaacaatttaagattaaccattttgttgaatgtaagattatatcccctccaaagaatgaaattaaaatagagaaaaataaacagcacacgtggaatcctgagcctcttgatgccttttgccttgggctaaagttctcttgtgagttgtaaacttcaaaagtgtcctcaaactggaacctttccataggaaaagtcagcagaaaatattgaccccaggatcaattgtttctgtttaagttacagattgctgcagtcaaaataagcagccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtaaggtattcaccaacctggccacctgctctggatcatgcagagccatgctggcgcctgtgtcttgtctcactgtgccccatgtgcttgcgtgtccaggtttcccagtgtacgactacgatccatcctccttaagggatgccctcagtgcctctgtggtaaaagtgaattcccagtcactgagtccgtatctgtttcgggcattcagaagctcattaaaaagagtaagtgcaaaatgaaatcttctctactcctccttccaatgctgtctgccttttgtcagttcattggatatacttttaagaaattttctccagtttaaaaatgatagtagctagtcatctctttcatactgtctcttttctttgacagagaaagatttaattacaattttttgtcatgaggctatccaaaccacttttgatgactgattcttctgctgtattctcctctctaaccttgtcttctggttccctgcagcctgcttttgtacttgaagtcctcgcgattctttctgaggtgttttattacgaacttctcatttattggaaatgagcctcctttcaaattcagcagttctgctcctaatacttactggaaataatctggcttttgagtcaaagaaattcacctttccttgtcaatttggtaatagtctgtttcctcttagctttgggagctaaagaaagagtaatcacttgggcttccaatgactaagtctgtgatatgcaaggaaagaaatgtaaaaatatccttcaaaggaaatgagaaacataagcagcaagtcatctcccttcttcctgttccccaggtaatttcactgccttattatcatctgcatggggctcatttggaggtagggatgaacatattttcaagcaaatttaggttaaggtgggaggtagagaggttctataaagttgcacatcttaggaatgaaggctctgtatagccaggcagcatgggaatgagaatgaagacacggctgaaggtccaggcagcagaggccagatggacattgctttctctctgtctgcctgctgccttctcccatccctcctggactgactcttagcttgttccctctgctactctgtagagcacatggctcatgatttcctagttctagtctccaaatacaacatattcagcttgatcttcctcagaacctggctcctagtttctcttttccaaatttcaagggaaatgaatcaaaaggacccagttttattttctagtttgattatagttcatgaagactatgggctatgcttttttttaggtgccattccagaatcatggccagagtggagtcacttgctctggatgttgtggtgtggaggcactggtcagctgccacaccaaaggttgagctgctcctggatcagaatacagaaccccctttccttgcttgtattgtatttcaaatgccagtttccattggcatttaatgaaatccacttgtggtggtgtggaatcggggtctttttgccaaccttgcagatgaacagtttaaatttacttttgatttagctattgctcaccacagaagaaagttagcagtttattagatgaataagagcatgaggatagatcccaagagaaccaattactgacaccgtggaaatctgccctgtggagatgagctattgtgaggcacagccaccagagcgtgttctggctcatgtgccatcttggtatagtcacccagacttgagcccagacgcacatgcacctaaaaatagatacaattatatgcgatgtgtgtgactcttgatgagcacatgaaaaatgttgcctctccacctcaagtacactgctcctttacctggaggtctgcctattcttgcctctccctgccttttctgattattcaaattcattggtcaagctacagtcaccgtgccctcttgttgagaactctatttcttctcccactggaagggagattctcttcctttgatctctcctggtgatatttttttctattgggagtgtttcatattttgatttatgttgtgtgtattaaccatgtcttctataaacaccctatagatggctccaaatataccaattctctctaccctagcagacatgagggatacactaaaaggcaaagccctcaggagagagttgagtgaatagatcactagcactggggttacaaacaattcacgaaagaggaaatacaaaagactaagaaagatttggaaagctattcaacctccctaatagaagaaaagtgcagaattaaaatagcaatgtgaaaaagaagaataacaaggtaaaagaataacggtgaaaaaaacatcacaactgccgctcgagagtttggaattttgtaaaattgtatttgaaaagcaagttggaaatatgtgttaaacatatttactagcatgttaaacgttaaattagtaaatatttaaaactttcaattgcatagtttcacttctaagaatatgttcaaagcaaataagtggtttagtcatgagtatttgggggtacagttcaatggttgtagggagaagggtcgggcccttctgttttgccctcaggtttgcttaccaagtgcagtgattctctactcagactacacatcatcattgcacgggagctttaaatatttctgatgtccaggagggatgatcgactccttaaatcccagtctctgagggcgggactcatattcttaaatgttctcctgctcattctaatgtgcggtctcggtgaagaaccactgggtattaccaacagacctagatcaaatattcttttaattgatttcaagttactcacctcctgggctccaaatttgagaaaggaggagaaaggaaaaatccacacgactttagcactgatggttttcttgctccaaccttgacattaggctcacttggactattccctcagtggacacaagcagagaaaggaaaggtgggcattggccctatgctgggccctatgctggggagggggaagcaaagaggacaagtagggctgtggtttcatagggagcagtttctaccagggaaagagagggaaaggagatggggagggaggggaaggggaagaaaggggaagaggaagaggacacagttaaataaaccaaattcatttccaatagtggagagtaccgtagaggagggtaagcaggttgacatgataggccttgcctggggcagcagtcagatggggcaacagtgtcctctgatgctgcatctttgagctaagactcactccagtgacaagaagttcccactgtggaaagacgttctgaggaatattgggtgagctggcagagtcagtgggagggtcctgaaggacgaaagaccttgagagggaggctggctagagccaagtgagcctgggagagaaaggtgggagtggagagcggtcagagaggtgggcatgagtgggacatgcctaggtcatgattttgaggagtttgaggtctgttttaagggcaatgggtagcccctagggacatgtgcatttgcaaaacatctctgcttagcttgggccaccgtaacaaagtaccacgaacacataacaaaccatggtctaggtggtgcataaaaaacaccaatttatttctcagaattcaggaggctgagatctgggatgagggtgccagcatggtctggttctggtgagggccctcttctgggctgcagactgctgatttcctgctgtatcctcacatggcagaaagagagctagctgactctccagcctcttcttataaggatgctaatcccacttataagtgctctaccttgaagacctaataacctcccaaaggcccaacctccaaatatcacatcagggattagagtttcactatacggattggggcagggggacaaacagtccattgcaatctttccagctgctgtgtggagtggggtgtgaggggagaaactgatcatggtgagatgctggtgtggggtctcaagtcagggcagggaggatgcggggagcagatagatttgaggtacatttggaggcaaagccatggagttttgggatccttgaggtctccatgccttttttgtgtgtccattttacctttcaacctctttgcattttttggtttttggctttctaaattattctcagctagccatttctgatctttactttttgtccattaataagggattcatttgaaaaacctaagtgaccattgatgccctattagtgagggttctccagagaaacagaaccaatatgacatgcatacatatataaatggatgcatatgaatatatgagagagagacattgagagagacagagatttattataaggaattgcctcatgcaatttcaaaggctggcaagtccaaaaggaaaaaagaaaatctgatgaggtaggccagcaggctggagattcagggataacttacagtttaaatccaaaggcagtctgctggcagaattcctttctgatgggaagatttctgtctttattctattaaggcctttaactgattcgatgaagcccacccacataatggagggtcatctgctttacttaaagtccactgatttaaatattaatcccattcaaagaatagcttcacagaaacattcagaaaaatgttgaccaaatatctgggcaccatggttcagtcaagttgacactataaaattaaccattacaattgtcaaatggaattgctatgggtcttttatttttatatatttgtatttcttttaaaaataaaaaccaaaatgtaatcattacaaaaagtcaaaaaatacaagaaagggaaaatgaaaaataacattcattatccatttatctgagaaacactcactataaacccatgagaggatatccttttggagtgtttttattcatatgaaggtatacaatgtatttttaaagaaaaataggacaatactgtaatactgattgtaaattctcataatttgtttcagcaataatgctgggtttttaattttctccagttgacttcttttttttttttggaaatgaattattttattttatgagtatcttggtaagtttttttattatactttaagttttagggtacatgtgcacaacgtgcaggtttgttacatatatatacatgtgctatgttggtgtgctgcacccattaactcatcatttaacattaagtatatctcctaatgctatccctccccgcttcccagttgacaaatgggatctaattaaactaaagagcttctgcacggcaaaataaactaccatcagagtgaacaggcaacctacagaatgggagaaaatttttgcaatctactcatctgacaaagggctaatatccagaatctacaatgaactcaaacaaatttacaagaaaaaaaacaaacaaccccatcaacaagtgggcgaaggatatgaacagacacttctcaaaagaagacatttatgaagccaaaagacacatgaaaaaatgctcatcatcactggccatcagagaaatgcaaatcaaaaccacaatgagttgacttcttattgttcagcatttaggctgtcccacatttcttgaattacacagaatagaaatttactggcagaaagtgagttcaaatgaaacagcaaaaatgttagatgtttctccctattcttgaaagtccccttcaagatgcaaaagaggttgcaaagttatctcatagctcaataaaatgatctgtacccccaaaaaactcacattttcatcttttcagctaagcttttgtgttgccagttgcttccatcaaattgcttttaggtgaattgctgaagctcaccctgcagtggagggccccaaacaatggacttcagttgatgggagagatttttattttttaattttttaatgagacacagatttaacgttcaatatattaaaattataagtatatgaggtagtaattaatggtgaggttgagtttttatttctacttgttttcagaaaattctacttttatcagcactcattatgtgtcctatgttaggagacataaagatccccgtcctcagcttggagttttgccactttttttccaaaacaaaatgttctgcatgtgcctattattccctacttgtaagtagttctcgctctcacagaaagagcgctgcctccatctctctcctccctgggcagtacgttcaatgtgttgctgacttcaatttgctgcaaggtgggttcagaaactaagaggcaagaagtgacttggatcctgggggtgttgtcaggtactggaccgtggcaggctccccactggcttcctgctgcccccttgttcctgccccaatctgtttaccttgcagcagccacggtgattcacgtgctgctcttaaaactctgtgatagcatctcgctgcagtgagaattaaatgtaaacacctttccgtgggctccaagaccatacctgacacgctccatctctccaaagtcacagtgtatggttcctgccctggtcaggtttgctccagccacaagagtcggagttgtccctgccccagggcattggctctgctttctattcacaggatgagcttcttcccatccttcaaggctcagtttaaatttgccttccttgggaggatttttctggcattttctctaaaacagctgcttccttccctcacccccattgccatgttgttgtttttcttgatagccccataactatctgggatgatcttggatagttttctttgatgtgtccactgtgtggcacctcctctggaatttaagccactgggcatcttccctgctctgcctctggtgctgaacacacagtgagtactcaagaagtcacaggaatttgtgacatcagaactccccagatttgtcatggagtttagattattttcctttgtggaaaggagaagaaaatcatttaaactcattcacatatcagaactgctcaagcaggaagctagggctggagaatagtctgtactgcagagagcactcgttgctcaattacttatttctggaattattaaaaaattatggagcagtcttttaggaaaatgacacttagaaatatggacagttgattcttcttacttgtagtagttatgttgtataaaatcaccacgaacactgaattagcaaacacagaatcattgctcctaggggaaatagaaggtttggttcctgtgagccttgggtcacaacattttcatcaacccatcaatactaaccttgtttttgtgagttcctgcttaaagatgcttaaattaatatatattgttgattcattaacattgaactcacgaccaacagcactgtgactcctgcctgaacaaagcttaccttactcacatattttccatgtcagctgcatcacagccttgtgctttggaacactagtgggttcttccacaccaggcttgggggccatcataaacataaagctactaacaaaaagcacaaaaatgcaaaaaaagccacgaaatagaccataaaaagcacacttgttttcaatatgagagttgaaacaagaaggaagaatgtctccttgttcggctcctgttggtaacatgcatgttgggtgactcaagatttttgtcgttctgcatttgtccctagatgattgccaaagtaagtgttactagtattgattttggggttacaaataaattttagtgagtaggtgagtttgccaatatggaatccacaaacagtgaggatcaattgtcactgtaaagtgttagaagcaatactggccttggagttagaacacctacattctggttccattttcgtcactaaactattgtacgactttgttaagtcacttttcctctctggtctgcagaagaaaggcacggaactaggtgattgctaagataatttattgctttcatggtggacaattctgtaatttttttcttatggggtagagacaatgatttatagcatcataaacttcagaaatgcattgatcacactctgaaactttatttttgtgaaggttgaggtcctagatgagaacaacttggtcatgaatttagagttcagcatccgggagacaacatgcaggaaggattctggagaagatcccgctacatgtgccttccagagggactactatgtggtaagtgggaggagacccatcccagaaatgaacaaaaggaagagcctcacttcttccatgacctggagtcacacaaagaacttggtcgctgcctggctagcatctggccacactgctaacatgtggacattgtgtcccctggtgggggaagtgttactccgtggctgaacattgagctgtggagtctgagatcctgagtgatcctgacaaattactttatccctggtgcctcagtttcctgctttttaacatgaggatgaatttgtatcaggtaaagtgaatacaacaccagagacaaatcccagacacacttaaaattctcttacaaaggattatgaaacactgactcttcctggcacatgtcacgttcttttgccattgactgttgaatgacatctgtcttccccactagttcaggctcagtgagatcaggaacatggcatgttcgctttcgtgtctctcatgaccagaacatgtacagcactgttccgtggtaagcaggaccatgaaaacctaaccccaaaggccaagggagctgagaggctgaagaaagaggctcccaaatccagtttctcggaaaaacaaacaaacaaacaaacaaacaaaaaacacttcatagggacttacaaacagaatgcatgtcttgggtggaggtgagacagtggatccctgtgccattacctcccagatccagggcttacatactgtagggaatttgacccaaggccaggatttatggtatgcacatgaaagtggaaatcttagagggattcccagaaacgggttaatcagaagtcatcatggcagattggcatccaaggtggaatagctttagtctccacagacacttagtcaacacccatgggcaataatcccatctgaaaagggcaacaccagcagtccaaaatttgttttccaaagtgtttgcattctgaggttcaagctcgtgggttttgttacttaaaagaggatgtttgatttgttatttgtttcatgaaactactcactgtgactctgttttacaaaggactcataccaaagtgtcacaagcttctatttctaatgaaatctgagggcaaagaagaagagagtgaagtcctgtggggttcttcgtcatttctttttgtccgaatgaaaattgactcagggcagcccagttagcactcatgggggaaatgtttgcgtttcctagagacttgtaatgggtcaaacagcaaagagatgtttaaatattccatttgtttctgcttcggtcttgaggaattttcattttgaaaaaataaaatgcctctgtgaagtttttctttgtcatttcgtcaaacctgacatttattttcctgatttactcaatggaggctatccctttccacaaacagctgaagagagaactcacccctttgtcttttccagtccacagctgtttgcagaagcaccgtgaaggtatctgcccagcaggtgcagggcgtgcatgctcgctgcagctggtcctcctccacgtctgagtcttacagcagcgaagaggtatgactggggccttgtctcctcccagaccgcacctcttagggtctgtgtgggtttgtgaaaaacagagtggtttgctgggtagctggatcatcacctgggcttggggatgccgaactctgctgacacagtgggattctctcttggacacctacagcctcattgtccacatcccctacttctcccagcttattctttcactcgtgtatgtcctctctctttctctctctctctctcacacacacacacatatgcacacacacacacgcacacacacacacatgcacacacgcacacatacacacgcacacacacttgatttccctgggattgggaaatggccttcaagtaaaattaacaaacctttaaagtttcagatctaagtatgtggctcgctggcactgtggtttagtgcaatcaagaaggacatttttgttggaccagtgttcaaaactatttctcagctctgtagtccaggtcaggatacttgactttcatttaaccctcatgatccatggcttcttcatctgttaaatgctagcagtcataaagaccaccttataggttgttgagaaaatccagtaagctgatggacatgaaggatctggcttggcactgggatactcaatggatggcaggacccttatttttcctcaattgcattgaaagtttgatttgcaataatactgtaatattaataatatatacattttttccttgaaattatattatataagtgtccaattattggctgctttccatactagactgtatgtctcatgagggcagggaatgtttgtttttgtcagtctaggacaatgtgtgatgcatcacaatgtttgacatagctcactaaatacttgttgtataaatgcaagaaaactggggaagaaatggacaagaatatgataagaagaggccatctcttcactttaaactagggataaaaacatgacatattatttgttcatgtgtaataggataatattattgacagatatttttaaatatttccaacattatatggatgattctaacataatctttctttcctttttatatttttgttcagtttttcaagatttaactctgtagtgaaaattacattaaaatattataaaatttctacttcaagaattacacataaaagttaattttcccatataattaatatactcctgccttaactatttcttctggaggtacattttagaattagaaagtaatgaaactaatgactgagacactcctattgcagaggatggccttattggtacaaagagaacttaacacagtttattaggactttctccacaaaaagttcagttgagcacggccttattgattgatcccgtcacactggcaactttcgaaggtcaacccccaggtgacctctgaacttgtcctggagccatagttgaagaatcttcttttctcagggctggggcgagtaccatgggcctcctttcttagaccctattgaaatatttaggaagtcaaatacattctgctgtaacacactcatacactgtggccccgctaaccagaaatgacaaggaccaagcttatcacttcacaagtcttttgttaatcttgatttgtggttcatatgagaaaaaagacagtggggaggaagacaagcacagtgctagcctttgtggagtttatagacacgtcttggggaaaggtgcccactaagcaggaattaccctatcaggcaggcactgggggccacatagtgagaggaatgcatgtcacctggggagcagacagcttcccccaggaactgaccttccagccaagaactggaaggcgggtagaagtcagaacaaacagggcagagtgtggagggggaagggtatttcaagcataggggaaatcaggtggggtaccctgaattgccaggaaagctggtgggttgaaatggacagaactccattacaacaggaatgagaaaaacatggggagagaggcacaaggtggagctggaggaacattagcagtcaagatggactttgagggtcttgtcgaggttgcctggctctatcctaaagacaaaggggctatgaaagagttttaagtgtgtgtgtgttgggagcagaggagggtaacagaatcagatgacgaatagattggaactaggtaagaataaatatggagtaaatatgaaataaataagaggtgagagagaatgctaactgggtctagggcttagtagtgaatgttgaaagaaatggattctggttcattttatgacctttaacacaaaatgaatttagtaaatggccagctaagttaacgcctcttccaccctgatttggaaagtgggttctgattgtttgcaaagcctacaaatctgttgcagctttctaattgcatagtgaagaccactctcttttcttccaattccaagttttctaagaagactcagatattaagttagcccttgtaaaaaactagatcttaaaataaactctctgattgcttcttcttaaaggttaggtgatcataaacatttttgagcaaatttatttttaaaaattctcaaattaaaaaattctacaatttgaaagacaagaagaaagcagatagagacttaagtaattcctggaaactctgaaatgaatttcttgcatgaaacagagaagaaatgagagaacagctggtaatcattctcagtgaaaaaaaatggcaatattataaatatgaaagacattagattaggatacatttagtcatagaacaaataaattattgttggaaggaagaaatagaagaaataaaactgaaaaaaactcccagagtaataaaaataaagatcacttgaaaaacatatagagaatgtagaagactttccagagtaaggaatataaggtaaagaaaaatggaagccatggcaaataagccccaaaatccaaattatgactaataaggacttagagtaagtctggtaaggacataatgaaagccctgaatataaaatatttggactttccatgacataattttttaaagtatagtaacaataaaaaattgagaaaataaatttctaaatttgcaaatattctcctatagttaactaaatagataggtgaattatcggtagtttttattatttctttttcaatcccgaaattgaaatgtgtagaggataaaagctttccttatggtgcataagcactcactcaacctcgtactggtgcaggccccatcaggagtacgatgctgaaatggtacaatgtattacagttgtaggttggagctctctttctctttcttcagtttctaatgagtgagcttgactttagacaaatccttctgatttggagcggataggatgaagtcagctagggtttccgacacgagacccaaaataagagagagaaactgaagaagaatgatgacaggaattctgagcttacgggaggggtgacgggcatttaatttatttactgcctttcatttcaaaagatagatattcaactagaagtagtctaagccaaaaagaggtaattccctggatcacattcccagaaaggaaggagagaagttggcttcagggacaactcgacttagagtccttcagtcctgtatgtgccacattcttctccttccccttctctcctggcctcccctcccctctgcccctccctcttccttctccccctcattcccttttctctctctctcttcctccctttcctcctccctctccctctccttctccttccttctctgagcctcctccatcttctcctccttcctctgtctctctctctctctgtcactgtgccttctgcactccacgtccacccttgctgcagagaggctttccccttgcagcaggaagtaaagcctcaagctactccagacttatgtcctctgtacttaggagggaaaagaggcatttctctctgctgccagttagagaaacctcttggtattccctctattggcctggcttaggtgtcccctctttttgttcttttatacatataactttattattaatttattttaaattttatatatttacttgtgtacaatgtgatgttttgatacccccctttaaaaatacattttggtggagatataatttacataccatagaattcacccttttaatatgtacagttcagtggtttctagcatattcacaactgccaccaccatttaaatccagaacacttttatcacgcgggagagagaccccagtaacagttgttctctattcctcattcctcctaacacttggcaaccactaatctactttgtgtgtctatggatttgtccattctgatcatttcatacaaatggaatcgtacagcctgtattcttttgtgactgacttgtttcacttagcataatgttctggaggtttatccatgttgtagcatgcatcaatgcttcattcctttgtattgttccgttttacagagccacatttgattgatccattcattcattgatcgacattttgcttatttctccctttttggctatcatagataatgaggctagaagcattcatgtgcaagtttttgtgtacacatgtatttaattctcttggaaacagaattcctggatcatatagtaactctatgtttaatgaccgtatagtgactttatgtttaactttttgaggaactgccacattatttccatagcagctgtaccattttacattcccaccagtaatgtatgaggatttcagtttctatacatttttgtcagttcttgttggtgcctgtcttttttattttagccattctagtgagtgtgacgtggtatctcattgtagttttttttgttgttgttgacagagtctcactctgtcactcagtctggagtgcggtggcacaatctcggctcactataacctctgtctcctgggttcaagcaattgtagtgcctcagcctcccaagaagctgggactacacgtgcgtgccaccatgcatggctaatttttgtatttttagtagagacggggttttgccatgttggcctgcctggtctccaactcctggcctcagctagtctgcctgccttgcctcccaaagtgctgggattacaggcatgaaccactgtgcctagctctcattgtggttttaatttacatttttctaacgactaatgattggccattatacatcttctttgaagaaatgtctattcaaatccttgcctatgatttaattgcactatttgtctttttatttagttgttttgaaatattttctccccctctatgggttgtcttttactttcttgatggtgccctttgaagagcaaaattaaattttgatgaactccagtttatctattttttgttttgttgtttctgtagtcttacattaggtctatgatccatgttgacttgatttttgcatatgttgtgaggaaggggtttgacttcattcttttgcatgtgcatatctggtagtatcagcactatctgttgaaaagaatgttctttctctcttaaattgtcttggtatgtgtcccttcccagtccaactactgtgatggaggccaagaaattacctgactgttcaggacagggaggacagcctaccaagactcttggtagaaagactgcgagccaagcaaccactttactttgtgatgattgcatggacttttagtggtttcatgaaaacttcttgtggacaccttttcctactgaacatattacagtgactttatagagagaaacctctaaaattcgatctaaacttagtctgtgtgcaagtctgtgtaacagggttttgcttttctggaagccggcaatgtttgggagtacattctcagtctaggggaaagatctgtgggtaatttaaacttcacgtagtttgctcttccccatgtgcttttttagacttatatgtttgatatatataaagttatttaatataacgtattgcctatttcattaaaaatggattatataacatatatcagagtcttccagatgacatttacatttttcagtgtctttcctttttctttctttcatgtgctgacacatcctgatgcctgaatttctttagatgatttttggggacatgttgggatctcataaatggagaaacaattatctatttggtaagttaagatctgttctttttaactttttttcttaaaataactccatattgcaactctttgttagtgagtcatttaaaactagaaatacatatgtatgtaatcttgcaacaattacagccatagaaaattaacattttgttttgcttttgcttattttttatcactaggtaataatgatacaactattcacttagatattcctttgtattcacaacagagcttttccatacataattccatttgatggccccaacatctctgccaagtaagcggagccagtgttggttttccccttaagaatgtctagctgggaggatcaggagtaaacagtctgaattctatcgtctttcagccatacaactagatctgatcatctctttgaatgtcttagttcagggaggaagggctctccttctttcttttcttgtgtggcttttaatacaaagtgggttgggttagtgttctatgatttaggaggcatttttcctattagtgctgacggcaataaaactcaatggtgatctctcactgcttctttgcttaagaagcatatttgtggcattaacagtaaagtcatagaacattctggaacagtgagaggagtcttgtcttatgattattactgtgttacaggtctcatttcagacgagtccataagtgaacaattttatgatcggtcacttggtaagtgatttctttcctgctgtgccaccagacccttttctgatcaatctggactcctgagaaatcctatttcatagctgtttcctgtttcataggagttaaatctctgaaatacaaaatattttaagtaaaaaaggaaaagaatagtaatgtataaacttgctttgcaaatcattaaaaaggtagccttgaggcactaactgacttaaaagttaccaagaggccgggcgcggtggctcacgcctgtaatcccagcactttgggaggccgaggcgggcggatcacgaagtcaggagatcgagaccatcctggctaacatggtgaaaccccgtctctactaaaaatacaacaaattagccgggcgtagtggtgggcgcctgtagtcccagctactcgggaggctaaggcaggagaatggcgtgaacccgggaggcggagcttgcagtgagccgagattgcgccactgcactccaacctgggcgacagagccagactccgtctcaaaaaaaaaaaaaaaaaaaaaaaaagttaccaagaatcaaaatatcaaatctggctcaggaaataagcattcaccattttttttttctgacactctctggagcatttaaaaagtagcatgaactctaatataatcttgtttttttaaactaaaaaatttaatttttatgggtacataggaggtatatacatttatggggtacatgagatattttgatacaggcatacaatgtgtctaatgatcttctttttgccatactcaaccaaatttctcaccaaatggatgaaacaaagttattttgtccctctcctgtacagatcagttttctcatttggtcctcatgatagccctgtcaaccacgtgtgttacctgcttatatagacgaataaagcagtaagaactcatggcattaaatggcatatgcaaattgtctaccctgtactaattgcctaacacaattttcttcttcagtgtcacaaacattctgtgaggtagcactatgttctttcccattttgtaggtgagctaactgaggcttagtgagttcctgtaatttgcttgtggctacattgccaatgtaggactttaatcagatttgtcagaatctaaaacctgtgcctgtttcatgctgcctcccagaagaactgcgaaatccacctgatgttcagcattccccattaaaatgaataacagagatattaacatttcaatgagctcaaagtctgaccttcattaggcaaactccagtttatttgaagtgctagagcttataacctgatgcttgatttttttttaatgcctgttttatatctcatccaagttgtcactttgggagaatatacagttattatgacagcatgaccactgctgaaacgtttttatgagcttttcttttagaattgccttcagaatccatggctttttttttttttttttaaatctccgtactggtggcaaacatttgcccttggatttgatgttgggaatattcaaaagatatttggagacaaatctgattaatcagattaataatcaacttgggtgtgttggttatctattgctatatatcaaattaccccaaaatgtggcagcttaaaaccacacacatttattatctcacagtttctgagggtcaaagaccaaggagaaacttagctgggtggttctggctcagagtctatcaaaaggtttcagataagacgttgactgggctgtgatctcatctgaagcttgactggggttgaaggagccacttccaagcccactcacatgttgttgggaagcctcagttctttacaggctgttggaccaagggcttcagtttcttaccatatgacctttccataagacttctgaatgtcctcaaatcatgacagctggatccccccagagatgattatttgagagaaagagagagagagagagagagagaatgagcaagcaagagcactgaaggcagaagacacagtcttttataaactaatcttggaagtgatatatcatcacttctgcataatctattattaaatacacaggccaatcctgccccaatgtgggaagggactgcccaggagtgtgaataccaggaagccatcttggaaactgattattgtattggacaaatgccatttgggactaaaaatattatatggctataaattaatgtgaccaattcttttatatatctcagaagaaatttctaagccaaaatctaaaaacacattgggcctgggggagcatcattgacacagaagtgcggctgtcttggagactgctttgaacatgatgatttaatttaattcaataaatgtgtgtgacaaacactgggtagatcccttggaggactgaaagataaatgtggcagttcctgccctccagggcatccatggtggctgagacatcacatgtagtaataaggagtggggagaaatgagcgctagaccaagctgaaacacaacacgggggagaaggagagagaatggaataaggaagatgaagttatcgcaccctcaggtattctcatggcagatgggttcaggttatgcttgtcacaatcctcctcattaatttgtagtaacattgtccacactgtctcagatcttgatgtgactgacagagcctatgcttcccttttctatctttagggatcatgagaagggtattgcctcctggaaacagaaggtacccaaaccaccggcacagagcaagaataaatactgactttgagtaacggccttgaggtaagaaaatgcaggtgcacacaagtgtatttagaaatagaagctacgtggagtgaacgccttaaaactgctgaccttcaaatatctgcaatatgctattcaaatccttgcttttcggcttctctgacctccttcccaagacttctcctcaattgcctcttcaatctcatgcaccctcaatctttttcccatgacatttgtatctgttgccactgatgtggtcaagtctgtccatgtgaggagcaaacaaacaacaagggcacagccccttcttttggcccatctcatccatctaagcaactgccttccctccgtccttccttccttgctaaactttttgacacaactgcggtctctggttgcttcctcaacctcctcacctcacatctatgaaatctcatctagcttccttttctggatgtgtactttatttattatttattaatttattttttgagagggagtttcgctcttgttgcccatgctggaatgcaatggcatgatcttggctcactgcaacctctgcctcctgggttcaagcaattctcccacctcagcctctctagtagctgggattacaggctcctgccaccacgctcagctaatatttgtatttttagtagagatagcgttttaccatgttagccaggctggtttcaaactcctgacctcaggtgatctgcctgcctcagcctcccaaagtgctaggattacaggtgtgagccaccacgcctggccgacgtatgctttaaatactggtgagcattcgtatgatctccttagtttaattctttccctatgctgtagattactcttttatctcttcttcttgcttgactttaactatcaatgatgcataattatttccaaacacatgtctcttaccacactctatgtctggatccaggcctttataactgcctcttgggtggtgttgccattgtgtatcctgggtgtccctgaaactcaactagcttcctgacaagctccctttcttaattgatggcattaccatccacctaatttgctcaagctaaaaatcttgagggcatcactgactccccttcatccttcatcttcttggaacatacattggggtccagtcttattcatttcacccccacatttctctggcattgctccatcacttcactaccatcaccaatgaactattgattgtattcttgcatcaggttctgatcccatactgtctaccttgcttgctgtcctcaggtttatcgtgaaacatggaggagactctgatccttgccccatataaactaatgcttgcttcacttgtgggactgagcagaggtgggcaacagccagacactgggccaagaggaggaacagcctatctgccccagttctatagaaagctagagacagagtcctggtttatcatactggcactgagcttcatagagtttcacatgagtataaattcccagttactagggatgggattggagcaaatgtagctatcatgaagggcacacgtaagaggaatctcaagatggaattatagatgtcgattccatgcataggtattttacatgcgcacatgtgcacacacaagttaataatgaagttggagtgttcacgggctttacagtctgcataacactgcatgctttcaggataaagtccaaactcccagtgtagctcacaatggctttcatgacctgggtctgcccacatctccagcctcacctggccgctcagctcctgaggcactgaggtacttgcagctcctctggctgctgcctctactgggaccagccacctgactagttctgcctcaccattcaggtcccagctcagttgtcacttccctttggaggtctacgttgacaccacaaaccaccaccactgaatcagagatgatgtccctttttgggcctctgtaggttcctcatcacagggcactgccattggttgtttcctgtcacccatctgactaacagacttcccaagaggaggtctcaagg

SEQ ID NO: 13557 - DNA, 18238 bp, Human
ctcactggctaaggctgcactggacgactgcattgctttcgattattagctgagcaagcaagtctatgtatggtggcaaatacctcttgatgtgcataaaccctttccacgaagtagaaactcatatgggaaaaagtacaagccactaggctacactattctgaacaattctccatttgattttcttcgtaatacttttagttgactccctcgaataggttccgtttttcattctggcatacacattctctttttcattgtaatccttatgtgcaccgtacttggtaacatttttgttttaatagagatggagtctttctgtgttgccaggttggtcttgaactatcaggctcaagtgaccctcctgccttgggctccccaaatgctgggattacacacaagagccactgcctggccagcactacagttctactatcgaaattattaatgctatgctatgtatctctggcggttttttttttttttttttgagacagggtctcacactgttgcccaggctggagggtagtggcctgatcatggctcactgtagcccctacctcctgggctcaaggaatcctcccacagcaggtgccaccatacccagctaagttttttgtatttttttaggggagagaaagcgtttcgccatattgcccagactggtctccaactcctgggctccagcgatcctcctgcctcggcctcccaaagtgctgagatgaaagacatgcgccccacactggcctctggatgtttgttactcctgagaaaactaaaatcatggcactccaaagactagagacgattcaacaggcaagagcagggatgaaatgcacgcagcgactgaggtctggcttcgcggctctgtgaccccggttcagcttctgagcgcctggttccttggcgggacgcctcctcctttcccgcaagaccagacacgactgtctgggaagcagcgtttctggggcgcaccttgacacttggatttggatcaacaatgctttcaagaagaaagacttttgatcaaaagcgggaaatgagaaagcgactttcctctgaaaagtgcctcccagtcccgaggctgcgaggcccccacgccaggctggctcccacggaagccgggcacccacccggaccgaccaagcgccactccgccccgtggacggggcgtcccaccccggggacgcccgccccacaccgcgtttgcaccccggaggccccttgccgcagaggcggacggcgcgcctctcccgggcccctggggtccgcgcctccctcgggcagactctttcgactctgctcgagcctccgcttcttcctgcgggcggacgccccggacacaacgggccccgctgttcacgcaggggcgccccggcggggcgggcaaagacccggggacgcggtcccgtcccgagacgctcagctccggcccaccgctcgcagctcccgccccgggcgcaggtcccgaccccacgggccgtctcggagccgcagcggccgcttccctgcacgtcctcacgccccccgcacggacgccgccagccccgcgcctcagtttccccactagcaggatggaaagacgggccccgccccgaagcgtagcggcgtctccgtggtagccagtgcccagagagtccgccggtcccaccgccccttcaaaggagaacccggcccaccgcccgccgcggcggcgaccgcgcagcccactcgtcacgcggcccgcggcgtccagcccgggccggctcacctcaggcggtcgctgccgccctcgcgcctgcgcgcccctcgccccgcccctctccccgcccgcgtcccgcgcaccggaggcctctgcccctcgcccaccgcaggacccgccccgcgcacgcgccgcacgtgccacacgcaccccacgcccctgcgcacgcgcaggccccaagtcgcggccaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggtgaggcggaggaggcggcgcgggagccgagggggcgcgggggggaagcctggggaaggccaagagggcgccaaggggaggttgccggggaggcctagggggcatcgcgggccgggcgaggctgcgccatcctccccttccgtacccacccctcctgcgggcatgcggagcccggggcgtggggaccccgcgtactgcccggggttcgcggcctcgccactcgggcgggggttggcttggacccgggtcggaccgcacgggaaagccccgattctccagctccgcgcgagctagaattccacctggaggtgaatctgcgtctcgcagttggaccgaacagcctcaaagtccacgttgccctccgcggtctgtagttcagaccagtattggttttaatgaccaaacaccaaggcgtggcaagtggcctgttatgagctttaattttgttattaatgtttatatccatggtgactgttaggatttcctcaagggtgaacgcggagatgggagggggttacagcgtttttaaaatatggcattaaatgggcatgttccaatttcactagagggtcgttccaaaacaaagctttaaatgacttacgggttaagaaaacacaagcaaaaggacgctgcccgtgcagcactcagtcgttacagcctgcctaatgcccgagtagaggctcgctgtgtgcccttggctagattcgcaagaccatccgttcacgcagcgggaaacgcaggcccggggtgcaggacttgccccacgcacagccgggtggcgtggagacccaccccacccggtgggtccgcgtcagagtccagacgagcctttgctcagggaagcgggcactgaagccgccttcccagggtccctagggccaaagcctcggaggagggacctggtggcagctgacctttgtgttctttgaagccagagtttactaagcaaaattagcatgtaaataagcttgggaaaggactgctgaaacctctgacagtgaacttttaatcttcattgagagtttttaaaaccatatattcacataaatttagtgagttgctaattttattacaaaaaaaaagattttactaggcaggacttagttaccgtaatatattgaataatatatatatatacatatgaacactacaagctttttttttttacctttttttttttttaagagacggggtctcactgtgttgcccaggctggtctgaactgggctcaagcgatcctcccgcctcggcctcccaaagtgctgggattataggcctgagccaccaggcgcgcctggcctaaaaccatattctttaaaatcctgtaattcggatttttcctcttgaaatttaaacattggctaattactattttgaaatagattaagaggtgttttcctatcttttgtcataaaataaagtccaagggatgtttttataaactctttgccataaaatcacccattttccggttgtgaagccgcgttactcctgacattgtgcgtttcactgtccggctgggatctgggcgctgggaggtggagggggctccggggggctcggtcctctctccaatatgtaacttacacaggctgctgagtcattggcagtgcaaggcggccagcgccggagttacgagatttttgtttttctgttttgtttattctataaaaagatagttacccgcggggtggatcccatgtaggcgattccttgggccgccctgagtgtccgcgcggcaggacggggccactgtgggctcggcgtgggcggggttggccggtcccgcgggctccagctgcctgcaaatccgggacggagcggtggctcaggcagcgctcacctctgcctgtccgatttcactgccccttgttgacctcggaacagagaacaatgggagccttgcagccagacccacggatggaagcagcaagcactctctcctctgagtgtaccctctggggccaactgcttttcctaaagagttaatggcaaaatgggctgattctgttcctttctatctcttgatcattctagctaaagttgttgactcgcaggatgctcgtatttgtccttttccttttttttacaagcccagtcttactcccccaggctggagtgcagtagcacaatcattatagctcactgtagccatgaacttggcccttttctcctagacatgtcactgctaacatgcaggagaggtaggattctgtgacgagaccgtgtcacggtggcgggggcatcacttccttgaaggacccactgtcttcaccaggagggcatcagttcagtaaagtgcatgcccatttactctggagggccgtgtttaataatccaagccctcacctcttcacccactgctgtgtctgcaactggcagatggttctctctcttgtcagaggcaactcaccatgggcaaagttgtatgaggggaaaagatgttttctacttattttggagtggagttgtagcattgtgtgctttgagacctgaaggggttgcagacatcgagattctcgtccaagacttgcatttcatagatggtcacaatgaggttctagaggtggagtgaaagataaggctggcaacaacacttaaggagaagccaaggtctctgcatgaggcagcagtgggatacctggagcccagatgcctgaggctgcgtgcaataggccctggagggtcctggaggagaggaggccagaggtcctggaggcaacaggaaggtggagggaaacgagccccgttggaagccagggacctgatttacctacccagctgacttgatacttgaaatcttttgtcaggcgggtctcttttgttctctccccactaacctgagaagctttaaaggtaaaacagcaatttcttagagcccacctcccctggggaagaagccctttgtatggttttggggtgctagttccctcgggggttcacagctcctctgcttcaggctttttttctgggatgctgcctccctctgttctgacatttatcccagagctttttcaatctatttgcctggattccaccccagcatcccaaatagtcactttcagagtgggctgaggctaggcttttggagaacaatgaaaaaacaccacaggtgattctcccttcatagccagagttgaggttgtcaccccaggttagggcatagggtggccttgagaacttggccctgtgtttactccacgtggggctcgtggctgtggcccatgaatccatgttgaggaatgggacccagggagttgccctgggacatacagagggcagtgaatcgaagggattccctggagtctgtcactggagggagaactgctttgggcacctagaaaagctggatgtcagatgattttttttttttttttttacacaaagtgagaataagaaatggattaagaactcttgttggactgtattttgtctctgaggcagacctatcagttttctttttgtactgtgatataaatatttatagtctaggcttttcaaaatctcatctaccttgatataggagggaggtaagatttactggctgtgtgtcttgttagcaatgtaaattataagtgagtgaggagggggaggaacatgagagggacgcgaaatgagattaggaaggagggcttttcttgcagcagcaacagcagcacctttccgtctggggcctaattatactacagtgatttgaagtgtaaactgcttgtgattatgagcaagttttctaaggttattaagcaaccttactgtaagcccatctttctttgaaaaggtgaacgatccgagtggagaactgtaacacgtgagtagatacacagcacgctccattctccaggaagtgccttcctttcctacgcggttgctgtgggttaataataaaactcctgtcccttagtaaatcattcctgggaatacagcttttgggcccaaagtcattagccatggacaatctggagtgagttttttttccttgtttcctggatttttaggtcctttctggggtgatgtttaaaaagcactgctttggttcgaatgtgttcctccatgttgccagtgggatggtagtaaaaggtgggcctttaagaggtggctcggccataggggctcctctctagtgaatgggattagtgctctaaggggctggatggagggaggtgggtccctctgtagcctcattgaagggatgaggcaggaaggccctcagccgacaccagatgttggtgcgtggatcttggacttcccagcctccagaacagagatcagtttctgttcgtaaatcactaagtctgtgggattctgttgcagtagcgcagaggatgacagagatacacttgtctctccttcatcttcctctccctgttgtcttcagcctgccccttgtgtgatagattacagtatgtgtttggtcttgaccctacctacttcctggtgcagagcacctaaacccctggggcttcctgagcagtgtcttttttttttgtttgagacacagagtttcgctattgttgcccaggctggggggcagtggcatgatctcggctcactgcaacctccccctctcaggttcaagggattcttctgcctcagcttcccgagtagctgggattacaggcgcccaccacgcccagctaattttgtatttttagtagagacggggtttcaccatgttggtcaggctggtctctgactcctgacctcagatgatctgcccgcctcggcctcccaaagtgctgggattacaggcatgaaccgctgtgccaataagtgtcttaagcatgtttattaaagaaagtaaaacagtaaaaagatggtgactccataggcagaacaacctgaccagtgtgtgcgttattcataaagtcaccctattagcagtgtactccaaaagtgctccttggttaaccatttttggtgtaagttgtaaggagccccttcagaatacactgctaatacagtggctcaagggtggccccaggatagttacttgaggtagaaattcccagggcagcccctcctaggaggggaggggactggagatggagatgggggagccatgaggtgcgggtagcatggttggggttagggttgggacatgtggggtaagtgggagtctggttgcagagagtgtggttggggttagggttgggacgtgtggggtaggtggggatctgggctgtatgtcatttccatttgtctgccctggaattgtttctggtaaactgataaatgtaagtaaagagtttttctgagttctgtgaattgtagtaaattactgaacctgaggcaggtgtgtgggatcccctgagtaggtagaggcactggcagaaatacgggtaacctggacaccccattctctgcttgcatctgtgggaacagtcttgtgggctccacactaagtctaggtagatagaatggaattgaatcgttggacaccccggtggtggtgacttggtgtcccacatttgatgttaagagtggcatcagagaagagacaccacaccttcaagttgcatttgtgttccatatcgtcagatagctgaacaacactttagtcaagtaaattgaagcaggcccagaatctgaatactgtagattcagcggagaaagacagctggccaaaacagaggctgtggtgccgttctctcaggggcaggccatggctagccggccgcatggcatcttgaaccgcagagagggaaggagggctagtgaacatcagagtacttggcaatactgtctggtcagatgagcggcttcaggaatggtgtggtctgtacatctccagaaggcaccatgtagcctctgccagagtgtggggcagactggcctgggcctttctcctccattgagctccaggctccgagacagaccctggcttgcctttgtattagggatgtgcttcgtgtaggccaggacatgaggcaacgtgagaggccaaagagaacaatcatgcgttcatttgaaaatttgtgtgatcatttcgttagcagcttactgggagactgttgatggcataagttgcaaatccacttttccttcctgggccttcggtttgcttttttctggttaatatgaaatagactctgcaacaagtggcgtatggagcctaggccagccctctttcaggagagatgcctcgtgtgtgtggaaagctgtgcacctgcctttgcttccagcgaacatgacggatgaagaggctgctcctttccccctaattgcatggtgttattagtgctgtgttggtttaaggacagtcagcagctcagggtgattattctgcttactaaaattatagtgactgcaaaaatgagataattccattgttctcgtccataagtttccctgtcttttgtggcctgcactttcctcccactgcactccatcctccatacgctaccagaggaagctcctaccagatttgctttaaataaataaacctatgacacaaagtagagagattatctggggcccagaaatagacgtgtgcctatatgcacgcttgatttctgacacaggaagcagccagcgcagagtgaggcgggagctgtctgcagtaaatggggcatccgtctcacatcaatgggaaaattaatccatgtagattttggatctaaatgtgactgtcataacagtagagctgtgtgaaaataatagaatagaatatctcagctcaggaagggattgctgcatttgactgaattaaaatcaagaacttctgtacatcagaagacatcagaagtgaaaagaacaagctaccgagggaaagttacttgcaacatatttaaatgcagaaaaacatatatctagaatacagaattatcccagaattgcacttttagcagtaagggaacgggagcagcgttccagcctcagtttctatttataatggtgacatggaaaaaatactgctggatgcccacaaataagagaaagacagataatagaaaagaataagagattcgaagaaccagttcaaaaaagatgctatccagatggctagcaaacttgtaaaaccgtcttcaacctcgttagaaattatataaatgcaaagtaagccacacgatgcaagtcatagaggctgggcatggtggctcacgcctgtaatcccagcacactgggaagctgaggtgagaggactgcttgggcccagaagttcgagactagcctgggcaatatagcgagaccccatctcctaaaaaaaatagccaggagtagtggtgcatgcctgtagttccagttattccggaggtgtcagctagaggatggcctgaacccaggagtttgagattatagtgagccttcatcgtgccactgcaccccagcctgggtgacaaagcgagactccgtctcgaaaagaaacaaaaaatagagcttaaaccttttaaagaaaacttcaaatcccttaagcttatgttgacattagtgttgttgttgttttttttaaagacctctttttccaaataatagcctttttcttataaaagctcactgcaaggaagtattctaattggattctgttgactcagcagagttattggacattggcttggtataaagggactgcaagagctggacagatacatggtctcagccccagggggcttccttcctgtacccagggagtgtgtgcgtggacagtcactgccatgagagtgggcagagggatgtcttcaagtcggggttgagggatggttcctggtgtggcaccattgctacctcttggaaatggaagggcaggctggttagatatcaagagcagattccagagtgggtagagaattccatctgcgcccctttttttgtccccatcaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacaggtaggcgcgcatcaacaagtgtatgtgttacagtgccgatgtcttcagtgggtgacagtcacagctggaagtgcccgtgtcacctctaggacagtgggctgctgttcgcctcgggccgcgttctggactggctcctgctgcagtccgtccttatataggagcctcgccctctttggggatgcagtgacctgggacttagtctgtggggagccatgttcaagtcatcagtaggcagcggaacagccacaaaccccactctgagaaacgcactcacgcgcctcagcggggctgtggtcgcaggaggagcggtccctggttagcagtacttctgagtgactccaaggtagagtggccgacagtggtcaaaggtcgcgtgcccttgagagctgtgcaacagacccagaccgtgaaggcggcaggtgacaaagccagctgcttgccagttgcccctgcgtcttctctggaagactggctagctcactcctgtcgtgctcagccaaaagggctgaggaagagtttggctctggcaggtgctgggtggaagggaagacgcgtacgctgactggctagagcccctcatcacggaggcggttcactgcctttggggtttgagcttctaatgatagaatgttcacatgatgttctgtttttcccattctattcacatcgccaagcccacctcgctcgcagacaccacaagataccaacagagcttctgaaacagatacccatagcattggagagaaaaacagctcacaggtaagctggaaggagaatgtgcagttgtaaaagtatttgtgatctgtttgtacaggaaacggttttaaatgtaattgagcacctcagagaaaagtcgggctttaagggtgtttcctgctttaaaaaaaacaaaaaagcgaaacaaaaaaaccaagaaactgtgggtgggaacatccacaagcacatgggctggacactcagctgagcgggggaggcgccgagtgggacaggcagcgggggcctcctgtccctccctgcctgccatcagggatacaccggaaaggaggaagggctccctggtggctgcagcctagagaggagggagggaccattggaaggggtggcagtgagccagctactggctggtctttcctcgtggttgctggttggacagtgagtgggttttaatatttgcatgctgtgtgggactcaggagttacccacggggccatctaaggccatgtggccactgtggctgtgactctgaggtgtcttcctcattagacactcactacctgccggaaattacaccctgtgcctttcctagcattagtcctgagctaactggtgccggagcagtgtagcattagcggctgatcagcctgataatttagtgtaagatcactttttcttcttttttaaaaaagttttttttgtagagacggggtctccctgtgttgcccagggtggtcttgaactccagggctcaagtgatcctcccaaaatactgggactataggtgtgagatactgtgtccagcctaagatgacttttctgttaacagctattgaatgggctttacagagcggccttcagcattgttgtgaaagcggagtgagtcttagaggaaaaagtgtacctggggttattgccttggtgtactatcgttctcccttcctactccggcacagatagggttcgaggcagtgatcagtactgtcttgctcagttatatctggcagtgccttaccttgctgcagatgagatgcgcgatcagtgttttcttgggtgttcgttgctggtgagaactttgacgacggactgtgttctgtattttggaagctctgtgaggaagcatggccttccaggcagggttagtagctgacccttccgtgctagcgcttccctcaaggctttcttcaccaaggaaacaaggagtccctgttacccaggctttctcagggacatcccctggccccactccgaggggcagcatgatttcgggagccccaggagccctggctgtgggtgtgtgggtgcatccagggcgtgcggcctgctcctgggcacttggggctgtacccagcttgggtgtacccagatgtttggtgggtttggggagctatattcttgagtattttcaattttatttcttttttttttgagacagggtcttgccgttttcactgttttacacaaaacttcccctagttttaaaaggaattagatgttcaggtacagaattttgaaaatgcaaaaaagtagagaaaaacacttagactctcagatttaaaatcctctttaatgtttcgtgctgttatataattctgaggatttggccgcagctgtggttatgtggacatttctgccttttccctcctgcttatcccggaagcatcttgtaaacctgctcactatacagtgtcccttccttcgtcacgtccctgttttgagccgttttcggctgttttcattttcttttcttataaccagtgctgccgtcaccatctttgccctcatgtcacgtgacttccctaggacagtgtttgccgctgtcagtacccccagaatctcacagtgaaccaaatgtatttacgccctgagtggggctcccccagaggtgatctgtccctggaggcggcgagcgtgctgtgagccgggagtgcggcgcggcccggggaaggcccccagccccaggactccccttggaccacggtccgaggcactgacatgtgcctctgggctcttgaattgagcctgcggatctgaagctcgggtgggagctgggtgctttcccgtgtcacgtgtggtacactgatctgcctttaacattgactttatcttagtctgaggaagatgatattgaaagaaggaaagaagttgaaagcatcttgaagaaaaactcagattggatatgggattggtcaagtcggccggaaaatattccccccaagtgagtgtgttctcagtgtcacgggggcaccccttgacagaggacacatcagctgacacgtttcttcccgcctcagggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtaggtgatgtgactgtgtgactcctgtcatggcatgtcgtggggcgattctgggttgcagtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggatggctcacctcggcctccaaagtgctgggattacaggcgtgagccaccgcgcctggcctttcctggctgcttatactcactcaccctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcatttctgctggtgcttttgggagtcagacctacagactgcatcagcatcaccaggcagtttgctttctggagccttttccagaactgtcaagcagactctgggggcaaggcctcgggatcctcattttaaatacaaggtttaagcccttcgtttcaggatggatttctgcagccactacttcccagctactgtccttcgtcctgcccgggttttcagagcctgatgctgccactggcgacccacaccccctcagctgcttttcagaaccacacgataaaatctgccccgaaagctgctgcagcactgtctgcgctcacagtgcccaccacaccaccgcccacaggccaggccagccaggcttccgattctgccctttcctggagacccatcctcctccctccgggagtgatgcccgctggtcagctggagcgagcctctctattgccgaaaagccttttctgacactcctgcatctttagtttgggacatctctcccactaccaaacttaaaccacatgagggcaggggcttcatttttaagcagttggctttggtgaggctggtggtgatgaactagcaacaccatcttgccctggtaggtgacttcccccagcactgagttggaacaaagcagaagctttctgtgtggaaacagcattcggtttggtgatccttctatgtaagaatacgatctgatgttttctaagttaattaatacaaaatacatattgataaaacactagataaaagatcacagatagattcattacaaaatttttataatgggtataaaatcaccagtccccttgcataagctctaaccacagtgagctaccctgtttcagctgtaacacagtctcctgtgaatcacaagatacattaactactgataatttttctgtgaaggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcagattactgtatttacatatggtttaaaatcagacgtcatgatagcttcttaatgaaaccaggactggtccctattttgacattatctttcctacagcaaactttttagaaaggctgcctgccgccttgatgtttcacctttccacgcttaattcgggtgttaaatctaacgttttcatttgtaaaaatctttgttgatgctaccttggaagcagtcatctctcagtcttacatttggagaatgtggatggcatgacatcagaattcctttatataatttaacttcagaatagtctgagatcatcgaagcacgatggtcaagggaattccgtttttgttttagagcaaatatgtttgctgtttgtctttcatcacaaacatcagtggagtttcagcaccttacagagctcagtgaaccccctggtcaccatcaaagttagcacacaacaaagccaaccacgtgtccccctcacagatgacaatggctgaactctgagtgaaaccacctgtatggccgggcacagtggctcacgcctgtaatcccagcactttgggaggttgaggtgggtggatcacctgaagtcagaagattggcctggccaacatgatgaaaccccgtctctaataaaaatgcaaaaattagctgggcgcagtggcacgtgcctgtaatcccagctacttgggaggctgaggcaggagaaccgctggaacccagaaggcagaggttgcagtgagtggagatcatgccactgcactccagcctgggagggagaacgagactccatctcaaaaaaaaaaaaaaaacaaccagttggaggtactaagctctgggactgggccagtgtgatggctccacacctgtaatctcaacactttgggaggctgaggtaggaggatcacaagtccagaagttcgagaccagcctgggggagcatagcaagaccctgtctctacacaaaatacaaaaattagcctcgtgtggtggcacacacctgtagccccagctacttggtagactgaggcaggaggatcccttgagcccaggagttcaaggctgcagtgagccaggatagtgcacacggcctgagcaagagcaagaccctgtttcagaaaaaacaactctgggactggagtgctttagacagatgggagaccaagaatcaagttttctggaggtgtttttcgttagattgtaacattagacattttattaaaaatgaaacaagtttgatgtgtgtgcgtatctgaatgtttttatctttgaggtaggataatggcagtgtgccttctgaatagcttctgtaaataacccttcttttctacagtggttaatacaaataactgcccataacactcattttaatcattaagtttataaaattaacattaagtgattctgatataaaaacattggccacttggccactatttacctgatatttactctgatgcagacatttgcccatacacatctgcttagggtgtggaacgtgacgccgacacgttgcttagaaggaatgcacatggctgcaagagagaggagtcggcaacacctcaaaaaactccagccatgcatctatgctttggacacacaaaccacttctaggaattcactctggagacagacctagaaacttctacatgcacatgcacaaggatataactaaatacgcagtatttattataacatgattgtattaaaatatatgaagcaaccgaggtgcccacgcatagagactcgagagaacgacagtgctgccctgcagggccggtgctttgccactcatgcaccaaggggaagagctcgcgatgagaagggattccagggtatgtgaagtaaaacacagtgcaaaaatagatgtctccctagcagaaaggaaagaacatttggaagcagctccttgaaacaggaaacctgtagcagtttgaagacagcccccggccaggcgctgtggctcacgtctgtaatcccagcactttgggaggct

SEQ ID NO: 13558 - DNA, 6851 bp, Human
gtcagtggggagccggatgagggctgaggacagggtgggtgctcgtgggaggggagagcacaaaggacctgtgaccacagctgggggcggggcaggaagtagaagtgatgtgagtggtggctggtgcaaggagccacagtgggctgcctggggggctgatgccaccattccaggagcctcggtgaagagaggatatccatctgtgtagccgcttctctatacgggattccaggtaaggagagagcagggattggggggcctggggccctgggtggaggggaagaggctgatggagcaggaagtgctgtgacctataagacaagacacctgggtcacagacggtgcccatcactaactcgctgggcagccctgtgtccaccctgggcctcagtttcctcatgtatgaaatgaagaggtagcgtgcagtttctaaggccctgcaagtgctgacattaaagcttctaagaaagctggaaagaggctccctgggacagaataccatgagagtcaggatgagggctgagttcactggattagggttatgactgtgcccgcctcctagctgggatgagcccagggcctttgaagattcccctggcctctttgcctccctggggcgagccacgctgcctgaaattccacccttcaagtcacacctttgggcagggcaggaggctccagctataatgggggctctccatagccctcttgtctcagaacctgtggtacccaagggcaaaggcctttgaagagctcagcttggataaggttaggcttgggtaaggttagagaaaggaggttccagatcataaacaggcccaggcaaggccccagaaacaccttaaaattaggaagaaccttccagacaatcattgtccatagtaggcaataggggggcccctgtcactgccgaaggccacagagcttggcagggagtggcaaagaggggaggggcagcaagaaaggatctgaagagcaaccatcgaggcctctccccacacaaaatccaagggtgtggtcaggtctgcccctttttcttttttttctttctcttttttttttttttttttttttgaggcagagtcttactctatcacccaggcgggagtgcagtggtacgatcttggctcactgcaacctccgcctcctgggttcaagcgattctcctgtctcagcctcccaagtagctgggattacaggcacccgccaccatgcccagctaatttttgtatttttagtaaagagggggtttcaccacgttggccaggctggtctcgaacttctgacctccagtgatccacctgcctctgcctcccacagtgttcggtttacaggtgtgagccaccacacctggccaggtcggcagattttattctagaattcgggctgatgttattccataaagctcagagggagagccccaaagggaaaatgagaagaataggtgcaatataggacctcatttctcttccaattctgttaagggctcagtgggagggagagaggttagagagagtgacagagacaaagaaacagagtgagagtcagggtgggcaaagggtggcttgttctggggccaaaaatgacacttcttcagaatgaaggcttcctcaggtccccagacccctccctaaacctgctacagctactctgtcccctcttctgtggccacagccccctccccaccacccacagttgtgtcctggggacagagccatccacctagatccccattaggccttagggaaattctaaaaaggggctccccttggctgggcttttcccctctctgggcccatctgtacaatgtgggggctgaaccaggcctataagggacataccagctctgacattcattgaataatgacttaagagatatctcagcccctccccttccatgtgccctgataatctgtggctgtgggggaagggagcagtcatcctccatccctccacccatggcttcccagagcccaagtgccccctgtctctgcagctccatggcagcccgtctgctcctcctgggcatccttctcctgctgctgcccctgcccgtccctgccccgtgccacacagccgcacgctcagagtgcaagcgcagccacaagttcgtgcctggtgcatggctggccggggagggtgtggacgtgaccagcctccgccgctcgggctccttcccagtggacacacaaaggttcctgcggcccgacggcacctgcaccctctgtgaaaatgccctacaggagggcaccctccagcgcctgcctctggcgctcaccaactggcgggcccagggctctggctgccagcgccatgtaaccagggccaaagtcagctccactgaagctgtggcccgggatgcggctcgtagcatccgcaacgactggaaggtcgggctggacgtgactcctaagcccaccagcaatgtgcatgtgtctgtggccggctcacactcacaggcagccaactttgcagcccagaagacccaccaggaccagtacagcttcagcactgacacggtggagtgccgcttctacaggtgagagctggggctaggggtggggggctggaaaaggcgcgggaaactctgggtggtctaagagccctggaaaggcagagttctccaatcaaacttggaggctgcttccaccaggaagaaactgcaatcctggctctcagacttcaggtgattcagccctgtggcctcctctcatccaggaggtcccaaatctgggagtgcccagtgagacatcaagtagagagaaagtgagtgagaccatgcctgagagtcccagcagggtgccatttaggtctagtgagtactgaaccctgcctttcctgggcacagccagccttccacagagtccttcctggatagggacagaggcaggagacctggccgggtcatccttcctcatcgctgtgtgaccttgagcatctcacttctctctgagcttcaatcatccactcaaccaatactcacacctgcctgtggcagggccacactgctgagcgacagcagtcactaccctagcccctgggagtaggaagtatgggacccatattccacgtctgagaaaggcacagtgtttgtaggccagacccaagtcacctggtctgattcatcagacctgggggccacgtttcctccacagagaggccgagcatggcccaagctgtcaggatcccgggcatgtgggacccatccagggggacggatggatgaaggccacatgactagttccaaagttcgacagataccatcagtgcaggatcattgcttttatgttcttttttactttttcttaaaaaaaaaatagagatggggtctcactatgttgcccaggctggtctcaaactcctgggctcaagtgatcctcccgcctcggcctcccaaagtgctggggttacaggcatgaaccactgctcccggccaggatcattgcttttataataagaaaattaaaaggaaagaaaaaaatgttattttgaaaaggaaaagagaaaatacctatacagagcactgaggtccctgaggggtgagagcggaggcattcctgccagccccgtgccactgtgcttgtgctctggagccgggcccctgggttccagtcctagttctgcccacttacatgtgaccttgagcagtcctgaaggagttatttgattgaatgggggaaatactcccctgggcccagctgaggtctctctcttctcgcagtttccatgtggtacacactcccccgctgcaccctgacttcaagagggccctcggggacctgccccaccacttcaacgcctccacccagcccgcctacctcaggcttatctccaactacggcacccacttcatccgggctgtggagctgggtggccgcatatcggccctcactgccctgcgcacctgcgagctggccctggaagggctcacggacaacgaggtggaggactgcctgactgtcgaggcccaggtcaacataggcatccacggcagcatctctgccgaagccaaggcctgtgaggagaagaagaagaagcacaagatgacggcctccttccaccaaacctaccgggagcgccactcggaagtggttggcggccatcacacctccattaacgacctgctgttcgggatccaggccgggcccgagcagtactcagcctgggtaaactcgctgcccggcagccctggcctggtggactacaccctggaacccctgcacgtgctgctggacagccaggacccgcggcgggaggcactgaggagggccctgagtcagtacctgacggacagggctcgctggagggactgcagccggccgtgcccaccagggcggcagaagagcccccgagacccatgccagtgtgtgtgccatggctcagcggtcaccacccaggactgctgccctcggcagaggggcctggcccagctggaggtgaccttcatccaagcatggggcctgtggggggactggttcactgccacggatgcctatgtgaagctcttctttggtggccaggagctgaggacgagcaccgtgtgggacaataacaaccccatctggtcagtgcggctggattttggggatgtgctcctggccacaggggggcccctgaggttgcaggtctgggatcaggactctggcagggacgatgacctccttggcacctgtgatcaggctcccaagtctggttcccatgaggtgagatgcaacctgaatcatggccacctaaaattccgctatcatgccaggtgcttgccccacctgggaggaggcacctgcctggactatgtcccccaaatgcttctgggggagcctccaggaaaccggagtggggccgtgtggtgagaacagtgagcttggaaaggaccagtatgcttggactgaaggggttctcacagtgggagccagggctgtcttcgtattcccattagaccaagcttatccaacccgaggcccgcatgcggcccaggatggctttgaatgcggcccaacgcaaattcgcaaactttcttaaaacattatgagtttctttttgctattttttttttttttttagctcatcggctatcgttagtgctagtggattttacatgtggcccaacacaattcttcttccaacgtggcccagagaagccaaaagattggatacgcatcagacagatggaaaagggagattcagactgtttttcagggaggtggctgggtttacacgctaatcccgattcaccctgtccaaactgcctaagccctccgccattctcaagccctgcagtcacagctacacagatcacagcttcagccaggagctgggcagaaggccaagaggctgttcccaccaggctgctcagggctggtcttttaggacccttcccttgagccctctatggtgtggcaaagccttcattgccttaactggagccccatcagctccagctgctctgtcttctttgcccacaatgctttgcccctgagacaaatggaggcctgtcctgacctgtctcaccatgtacatagcttgataaagggccaataaatatgatgttatggtgatcatcatggtggtgttgtggcagaggaaaagatgggaccaaacacaccccagagataaacttctacattggcaacccagtgaaaacaggctggcaggtaatgtatataaactgcttttccacttttgtcagaaacgtggggacccaaaatattttaccttcctcataactctctgactcaagaaagcagcagcataaacatgataaatggcaacaggcattcagctcccagctggaagacaatagggcatggtaaggactgtggtcaactaaagagtgcatatcttttgtgcggggggaggggctgcagtgctgctccagccaaacatttcatgcaggaacatgagccccgtgctgccaggtcttctacttatttaaggtcaaaccacaatttgacttctaactgtggcagttaatttcattttgtgaaaatacacctttgtgggcaaacatggtgcaagccaaagagaacatgcatgtgggccataattgatccagggctatctgctttgaaaattctaccttcaacagaaccattttgcacaaagctgaaaagctctcccctgtctcacgatttcaagcaaaggagcattggttccaacaaggtgggctctgtgggcctcctaggccttggatgcaaaaaaacccagagtctcggcttccaacataagatgaaatggtctttgtttcatgtgcccgggacataggcctcagcacacagtcccgtggagtggatggcaagattccaggcagcttcctggacacggctgtgcaggctgtgcagggtcattgtcagagggtccagaggagcgggcacagccctcccgactctctttgaaactccctataaattaagttctttgaagtttgtatgggactcataggcccaaatgccaagcagtgacatgacattaaccctaaatccccaggtgggacaggaggggtggccaaggtccaaaagcctggtgaaactactgttaccacatgtcccattcacagacacacactcaaaccagagcatgagagagacctcgacacttcacggtggctgctgcgctcattggaaacaaacatgggggtgggcggtgcctcccggggaaagcaggttcaaaaggccagggcgggcctggctcaggggacagccctgacaagaaatggaagtcttgctcaatagctatgtgatcagtgacccccagcaagtctctctgcctcctgggccccagtttctccaaaacgacagtctattttactcccttcttaggactgtcttgaaccttcctagtgctacaggagggtg

SEQ ID NO: 13559 - DNA, 8894 bp, Human
agggaacctgagtgtccatcactgatagaacaagaaacccatggcagattctcattacaaaatactaggctgcagttaaaagctacagattgaatatacatatagcaacatgggtagatcttaattttccactaaatactctgttttgtaagaaacagactgagaaatgtaatatatttacataataccatttacataaatttaaaaatacacatagacgaaacaacaccacacattttgcaagaacctgtgcaaacaaaaatacacattaacacattagagaggctgctatgggcggtggtggggggcggggaataaaagtggagcacaagaataaaagttaatagaaaaatgtgaaatgtgagaggacttttctaatctgactctaagacttattataaagctataataatcaagacaaggtagtgttctgtcatgacagacaaacagatcaatggaacagaagaaagggctcagaaataaacccacatgtatacagtcaattgatattttacaaaggtgcaaagacaactcagtggagaaaggaataactgagtcgccatgtgcaaaagtgcatctggatctataacttgaagcatataaaaatatttactcaaagtggatcacagactaaatgtaaaaccaaaagctataaaacataggagaaaacttttgatcttgggttaggccaagatttctatgtgtacaacatcaaaatagaaatccataaaagaaacatttgatatattggatttcatcaaaattaagaacgtttgctctttgaaaggcaccataagataatgcaaagaaaatatttgcaaatcactgcctgatcatgtccttatatccagaataaaacaccctcaaaactcgataagaagacaacccaatttcttttttaatgggcaggaaattcaaacatgctattcaataaaaaaaacttatccttagcaaataagtacatgaaaagacattcaatacaattactaatcaaggaaactcaaaaccacaatgagatactgctacacaccaattaaaatttaaaaggctgactatatcaagtgttggtgaggacagagaactgcaaccttcatacactgctgctaggaatataaaatgatacaaccattttgcaaaacagtatggcagtttcctaataagttataaaagtccacctaccacatgacccaggcattccattcctaagtgtttactcaaggaaaattaaaacatacgtactttcgaagatttgtgcaccatattcgcagcagctttatttgtaatagccaaaaggtaaacaacgcaaatgtccaatagtgaatcgctaaacaaattgtagtctatctgtacaatgcaatactataaaataaattttacttagccataaaaggaagaaaccattgatataggcaacaacatggctgaaccccaaaacagttatcctgcctagtatatactctatggtccatttacataaaattctagaaaatgcaaactaatttatagtgacctaaagtacatcagtgcttgcctggccaggtggtttcgggaggaaggggttaccaaagggcaagggaaaacttgcagggatgatgatatgttcataatgttgatctcggtgatggtctcacgagggaaacattaaaatttatcaaattgtacacgttgaatatgtgcaatttattgcatgtcaattatatccaaataagagatttttataaagaaaaaaataggtattctggcgcccagggccacccagctgtaagcggcggggtgggattccaacccagaagcgggcatttggagccctcatgcttcaccctagctccctgaaacaagcacggaggatggctctgagcagcgaggaaagtgctggaagcaagcaggccgagcgcgtccctggctggggacgttaatcattaccggagggcggcccgagcgcggccccgccccgggacggcagcctgcgcgcccggccgccgcctgccctctccgctggccacctgctgccgcccgcgccatggtgagtccaggggtgcgcggccgcgatcggggcagcggggccggggcagccgcgggcgaggtgggagcgggaaggggcgggggaaagtcttttcgagtcccctgcggagccgccggggtccgaaagtggggtctctgcccggctctctgtcgccggcggcggggaggggaagctgaagccctgagaggggcggtggcgggtccgaatcccacccagttgggaggccaggcctgccctgaccccggccagtgcttgttccgggacccttccgggggcggggcctacgaccttcctgggccggggaagacagtcgtggaggagtccacggatctcgtccccttggtggcccgattctgctttatactggggtgggagcgagagggaggctgagtttgcgcgctcgtgtgcgtgcctgtccgctgccccttcccgctggcactctgggtacggggtctgcctgggactcacgctctgcgccggtatgctggccccagagccagtccccgcgccggcttgaggcccgtgccaggccacgggggcttggtggcgctggagcagccctcctcccgtgagcttcccccacccacccccggggcgggggcgggggcggggcccttgctctgctgtaagctcgcgagcttcatcagaccatttctggtccacaggccttcggagcaggcaagactgggagggccttttgataggagagggacttgggggagggaggatgagtggggctgtttgtgaggggcgctgaggtcccagagatgcaggcttgggaaatcggtaaccactccccacacctcgccagaggaggcaaacggggcagcgtccccctctctgtctccagagccggcacctggaaggtttgtcagttcagccgcaggctgtgcgacctggggggttccagaaggctctaccgagaaagggaagcctcctaagagctcacctggactcacccacccctttaagagccaaggaagtaaacagtgggctctgatgctttggctgacttctggttgtctagatacacggaccaggcggtcagccacggggagaaggccagctctggagtagagacctacctactgggcagatgatgcaaatcgctgctgccattcaatccctatagtcatccagagccgaggggaagagaggggccaagctacatcagtccagagagagctcacgttttcaggagggaaaacagcagggaaaaaagacggacttaggaaagcactgcgatgcttcagctaccccaaatgctaccaggcccatcacaagcctgcttgccttaggaagttttttttttgtaatgcagatgacatttgctttatagcagtggagtttcctaaagtgtcccattggcacctcatgatgatctgtggaggtggaggttctgccaagagaggtacagccacctggctggtaaatggtgaaagcgggtctcaaaactcctgccaatcaacacatggtgtccagtctgcaggctgcctcataaaagctaaatcaacctccctcacattccctccccacccctaagggtatcttttcaattcagcactctatttctgccctggggtggtgctactctagaagcctaggttctgggatctgttaagctcctagacctggatcctcctaggatgaaactgacccttgcttccttgctttctctgaggttccactcatggcctgaattgtgccaatttgggctgccttgagggcacttcgcacattaggtaaataggatggggcactaggtttgccagctgcctttggccaagttccttccactttggcctgagcttcccaaccagccagaaaagcagacggaaaaccagagaaacctagccctggcggctcaggaccagaggctgcctgggagcatgactgaggacctactagaggtagtgccaacggcggtcagctgcagtgtggctaagaatgggatggacacttattttaaatgtagctccttcgtccagccccagcaatgctgacacacagacaacactgcgccatcactggctaggggtgggcgggaaagaacagcagacaagtcgtttcccctctctaggcctgtttcctcttcaatacacgtgaaagttacggtagggacgtggggtgcatatgatgaagtacataataggaaaaggaaggggggagagtcatgggtactcttcctgagaggttgtggagtaacatatttgcatctgggatttattttgcttttacgccctcactgatgtaataatctcatggagggaaggtccgtaaggctttgagggcagggtgggggaagagtgcttctctgtccccgtcatatgaattacattgcttttgtgatttcccttgtgtgtgtgtggagtgttaaaacccaagacctgagggcctatcggcagacgagcctggaccccacctcctgggcagggtgccacccttgaggcctcccagcctattgctcaaagacctgctgccctttggtcacccacgtccaaagcagccagtggaagctaagttcccctaaaggttggagcccctctgttttgacctataaagagaaatgcccttgggcctctgtttttttccctcttctaggctggcaaagcacacaggctgagcgctgaggagagggaccagctgctgccaaacctgagggctgtggggtggaatgagctggaaggccgtgatgccatcttcaagcagtttcatttcaaagacttcaacagggtatggcaccagggtgggacagagttttctgagacgggctgatggggtcaccttacaaagcatgttctctcccttcacgtcttgttagccaagactctcagacaccacactcatccagttatttgggcactgtgccagtggggaaattaattttcctgtctaactcagaaagtatcatctttggggattggagagccataggaggatgtgtcttgggctctcccttcctggaacttttagcagcagtcttctgaggagatagttcaagtggaaaccatgcacatctgaagacatttgaacagacggccaagactggccaggccaaaagcctgttgtggtgtttccaccttgttggcatcctaaatagcaagactttcttcctactgcaaggacaatctctaactcaagcctgagaaccagtgacaggatgtcaagggggaaatgattatagaggagtctcctggggggaagctaattcatcctcctgcgtctaggccttgaattggtgatgtccagaagtcctttctcttagaacactaacctggctctcactccacttaaataggcctttgggttcatgacaagagtggccctgcaggctgagaaactggaccaccatcctgaatggtttaacgtgtacaacaaggtgagtgatgctgtgtgcctctgttgtgctctgcccccatccaaatactgcgaactctgacacattctgaaggcttttggacttaacaatgagccttcctgacccataggtcatccactcatctcatttccaatctcactgagattgcacatgcctagaatcaacataaatacccctgggaaaaaaaaatcagtcttactataaagaaatgcaaattaaaagatgcatgagatagttgtggttaaagtagacatttaagtagacattaagaaggcaaaacccaagaaaggaaaggctgtgggaatcaggcatacttattcagtgttcatagctctaaatggctttaatcttgctggaggtatggaagaatgaaaaagtaataaacttgaactaagaatacacacatatttgggaggccgaggtgggcagatcacgaggtcaggagatcaagaccctcctggctaacatggtgaaaccctgtctctactaaaaacacaaaaaaattaggcgggcgcggtggtggacgcctgtagtcccagctactggggaggctgaggcaggagaatggtgggaacccgggaggcggagcttgcagtgagcagagattgagccactgcactccagcctgggagacagagcaagactccgtctcaaaaaaaaaaaaaaaaaaaaatacagacacatagccaacctatcaaattatttgcttaatgaatagaaacagtcattaaatgtctaccatgtgccaaaagctctgctggtctctgtttataaaaacagtaagggtggaagaggtcgtctatgaatggatagtgtttaggagttggcattggtttttggttttgtctttagcttttaggttgctcttgacattcagatattaagcttttattctatagctgaagtcatgattatttttgagagacagcaaaggggagatgtagaagatgttgttacagacatgtcaggaaggagtccccaggagagatcgtactggccagctgctattctggagctcctagcagggctgagcccagcagctagtgactccctcctgttcttaagtgaagtcagtggaagcagaatttctggtttcatttcaggtccacatcacgctgagcacccatgagtgtgccggcctttcagaacgggacataaacctggccagcttcatcgaacaagtagcagtgtccatgacatagaccctgcccttcctctttgaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttggtctcaggctctagaaacttcttttccacaggtcaatccaaattggagtcaataggcatttaaatgaaagcacttcctctgtgctaggcacttcctctgttcaaggtactggaaaatgacagggaccagaccaccttgccttcagattcattatcatctaggggataccatttgattatcatcaaacaggaacacaattaactattaccaattaccaattaactagtactaattaactattactagagtgaattaatgctaggtggcaggataagaaatgagctaaagggaacgcaagtgattaatggtgaaaagggcaaatctggaggctttgagttatgccttgaagacctgggtaggattcttgggaggcagagatggctgagagaacaccatgaacacagataagggtgtgaagggcacaggtattatatgcattgtggaacctatgtctagaaaggcagtctggggccatattacaggttgaacatccctaatttgaaaattggaaatccaaaatctgaaactttttgaatgccaacatgatgcccaaaggaaatactcattggatcattttagatttctgattttcagattagagatgctcaacttgtcagtataatgcaaatattccaaaatccaaaatctgaaacacttctggtctcacacctttcagataagggatactcaacctatattttcttcctggctgtgatggctaatgttaggtgtcaacttgattgggccatggggtgcccaggcatttggtcaaacattccgggtgtgtctgtgagggtgtttctgaatgaggataacatttgaatcagtagactgagtaaagccgactgtcttccctaacatgggtggcctcattcaaccaggtgaaggcctgtacagaaaaaaagggctaaaaagggctgaccctcttccaaataaaagggaagtcctcctgcctgactgccttgaggtgggacattggtcttttcctgctttcggacttaaactgaaacatccactctccttaggtctcaaggctacaagcctccggtgtgcaacaataccatctgctttcctggttctccagcttgccaactacagatcttgggacttgtcagcctccataatcacatgagccaattccttataagaaatctctttgtgtgtattggttctgtttctctggagaatcataatacacaggcctatcatatcagatatggcagatcccaaatcctgatggtctcttcagtttcttaaaatcttagcaaagttcttagggcttgcctggtttactccacaagagagaagacacaggcagcttaggacctggcaggctatttattactggagcagttaagagatggtttgcacagtcagttccccagccaggaactctctaggacagaatattcccacgctgtcatgaagaagggggcactaagagcagcctcatctctacccccacgagaatgccacacaaattttacctcacatatgtcactatgcagagactgggaagccttcttcctaatagttctcacctgtgtctcctaactcaagtactaagctgacttgtaaatgccggggtcacttggaacaggaatctagccatgtcacaactcagtctgaatgagttggtcccccagcaaaggccaggaaaggggcagaggctggaggttgagaaataagcgtattgttcacaagagggattagcaggaccccgttcctagcatatatgctagtaaaggattatcaatacctatattgatggcaaacgagattcagacagtggtctcccatctgctccacttctgacttaaaattttccaagtgtgctttgatctgatgact

SEQ ID NO: 13560 - DNA, 11858 bp, Human; identical to SEQ ID NO: 12652

SEQ ID NO: 13561 - DNA, 12211 bp, Human
  misc_feature (1)...(12211): n = A,T,C or G
gtttgatcctctgggccaggctttcagcttgggcctactaagtagaattcaagatctctttaaaatggatgcaaatttgtgtgggtttaggctgcatttctataaattcatcatcccccaaaaggttaaaagacaggttttgtttatacagtggtggagccgatgagaaacggaacctcagagaccagggaaagtggccctgtggcagacttgctcaaaggggcctcagcaaccatctccccctgcagcaaccccagctggcaagctgccactccttacataactgttctttggaaaaccaggcaacaaaacctccaggggaaaaaaagctattgattattaaagggtatttagaggtttagagactcacaataaagcagttataattattcctgtaatgacacatccttcgaaatgctcagatctgagaacattttgcttgcattgcatcagtcatcatcattacagggagaaatgcagagagctggaaatagctcgtgtgcaagctacaggcaaggagtcacaaggaaaggagcagattgacagcgagtcagtgaaggaaacaggggagcttccaatgcccagaacctgcacacagtcctgcagcctctgtctccctgccttgctgccccgcttcaaagccagcttctgctgccaaaggactcttggggttgaaatgcttgttgcacagttacacatcagctgacagtccttctctgatttaatgaacttcatctatgaaaaataccctcaacaggccgggtgcggtggctcaggcctgtaatcccagcactttgggaggccaaggcgggtggatcccctgaggtcaggagtttgagaccagcatggccaacatggtgaaaccctgtctctactaaaaataccaaaattagccgggagttgtggtggacacctgtaatcccagctactcaggagtctgaggcaggagaatcacttgaacccgggagacagaggttgcagtgagccgagattgtgccactgcactccagcctgggtgacagagtgagactccatctcaaaacaaaacaaaacaaaacaaaaaccctcaacagaatgtcaaaaaaaaaaaaaagaagaaagaaagaagaaaagaaaagaaagaagaaacctgggaaataccatcatctttctgcttttgataataacaataactagcatttattgagcatttactctgtatcagacactcctctaagtactctctgtatattatctcatttaattctcacaaaaattcatgagctaggaatgataattattcccatttactagacaaagaagctaaggcataaattggacacagttatacttagtatggggcagagtcacaatttgaacctggctggggtgaccctggagcccccagcaggccgctccctgttaaggtttccaagcgcactcttgggctggtagaacagccagcaagacgagggcagggggagggatggtgtcagagaggcatctccctgaagaatctcagaggacactaagtgttgggcaacatttggtttggtttcgtgtctttcgtggttcacttggaggctttaatcccccactttacatagccctctccacgctgtttctgttcatttgacaagtatctactgagccgacactttgaggtccgtgggtgattctgaggagaactagacacagtgcccatcctgggagatgcataattaggtgggacaggggtgaaaatcaatccaacaaaccagaataccaggcagagagcgccctcgtggaggtgcagaggctctgaggaaggcctcacagcaacaaggacaggcaggtgttcccctgcaggatgagggttcacatgggctggggagagaagaggagggaccgcccacagaggggaccatgggcacagcactcttacttcatgattgtgtggccttagaaggctcagaatgacaaccccagctgctttgcgttcccgcagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataaggtaaaaggcgaacctcccgtttgttttgctgcctccgctgtgaataagcgttctacaaggttcaatgtaattatgctgctttaatttccactgcacaccttgggacaagtatttatcttatttggggtttccccaaagcagacatctgctgagacaaagactgcaggcagagaggtttgggatgatcccgggacgcacgagagcaggtgggaaggtgagtcggagacagcacagaagcaataaagggtgcgttcctgagctgtcgccctgggccgtcagggtcagtcacactgggcaccctctgaggacacgtggagcatgcccctccgattgtcccacagctgctgccagcaggtcatgggagcatccgtggctctagctgagccccctggcagaggagagacacagggtctcaggtgggaggctggcagtgtctgggaattgcctaccgtggctgcggtgaactcagaggtgggctgaggggaacaggaccagggaaccatagtagctgctacagagctattatccttgttctacagatgcagcatcggaatctccctccccagctcacgcagctggtaaatgcaagtaggattcaaaaccaggcttctcagcagtgcagggcacccaaaggtcactcaaacagggctcaggaaagcccaaaattctccagggggctttcttggtatctgcaccaaaatgtcatcaatacaacgagctcctccatagatggtctttcttcctggggtttagcgggaggggaaggaagagggcggcagaaagaggcagctattggaggacaggactcacaggctcccactgttgctactcaagcctggaatctcacccttaagacttcctctccttaggagaaggtttggatctcttttaagaatggcaacagtaacatcgaagttgttatcatacactcgcacctcaaggtgaatgagtgttgggacctctgaggggacgctgggtgggagaaggagcaccatccatgggatcaggagatacaggtgtggtaggaagaggccatagagtacactaacgtctacactgacttgctccacttacaggctgatccctttattcaggtaactctgatagaccacagagaggctttaaagaaaacatccaaggaatctgagttatactttcgcttttggatacaaatcccaaagcactttggaaatgataactgatctgtatttatagaagtcctttgagaattaaagcaggatttaaaaaatagcagctttattgagatataatttgtatagcacgtaattcacttgtttaaagtagcttttcactttccattgttgttagtatcatcacagagttacgcaaccatcaccaccaccatcgatttagaacatttcactgttccgaaaaggaacctcatacccattcacagagtctccatctcccctccaacccttccagccccaggcaaccactaatctactttctgtctccgaatttgcctattctgcatatttgataaaaatgaaatcatactatatgtggtcttttgtgactggtttactgaacgttttcaaggttcatccacgttgtagcatgtatcaatactatatccccttttattgccaaataatattcttgtaggaaatcgttataggaaatcaattgactgtatatgtgagagtttatttttgcactctcagttctattgatctatatgtctatacttatgccagtaccacacagtgttgattactatagctttgtagtaatcaaagccttgaggtaagctttgaaataagaacacatgtgtcctccaactttgttcttctggttattccgtgtcccttacatttttatatgaattttaggatcagcgtgtcaatttctgcaaataatccaattggaatttgatacagattgcattaaatctgaagatcaatttggggagtactgccatcttaacaatattaagtcttctaacttgtcaacatagtgtatctttccattgaattaggtcatctttaatttctttcaacaatactttgtagttttcagagtataagttttatgtttctttggttaaatttattcccaaatattttattcttttgatgttattgtaaatggaattttcttctttttcttttcttttctttttttttttgagacggagtctcactttgtcacccagggtggagtgcagcatcaccatcttggctcactgcaacctccgcctcccgggttcaagcaattctcctgcctcagcctcccaagtagctgggactacaggtacacgccaccacacccagcaaagtttttttgtattttagtaaagacggggtttcaccatgttgcccaggctggtctcgaactcctgagctcaggcaatccatccgcctcggcctcccatagtgctaggattacaggtgtgagcaagccaccgtgcccggccttttaaatggaattttcttaatttcatctgcaaattgttcattgcaagtagagaaatatgtttatatatgtatatatttttgtgtgtgtgtgacagagtcttgctctgtcacccaggctggagtgtagtggcaccatctcagctcactgcaacctctgcctcccaggttcaagagattatcctgcctcagcctcccgagtagctggtattacagttgcgtgccaccatgcccggctaatttttaaattttttatagagatggggcctcgccatgttggctatgctggtcttgaactcctgacctcaagtgatccacccgcctcggcctcccaaagtcctgggattacaggcatgagccactgcgtctggctgagaaatatatttgatttttgaatattaatcttgtatcttgtaaccttgcttaactcattagatccaatagtttttggttttgtctctgttttagatttcttaggatattttatatgtcatctgcaaacagatagagttttacctcttcttttctaggattatttttcaatactgaccagagatctgaaaagattaagaagcctttgcaaaaataatatgagatcataaggaagctctgagtttcctcttttctgaaaaatcatgcttccttggtttttactatggggcactaaactcactttaacagaaatagaacagatttgaatgcaccatagaaaatggagcttcttccgaggaatgtctatgaaaccagttaacctctaaccttattctttggtactttaaatgaatgttaagttcagtggctttaattgnnnnnnnnnnnnnnnnnnnnaattgaagctgtgctttaataagtgagtagaactttatggtcatgaatgtggcatacatttgagcggaaagccgtggctgaagcaatactcacctgtgtgcagcatcctctcttttcaagttctgactctgaaggtgagcgcatctctttttgtttttaaatttctagaataggccaggcgcggtggctcacgcctgtaatcccagcactttgggaggccgaggcagggggatcactaggtcaggagattgagaccatcctggccaacatggtgaaaccccttctccagtaaaaatacaaaaattagccgggcatggtggcacgtgcctgtaatcccagctactcgggaggctgaagcaggagaatcacttgcacccgggaggcagaggttgcagtgagcccagattgcactactgcactccactctggtgacatagtgagactccatctcaaaaaaacaaaattctaattagtattttaactagataaatatatttacattgttcaaaatcctaaaggtgtaaaagaatacaccacataaagtttccctcccacctctgtacctcagtttccctccccagtagcaactagtaaaaaccatgtattatgtaattttacagataatatatacatatacaagcaaatacttaataactgtggtaagcagaagagtggcttccaaaggtgtccacgccctaaccttgtgaatgttactttgcatgggaaaagggcttttgcaaatgtgatcgaagttatgagccttgagatggccagattagccttgattatccaggggaactcaatctaatcacataaatccttaaaagcagagaatctttcccagctgtgataagagagagaggtttgatgatggcataagagtcagagagatgcaatgtgagaaggatctgacttccttttgctggctttgaaaatagaggaagcctcaagccaaggaatgtaggcggcctgtagaacttggaaaaggcaaggaaactgatcctcccctagagctcccagagggaaacacagccaacactttgagttcagcccagtgagacctgtcagacttctgacttacacaactgcaagataataaatctgtgctgtttgaagcttgtgctaatttattatagcagcaacagaaaaccaacgtaataaacattttctccatttttacacaaaaggtgccttaatagatacactattttgtacctgactcttttgtcattaaatattagaaatcactgcataccactcttttgaaagaggaagtaaaattccattgtctggatatgccatcgtttactcacccagccccctactaatgctcacataggctgtttcctatcttgtattattacaaacggtactgtaatgaataactttacacatacatcatttcttatatcaggaggatgcattcccagaagtgaaattgctgggccaaagagtataatatgtatttttagctttgctagatattgccaaactgccctccgcagaggttgtaaactggtatggtctccctgcaacgcgtgccaggcagcctaggagggcctggttccctcgaccttccccacacagtggcagcttcctttaaagctaactgtatacacctgaagtctggactgagcgcaggcccctagagaaagcatgatacagacctttcaaatccccaccacctctccaaagccttgatgactaaatccctcctcagggtcagatgaggaaagttccgtgcgctctggagtcctagctccccacagcgaacgcatctgactttgcacaggattcaaagatgacttgtagaattgtgcactgtttcagatgaaaggtatttcccatcatcccctttttttacagagtctagaatgtcacagcgattttggctgaagtgggccctgagaagagccctttactcagcattcaccccctgcccgcacatcccatcctagtcacagattctcattgcaatcaatctcttgcccagttgccactgggaacaatgaggcccattttgtctggcttccccaggacagggctctgcgtctgcacgacaatggggaagaagttgcaggtccccagagaaccacagggttttgctctgcttgttgtctctgcagtatctcggaagatggtacgaaattgagaagatcccaacaacctttgagaatggacgctgcatccaggccaactactcactaatggaaaacggaaagatcaaagtgttaaaccaggagttgaggtgagtggctgtgggcgtccggggccaggcctgcggagtgctgacgcagagtgactgggtgtccggcagcctgggtcagggaggatgggaaccttgctggatcgggactgcctgctcctagcaggaattgagaggaaagcgtttggcaggcaaggatggcaaggactaggatccacttatgcatttccatgaccacctgcggggcacaaactgacagggttcctgcactcactgcaaaatagatactctggtagcaaagaacatcaagaccatctcttctgacctccagtctgggagagaagccgcttcgacaccatctgctgacagaagcatccagctttgttcaaacacttccaggaactgggagctcatcgccttccaggacagttcatcccatctctgggcagcttaatctatcagaaagctccttttcttactaagcaagaatcacatacacaacattcacactctaggttatgtaaacaggatatcctttagaagtgtacatttctattactgagggcttctaacacaataattaatccaaaaagctacgctttggaaagcaactataaacttaaaaagagccccaggaagagctccttcctacccaccttccactcttgaaaatacaaatgcagtttttccatgaacatgttgtgacttcatggtcagagactggtgtcctgaaaaccgttctagagcaaaatgcaattgacggtgaaaagggcagaatctgctgggaggagactggtttgttgctaagttaacgtatgcagatagaaacagaccatcttccccagctgtctgagatccagatgagagaggagggcacggtctccagctttacatggtgataaacagagaaagtacttgggaacatcagagcacagttcccagaatccctggcctgttgctcattgtcctgtttctaggacatccgtcaccactaaccatagcattaacctactgactttcttttttttttttaattgtattttagtagagacggggtttcaccgtgttggccaggctggtcttgatctcctgaccttgtgatccgcccccccttggcctcccaaagtgctgggattacaggcgtgagccaccacgcccggccaacctactgactttctaacacatacgactgctctaatttcagttggcctccctgctctgccttgaggattgataaacagacatcctctcctctgttggcttcctaggaagagcaccctgatgccttagcaccctccctttggtgcctccatctccacacctttccccttctcccaagttcatggggccattgggagtcatctagaaagcaggctcattcaaagaggtgaaagtattgcatccaatctaagcccccagcttttaagacacaccactgcgttatatgccactaagaaaggaatgacactgctaattgtcaggtgacatcaattgtgagatatgcatttcttcacatttaatgtctctgaaatctgggcatacctgagaatcactgagataaagtaaatgtttcttcactgcctccttttacttggcctacattgaaatcccccacactcactcagaggcttgctgaactagagggagtctctggactcaggccccttgatgggacaggcgatgtcacatgatatcactgaggcccaaagaaggggaacgcttttatgtctccttgttttgaattattttcagtgatcaagtccatcctcatctgtacctttggcccttctcgttttaaaaagaagtgaatctgccaggcacggcggctcacgcctgtaatcccagcactttgggaggctgaggcaggtagattgcctgaggtcaggagtttgagaccagcctggctaacatggtgaaaccccgtctctactaaagatacaaaaaattagccaggcgtggtggtgcatgcctgtaatctcagctcctggggaggctgagggaggagaattgcttgaaccggggaggcagaggttgcagtaagccgagatcgcaccactgcactccagcctgggggacagagcaagactccatctccaaaaaaaaaaaaaagtgaatcttctttgtgtgttgggttgttttgtttgtttttccattctcttttctccctttctttggagcctgggagcaggaattggtctttcaggccatagaagatagtcagagatagtgttgaagtgcaagggcctaacatactgtcccatcctggagcttgtcaattgcggcttcttatcatcccgctgctctcttcccctgcttggcctcagagacagtcacaagggaaaggccaggccatggagctagggtctagcctgcctttgagagcctctcttaccagaaatcacggtgttggctgccacggtccttagtggcacaaatcttgcctttcgttgcttattggctttcaatgagttgtttttcttttctcttttcgttttttgtattttttctttttttaactcactgcagagctgatggaactgtgaatcaaatcgaaggtgaagccaccccagttaacctcacagagcctgccaagctggaagttaagttttcctggtgtaagtatccacttttcccaggaggattcagggacaggaaatatgcaaactgaaggctagcgccccggcttggagaattcctgagacacctgagtgtcatctataatcactcagcacataattatctgtcaaacacttactacatgtcacgcactagggttgccatgatgagccggacagagctggccttggtacttatggagctcacatcccagtgtggatactgacacgtgaccccgcaatttactataactagctagcgtttcaacaggtgaaacacaagtaggtgcacaccgggtgtgggctgcagaagacacaacccagtcttgtttcccaaaggaaactggggcccgaaacattagcagatattagcagaacaacctgcacggcgcagaaactaggaagcaagagatgacaagagtgacggcaagtttgaatcctgcttctgccactttccagtcacattgttggggatcctgtgagatacctaatgacaggcatttgcctctgggttctgagctaactgaggaagggacacaggcaatagagaaagcaccaaatattagttttatttccgacgaagatacactagagagttcaacccagaactgtgaggctttctaacacgaagagtgcttgaaagcccctttcccacctgcagggtagacactgaagtcatcagctacaaaagttactccctgcacttcctacttctcacctctgccactcctccaccccacaccagtcaagtgcctagagcggggaggagaggaagttctaattttatagaccaagaaaggaatgctgggaggagaaaacagttcttctcacactatgaatatggacaactaacttcacatgtacaagccagaaataactgcccagtgtcgtgaaaataaaccagatacacacgctctgtaaactgtaaagggctttatacacagtttctcttgttatttttatcaagaagggagctaaagtgcaggtgggctgagtgacgcaggccatcactgaactcattagaagtagagttgggacctaaacctaggtctccaaactctcaactgagtatttttcccatagggatcagggacggggattggagtgaaagctaactattacatgcataacaaggattagatgtttgcgttaggccttgtaggattatgggagattatggaaaaggatttccaagtgaagggaactggaacatagaagaaggcctgaatacaggcatatcacgaagtcaggagttcaagaccagcctggccgacatggtgaaaccctgtctctactaaagatacaaaaaattagctgggcatggtggcgtgtgcctgtaatcccagctactcaggatgctgaggcaggagaatcgcttgaacccaggaggtggaggttgcagtgagctgagatcgcgccattgcactccagcctgggcgacaagagtgaaactccatctcaaaaaaaaaaaaaaaaaaaaaaaaaaaaacgaagaagaagaaggcctgaataaagaggcctagagcctgggagtgtacatgaagaggggcatgaggttaggaagggccttgaatgccacattaaaaggcttgaagtttcttccataaacaataggagactgtcaaagttttcaaataaggagagacatgtgaagttttctgtattgtatctgggtaaatttattcttcggaactggaccacgagaggaaggcagaatgtgccagcctgggtgagtgcaggtgggccatgatgccgctgctggcagaggtgggagacagatttttgcaaaatcactctgggcttaagagttctcagtccacctgggaatacacagagcagctgaaatgtgcagatgggtgatgactataacgctgtctctctctctctctctgtctctctctctgggtgagtgaggcaggcaggcaggcagggcaccaacagtgctagaaagggtaagtcagaaacactcagtctaggctttcgtccaaacttctttccagg

SEQ ID NO: 13562 - DNA, 12770 bp, Human
  misc_feature (1)...(12770): n = A,T,C or G
agaatctaacacatcactctgtttgtctcctcacaattgttaccactggattttttatttggttacttcttccttctttatttcaccttattagaatatacagaccccaaacatataggctctgctgaccttcactcccttgggacctcacttagttccacagttaaaattaattctatcttcttgctgacaattcccaaaattgtatctctagcccagacctctctcctgaattctagactcgtatgtataatgcatacagacacatacacacacaaacttccattacatattcactgcatacacatgtctctttattccacatgtccaaaatcaaattctggaccctattaccccaaaaaccttcctcagtcggaaacttacccatcttaattgatggccaatccatcccaaggcagtcattttgactcctctttttctcttacagtccacacccattaattccatcagcacattttattgtttttgtcttaaaaatatatccagaatctgaccaacttctcaccattcccactgctaccatcctggtcaagccttcaccagctctcacctgcaatattgcagtaacctccaaagaagtctccctgcttctatcattgcctcatcccccattataatctattctcctatctccgagtgatctctttaaacataagccaagtcacttcaaaaccctgcaatggctttgtttccctcaagagtaaaaaccaaaattcttcctatggccctttgttctctctctgaccttctctcgctactttctcctttggttactttcactcaagtctctgtattttctaaatgttcttcaataagatactgtttttttaattaatgaagttttaaatgtaaaactatgaaagagtaatctaatctgccattttatccaaatgtttccactattagaacacgattgtataacaagtctgagaagaaaaactaagtaaatttatgacaagagtttatggtgccctgaatgtctacgtacctaatgaagacgttgatacagagaaatcgtctcaaaaaatcaaacggtatggtgaaataccacaagttctgggtttgggattgaaatatatttcttaaatcttttattacttactaattgtgataccttgactaactcactattctctgattcagttttcttctgtgtaaagatgaagtggtctgtaaaaccaagaaacctcgtgttctataacaggaacacctttatatagctacccaaaaaaacacctaaaaaggctgacttattcctaagagtgttattgaacattctagattaatctgcatatacaaaagaatgccagagaagaaaccaaaataccaaaaatatttggagcctggttgcggactgaattttatacaactttcaaagacactatttgagaggctgtcgtgtgtagcctactaagaaaaaacagaggggtggggtggctcactctctaggaaccacaaacttaaggttcctagaaagagcagagattttaaatattcagactgtgtatgtatcatgacccagggttgggggcagatggcccggggtggcgggggaaaggagagatggcggagatcttctatcaggctatcctggggaactgctccaggctgaaacaaaccaccagttaggacgaaccgcctttgatgtgaaagctgggaagctagaatgtagtttcgccttatccttagcgggtcggttctaacaattttgtcacccaaactgaaccactcaccgggtcaactgggctgcaagcccttatgagttggagacaagtggcccagccccaacacagtcagacaaatcgctgggcggccatctgctcctgagaccgttgctagagaaacaagacaacatccaagttctccacatcatggttttccgggcgccagccaaggcgctccgggggcgtggttacgtgggcgacgcacggagggggcgggtcagaaacaaccgggcggaggcgcaccccagggcgcatgcgtgctgtgcggcgcggtctcagggaaggtggggctatggcagctgctagggaccctccggaagtatcgctgcgagaagccacccagcgaaaattgcggaggttttccgagctaagaggtaccagagaaggcaccggagttctcctgggcaatgcagagggagggtgcttttacgtgccaggaggtttgctggactgtcacttcccgtttacttctcatctgtaggcctatgacgctccccaggagtagctagctaataatccttttgagttttttattcttttcactgtccctgcttgacatgcttgttgcttactttattcttagtagtatagatattaaaaatgagggcggaggaagaagaagaaaatcttactagtgaagttatgcattgattagctcattaataaaagttgctttaaataaatctaaaagatacgaagcacagtattttgaactttatgagtagatgccagccccctatctacttcacgctttacattacgttcatctacttctgtaatgtaaccgtttgttgagggagtaacagaacatggaggaattatggattaaaaattaaaaggaagaaatttgttatcaaaaaattggctatgacacttaatccctgtacacctgtctaataaaagtgattatatttgtgttgcagtgactgcttaaaaaatactgggactaattcttggataacagtaaaactttcaggactattagattctagctgacaagttctgtttgttaactaattaaaatgctaaatcattttgtttatcaataaagagattccaactgtctactaaaagtgcacactgtcttttaaagatgtcatcagagagttgggaccttctgttatccagaattttatgttatattctaacagcctatgtaagtttgcatggttcatcttaaagtaatagaaaataaagtacccacatttataaacagcaacattgagggaagggatctttgggttgtgtctttcttagtcacctaacaccaagtgtccgtgatacataagaattgatttgcaaagctggagatttgtttatgtttatctcctcttcttattgaagaattgaggcaatagtctttggcaagttaaaagtcgctctcttaatcaagaaacattatgtcattcagaatttataattaaattggattgcaaaccataaaaggagggagtgatctaaaagaaaaaaaaggaacttgtgaacagtcttcattataactattttgaatcgtattaatgcaccactaattattccctaactttcaaaagccaaagatacattttggaagatgataatggatattaccttctttatcatctttctcaataggcaaacctgtggcaactagaaaattctgataatttttgttttcatttccttgctttttccaaataggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggtacgcgctttatggtcagttttataatataggtcctaagcagaataatcattgaagaaaaggtttctgtgacttacagtgtataagctgcatatctctacccacagctttacaaactttaaaatttgaacataaattgactttttttagaaagataaaaggaatagcaactgttcttacccattatgacttaccttgaaaaacttccagaatgttacttaaaagaaaattttattagttttaatgaaattcacactattcagataggaatactcctttggaccttatcagtagaacccttgaggtcctctccactccagagttcctccagcaatttacatgaagaaagcaattagtgggaaaaaatactcttgacctcttagggacataatgcagaatgcaaaagaacactgtcacatggcttaaatataatacatatatttgaaaaccctagtttaggtcaactttgccctttgaccgtccattgcaaatagaaataaatgctgtttttctgaatgctcttttctatgtgatacttaaagttgaagccccctgataccagagataagatatctgtatatgacattaatatgacattagcattattctaattagccaacattattttaatccttacaactatgaggtcagtactgttattatttctttttttttttttttttttttttttgagaaggagtcttgctctgttgcccaggctggagtgcagtggtgcgatcttagctcactccaagctccgcctcccaggttcaggccattctcctgcctcagcctcccgagtagctgggactacaggtgactgccaccagcctggctaattttgtttttgtattttttagtagagacggggtttcaccatgttagccaggacggtctgtatctcctgacctcgtgatccacctgcctcggcctcccaaagtgctgggattacaggcgtgatattatttccatagatgagaatctgaggtactcaagagttaagtaactggcccaagataactagtgtggtagttatatttaagatttttttttgggaatccaagttctaaaaatcttttttcgaaaggaactctaacttgtgtttttgattgtgtcatttgggagaattatttaaatgggctttgtgatttgtaactctgtatgaatgtttatatttatcagtcttctagtgttacagattgtgtaattgattcttctttcttataattactattttggggagaatattacctcatcatttattactgagggttgttgtctgggtttcattgctaatttattgattggttgtttgctatgagatgtttttaattttgttctattgccaatacctttgatgtccatctatttacttattcctgaaaggcaaatccttaaggttatataacacctaaatttactgtcatgacaaagttttagtaggtttctattaaataaattgtgcttttttaactttgtttttaaggaaatggaggatcaacactttgtgcccttcaatgtttggaaaagctatatggagataaatggaattcttttaccatcttattaattcactctggtaatgttatactttactaatttacattttctttttagtcttccacctttaatactttagagacttttttctttcttgcaaacactttccttcttttttaaaagaatctttgaagttattctgctttgaaaacaaatattttatgattttcatgactttttttaggttgtaagtagtatagtgattttcacaaattttactcgtaaaattgtagatcacgtatatcgtcagtcttttatgaatattgttttgttttgggtatgtatatagaaaattattttcctaagacaactcattcaaatatgaatagttctcgggaatactttaatggggatttttcttttaattttaatttgtattttaagttccagggtccatgtgcaggtttgttacataggtaaacgtgtgccatggttggttgctgcacctgtcaacccatcacctaggtattaagccagcatgcattagctatttttcctaacactctttctcccttaatggggattcttgctttgagggaagggtggtttaacactgtcattactagacttttgccagtactttttatcttgcatttttgtgtgattattgatagccagaggccacaatgcttaaaaataaaaggaaaatgtgacaagatacagagtggacaagtaaatatataaaagagaaatcacacacacaaaataagacattttaaaacagaaaagtaggaaggacatggtctcagaatgaagaatagctttttaaattgaatacatttagttgtgtgaaaattttggttacatgaaaacctttgttgtttttctatgtatgttaaggggctaatgaaaactgtcatgaactgacaccagtccagggacaggtattttagaattattcatctacatggcttccaaggcactttttcattcttatgatttacatacaaaacaatgattctttgtaaagatgatgtcaaagtaaagcatccaagttctggtttgaagcctaaaaatgtgtaaaacaatctaatttacaattttatttaagaaaataattattatcagtttagtaaaaattaaattagataccaggaaatgcatagttagataatttttttatttttattttttggaaatagataattcttagtgctaaacttgactattggctgctctttgaaaaaagaaaaaaacagaaacttattagctctcttttgttgaacaatgtactgtgtgctgccaagtgctttacaggtattattgatcttcagtaataaattaaccttagcttactataacatttttactttataaacttcttaatttttttgactctcttgtaataacattcagcttaaaacacaaacactgtacagctgtacaaaaatattttctttatattgttagggtttattttgttgtttttatttttactttttaaatattttggttagaaatgaagacacaaacatattagcttaggcctacactgggtcaggatcatcagtatcactacctctatagtcctactaaagttcaggagctgtcatctcctatgataacaatgctgccttctgaaagacctcctgaaggacctgcctgaggccattttatgcttaacttttttttgtatgtatcatatgaatttattctaaaataacaatgaaaagtatagtatagtaaatacataaaccagtaaaatagtcatttattaccaattattatatactatatacataattgtatgttctgtagtttagtaaactggcagcacagcaggtttgtttataccagcatcaccacttgagtggtgcatcgtgctaggactttacaatggctccaacatcactaggtgataggaatttttcagttccattatgatcttatgggacaacctatgtatatgctgtccatcattgagcgaaatgttgtaaagaagcaagtattttagcattagtatattagttttctataacttttattttctgtgaagtagatttttttttttttttgagatggagtctggctctgtcgcccaggctggagtgcagtggcacgatctccgctcactgctgcaagcttcgcctcccgggttcacgccattttcctgcctcagcctccagagtagctgggaccacaggcgcccgccaccacgcccagctaattttttgtatttttattagagatggggtttcaccgtgttagccaggatggtctggatctcctgatctcgtgatctgcctgcctcggcctcccaaagtgttggtattacaggcttgagccaccgcgcctggccttctgtgaagtagattcttaattagaagtctaaacatggttgaaatttgttgtttaaagagnnnnnnnnnnnnnnnnnnnnccaggcgtggtggcaggtgcctgtaatcccagctactcgggaggctgaggcaggagaatcgcttgaacctgggacacggaggttgtggtgagccaagatcgcacgtcactgcactccagcctgggtgacagtaagacttcatctcaaaaaaaaaaaaacaaatgtagatgcaacatcatgttttgggccgtggtccttcttatttgttatacatgtaattcaaaacatttcacagattctacagtatatttaaattttttcctgacctacagtttttaaaattgtcttatatcaaatggcaacaagaaaatttctcttcgaatttttaatttggatttcattattctttcctgatttgcagtaacaagtggcatatattaaatatcgttaaatatattttgatttgtaacttatgggttataaaaccctggggttttgaaaattttataaataatactgcatttttaaatggttatttcgttttaattttataggtggctacagtcaacgacttccaaatgcaagtgctctgggaaaaattttcactgctttacctcttggtaaccccatttatcagatgctagaattaaaactagccatgtacattgatttccccttaaatatgaatcctggaattctggttacctgtgcagatgatattgaactttatagtattggagaatttgagtttattaggtttgacaaacctggctttactgctttagctcatccttctagtttgacgataggtaccacacatggagtatttgtcttagatccttttgatgatttaaaacatagagaccttgaatacaggtcttgccatcgtttccttcataagcccagcatagaaaagatgtatcagtttaatgctgtgtgtagacctggaaatttttgtcaacaggactttgctgggggtgacattgccgatcttaaattagactctgactatgtctacacagatagcctattttatatggatcataaatcagcaaaaatgttacttgctttttatgaaaaaataggcacactgagctgtgaaatagatgcctatggtgactttctgcaggctttgggacctggagcaactgtggagtacaccagaaacacatcaaatgtcattaaagaagagtcagagttggtagaaatgaggcagagaatatttcatcttcttaaaggaacatcactaaatgttgttgttcttaataactccaaattttatcacattggaacaaccgaagaatatttgttttactttacctcagataacagtttaaagtcagagctcggcttacagtccataacttttagtatctttccagatataccagaatgctctggcaaaacatcctgtatcattcaaagcatactggattcaagatgttctgtggcacctggctcagttgtggagtattccagattggggcctgatgtttcagttggggaaaactgcattattagtggttcttacatcctaacaaaagctgccctccccgcacattcttttgtatgttccttaagcttaaagatgaatagatgcttaaagtatgcaactatggcatttggagtgcaagacaacttgaaaaagagtgtgaaaacattgtcagatataaagttacttcaattctttggagtctgtttcctgtcatgcttagatgtttggaatcttaaagttacagaggaactgttctctggtaacaagacatgtctgagtttgtggactgcacgcattttcccagtttgttcttctttgagtgactcagttataacatccctaaagatgttaaatgctgttaagaacaagtcagcattcagcctgaatagctataagttgctgtccattgaagaaatgcttatctacaaagatgtagaagatatgataacttacagggaacaaatttttctagaaatcagtttaaaaagcagtttgatgtagagatattttaaatattgtacactttgcctttttgagtaacattccagagataggtattttttgtaggctgtttcactgaactcagttaatgaaaactgtattaacataattgttgtagcataatattaatagtgcaaaagtacatataagtcattttgatgaaaaatattccaagactaagttgagaaaagagatactattttggatgtgtatcagtatttttgtttttaataatgattgatttgtggagcattgttttttcacataattagttttaaaggtaattttctaagcatacctttggaatttttccatcttttttgaggcttttggtccagtgaagttctaagtattcactggcacttctctcctcaactgtaattctatttttaataataaaaatggcatactgtagggtcttcagagtagtgtaggaatactgtagaaatactttttcagaaacgaatccatagctgacaaattcactcagtgcccaatatattgtgattattttcgttgataaagaactagatacaaagacctctgaaattgatgataaaatttgtatctcattaattttatcaaaatgaaactaaaagtacatatgtattatacacttgaacatgtgtttgtatatctttaaaattttcctttatgttccattccataggaaaacacacatatgcacacaaaactcagttatctgtggggaaagtggtagtaataattgagattcatcaataatcatataatttcactatagacattacttgcattatctcctatcagtccttctaacaaaacttcaattaccagatgaactgactttagttttcatcttattttttgtccacatgctggtgatgctgagaaacaataattggcccaaatgcagacatcaagaagcaggcaggaaaatggaaaaactgagataatacacaggtgataaacagtttcgagaaaataaaaattggctagaatctcaagttatgtgtttctatattggtataagcatataagtgaaaagtcttataagtgtaatagagaaaagatttgtcagtgtgtttttttaaatgaaataactagtctgtgctactttatgtcaatataaaaattggtaaactagaagtaacttgtccacaaccctcagttatgatacttatgtgcgtgtttttttttccaaagtttttcccaaggagaagatacaaatatatggtagctattgtttaaaaatgattgatttacttgcagatttttcagaggatgttatgtctttgtcattcattaaatgttcaaaattgtagttttaccaaatctgaagtgccatcagttataagaatcaccattattttatgttccattaagaaaaacacaataaaacatgacactgctttttttgttacttgaaattttcatatttattggagagctcttttagatgtttttaaatacagatttttatttaaccctcttgcatatacatataaaataacaaaaaaataaaatattgagatatcatcaagaaatttctacagcttcacattcaaactcttcagcactttcagagctattgatatgcatatgtccacctagtaccatcttctctgctttcagaattattggtaaggctgcatttcctgagtgctctaccacacttatgtctggattttttttacccagctacagacccacactcctgcaagatttgatacccttctatttggcaaaactcagtttcacttttctttcagtttaatcacaggtccttagaagatcggacctgtgattctattcaaagtcagaaagagatttctcacaaattgacgtcatattaacatgtcaatatgaaaattattgtttggtaaaccagaagtgacctgtctgaagccctcaattgtggtatttgtgtgtttgttttttctttttcaagattctttttaaagaaaatatatggtagctgttgtttaacatttatctacttacagagcgttcagaggatgttatatgtttattaagtgctcaatactgtattttaacctaatctgaattttaatcataatcctgtacaatgcatggattctggttgctttgaaatggttctgttcaaaggacttatcaatgtctcttgctttgagatgtattgcttggtgtgtagtagcacaaacgtaccaccaataatgtacctaattcaactgaagtgacagtcatatacgcagatatgaccaagttcacatgtgagcaagtaacaactccatgactattgctgcctggctaatagctattatactatcatttgtaaggcacattctgttttctggggtgtcgaaatgtggataaaaaaagatgaattaggaatgattctaacctaagtatgtgttttaataaaaggatctaggcaaaaaaaaaaaaagtaagtcactcctaaatttaatccctgaataatgcagtgtacatgatgatagaggagaagtgtgtttttgataagaagtgactaaattttgtgacaatcttaattttttaggcttttcatttagtcttccaataaagataatttttttctgagttttatcagcagtagaaaaataagacctacatggataagtttgaaattaaacattttgtctcattttataatttttatttttatgaaatcatggcacttacatcatatactcaggtgtgtaaaagcctgctatttgtaactataatccataaacttattgatgatttaataactatcaacaagggcatgggaaaaattcaacatttgataataatcttttaccttaggcatttattctctaagcaaagcagaaataaaggatatgtatcagtgtatactgattgaaataaagctttaaaaatccaagtgatactctgaaattgtcaaaagtttaatggcatgaatccaggattaattcccataacctgtgatgatctagtcatcttctgtagctacatagtactcctaatgttaagattaccaaattcagcaataaagccaaaatcaaaactgccttctgtcacatatagctgttaagtaaactacacaaaatcagagttgctgtttacatacatcatgatgccgtctggacttgagcaccttggcggctcaggattaaggcacctcagtctagcctagcagagttacaatggagagaagtgaaaactcattagtagctcaaaacaagctaaaggatttcagatgctctttttcttgttcatctaaatcaagtcttcatctgtgtcaagaactaaattgttaaagacctttttaatttgcttagtgcaagaaaaataatag

SEQ ID NO: 13563 - DNA, 50263 bp, Human
gattaaccatctcaatgttatgtgagcaaagataggaagataagaagcacgaccccgtaacgaactacaaacagttcagaattatagtggtttgcctatcaaagtttcactaacaagtgatgaaactgagggctacatacagccagacagagaaagactttctatattatagtaacagggattccttttttatatataagctacaaataccatgagtttctgccatttatatctttccctcctatgaaatgctgtttattcactcatttaaaatcattttatgtaccaggtaaagtgttaggttctggttatataacaataacctaagcagttctaatccatatcatcacggacctaagagtcagaatccatgtgctctcttaaagtttaacagacgaaaccacctgagtctagtcaataagtacattctagcacaccacttatgatttgagaatactcattcacttacttattgcttccgcaaaatttaataagactctactatgtaccaagcactattttcagtgatagaaatacaacaaagcacaaaacaaagctcactgacttcatggtattaaccttttggttggagggcagagaaaacaaaaaacataaatgatataaattctgatagtgataaatgctgttaaaaaattaaacaggtaagagaacagaatgttagcatgataggtatgcaagtttagagaaaaatgtttcaggttttggggaaaccaagtagatatatatatatgcacaactgtagtttgaaaatgagtatgttcccattgatcaaaaactcttttaggtggagtaaggattctgtgtcttttcattcattcagaagcatttgcttgcctaatctactttatacatgtcacaataagaaagcaatcattagaaggaaaatggaaggttttaatcagtcttaaaacctaaatataaatgaagaaaaacattacaggaaaaatgctctatttctccatctctccattcccctccctctctctcttacacacacacacacacacacacacacacgacaatcagaagagcatctggccattcattcatggtacccagatttgtgcttcttggtctttaacaggtttctcaggatgtccccacattcaaacactctgtgtggcatctatcctgatcttcaacttagaaaatatactcattattccttgtaagtagaactctgcacagctgcatacagaagagcgtctcggcagggaacagtgcaggttcacaaaggggccgataaaacatataattttagctttggtaattgcccttgaagattacaataagaggaggaaaataagggccaaagaaacaaaagatttgcccgtgatttgatagctggtttcgtcacatattatgttgcttatcccacagaatgtgggaatcccagaaagcgccccgtttaaatttagaccgtatttttagcagggtccctttaacagagattgcgggaacctgggaaggaactgaactgggctaaccaaaccggtcgaaatgagcacagggattagattagagcacagaaattctggctagcagtctgagaaagggggccaaagccagcccagagaaaagggaggttgcctgggccaaaggctttctgacaggagacacaatagggtcgtacctctgggtcttaccttcactgaggtttctacccgacaggtttaactggccgctcttcctcgctgccttcaacagcccttggggtaccgaggtaccgcagtctcttccacctgctttgaaaccagcgcggagatcctgccccgctatccgcttcaggcgcgacatgttcaaagtcctaggtccagaagctgcagccccacccgtgacgcttaaaggtggcgccgttgggatgccccgctcctttcgtgagcgcgcgctctgggcgctgggctcgcggcctcgcgctgggccttcactctctgcggcgcagtccagatgtcgtcagcaccagcgcctgggctggaggacagagaagccttttccgttgccggtgccggcctagcgtcctggaattacttcaatcaagtaagtgcgtttaacgggcttaagaggggctttcgggtttattgtttgcactgttactgcgactccaaccttctcctctgtgcttccaccgtggcgagggtgtggggaaagagaaccctctcttctcccctctcctagtctgaacgtgggccttgactaaaacttgagatctgggcgcggtcggcagcgtttctggaccccagcctgtgtttgtcgcttgtggtggtggcgccagacctctggcgtacggagtaaaagaaattttctgttcttaaggcttgtactctgacaccattctcgttgtattgagggtatatagcttacccagcaaaggaggtaatgtgaaatggaaggactggcaacatagaagacaaaaacaaaaatccttaaaatttaataaatgttctgtgtatcagacagtttagggagacaagtagtggtacatgctttagtgaagctcagacagcttggatttttgagccctaaaaagcaagttcaaatctcagctgcttctttactttagaaactgttaactttaggcagtttactcaaccgcttttaaagctcattcctttttttcattactttggggataattcctaccgcataaggtttttgaaataagtgaagataaaaactagaatcttgagctctcggtgagtccagaataatagcaaatgaaaattttgttcaatgtaagtcggtgtttcctaggaaattaaaattttcatctgaaatgtacaacttcttgattcaacaagtaattattaagattaatcctgcctagtatgtgtactatcctgggtgctagacttttcttttgcctgaaatgattttgttttaaaagcatatgccagggaataccattctaacccccatcaagtctactgaggattggtagaatagttgaaagctaggatgaaggccctttgatcaattcttcatcacgcacttttacctgagtccaggttattgctacctgtaaaattcggtttttaactctaccctttttgttcttatttctgtggagtcctttacactaatatcgaacaagagaaagttaccaatagttgttaccctactaaaaaagcaaagagtggatttttgtcttttttttttttttttttttgagacaaagtctggtctgtcgcctaggctggaatgcagtggcgtgatcccggctcactgcaacctccgcctcccaggttcaagtgattctcctgcctcagcctctccagtagctgggattatagccgcgcaccaccacacctggctaatttttatattttttagtagagacggagtttcgccatgttggtcaggctggtctcgaactcccagcctcaagcgatccgcccagttcggcctcccaaagtgctgggattacaggtgtcagtcgccgtgcccagcctgagttttaaaggaaaacgaccgtagcagcttttgcaacgttattaatgaggtccctggtcagcttgtcttcacagtaatggtaatagctgccttattgggcccataccaggctcagtgctaataatacctctgtttgctatttcttatttaacacagtgactaattttgcagataaggaaattgaggctaaaaggggtgaagaaacttacccaacctcacaagtttctctgaatagcacgaccaggaatttgaacctagatctgtctccaaaacctttctttttaatcaccatgacttccctagtggcttttcataattcccaacttgcttttttttttaatcctgtaatcattgtaagagacacttcagttgtttttaagaagatttctttattaaagaaccacctttttctctttatagtaacaacctacctttggggaagaaacaacccacctttggagaattgaattgctcgagtacaaaattttacagtaaccacccctccccctacaatagattcttctttcgttctttttttttttttttttaagagaccaggtctcactctgtcacccatgatgaagtacagtggtgcgatcacagctcactgcaacctcgaaatcctgggctcaaacagtcctcccacctcagcttcctgagtagccatcacaccaccatgcccagctaattgtttttattttttgtagaaacgagtctgtgttgccaaggctggtcttgaactcctggcctcaagctatccttccatctagggccttccatagcactgggattacaggcatgagccacctcaagcaatccttctatctggggccttccaaagcactgggattataggcatgagccaccacaccctgcctagttcaatttattaaaaaataacagcaaggtataatttttaaatttgttgttcttgaagttaaatatttcattattgacatttaatgatactgtattaaaacattgtttcatcttgtataaggaaagtatcttctgtttaatggcaaagagtaattctgaaaaaaaatcccagtggccatatgcttgtggtaaactccaatagatataaactgacatatataagaatgtactagttactgtaatacagtgtatggtgtgtgtgtgtgtgtgtgtgtgagtgagatggagtctcgcactgtcacccagcctagagtgcaatggctcaaccttggtcactgcaacctccacctcccagcttcaagtgatttctcctgcctcagcctcccaagaagctggcattacaggtacgcaccaccacacccagctaatttttttgtatttttttagcagaggcagggtttcgccatgttggccagattggtctcaaactcctggcctcatgtgatccacctgcctcggcccccgaaattgcgggaattacaggtgtgagccaccgcacccagctgctgtattgtatttatgtagtaagtgcagattgagcaagttacagtaaaaattattacctaatgcaatagagaaaataacatgttttgtctcaaatggatggaaactgaaagctaatcaacttcaactgagcttctttatgaaaagatagttatatatacttatgtgagaattagctccatttccattgttttaaggagaatacattgaaagcaaaaattctaactctttttcaacactggcatttaagtcaaagtatttgcttttttagaaaaattgactttatatacattactaaaataatgtgaaatgaatgtctcctgtgtcaaggctggagactactgcatagctaccttttgtaatggaattgtctagccagaatttattatattcattttatttaagtgatgaaaggcttccctcttcaagcttctttgctaaatgagaaaagaaaatgaagaaaccaaatttatgttaaacctaaaaatcacattggccaaagggtacagttttgtttcataacagaaagtaagactgttatcaaagtatagagcagcttgtctctaccattaaaatttattaagacatagatgaaaggtacaattgatgagatggattattgaagtctgaaattgtagtaagggtaaattgagttaatttggcagatttgcaagcacacttgtttataaaatggagtcaagtaagagcaaagtgtatttgttttgcagacattctaggaagtttctttttgtgtaaagtaacaaatttagcctattttgaattgtattgtgtttatctttcagaatattgccttatgtatgagagctgctatcttatggtaaaagttgtttattgagagaacattttagttttctttaaaaatttagacttacaatttcacatttgttttcccttcagggctatcattgccaactttaagagtagctgggagaggacattcttttttgtttgtttgtttttcctttttttctgagacagagtctcagtctgttgcccaggctcactgcagccttgacctccctggctcaagagatcctcgcatctcagcctcacaactagctgggactaaaagcacctcgcttctttttttttttttttttttttttttttttttttttttttgtagagatgaagttttgccatattgcccaggctgttctcaaactcctgggctcaagcagcccacctgccctggcctcccaacgtgttggaattacaggcatgagccacgatgcctggccaagaagacattcttttcttttcagtgaagacagtacatattttgcattttactgatagtttcaaatgtggctttgaaatttgtattatgttgttactggagttgtatatggtaattttttctaatggagagagtgcattgtctttggaataatgcatttgtatattctttgttttctctgcttctcttatatacttttgaatcgtgaaacagcttgctctaggaggtttaatatttgattctaatattttctgctcccgcccccctttttttttccaagacagagtttccctttctcacccaggctggagtgcagagctcactgcagcctcaaactcatgggttcaagtgatccttctgcctcaacctcctccccatgccccccagtagctgcgactgtaggctcatgccaccacattcagctaattttttaatgttttatagagacagggtctccccatattgcccagactggtctcaaactcccaggctcaagcagtcctaccacctcagccttccaaagtgctgggattggccaggtacggtggctcatgcctataattccagcagtttgggaggccaaggcaggcagatcccatgagttcaggagttagagaccagcctggacaatatcttgaaactctgtctctacaaaaaatacaaaaattacctgggtgtggtgtggcatgcacctgtgatcccagctactcaggagactgaggtaggaggatggcttgaccccggaaggccgaggttgcaatgagctaaaattgtgccactgtactccagcctggacaacagagcgagaccctgtagggaattacagggatgagccaccatgcccagctctctccactttcaacacaaaaaaattttagtccccagatttaggaaaaatttttttccctcttatatgagggctttttttaaatgttagttttatttacttgaaggtggaagaactagtaaaaaaaaaaattatcaaaaatgcttttaatttgggggttttctggtttatttcattatattataaaaagaaactgaaacaagggtggtggtaaaccaatcctgcttatgtcattttcaaaaaagcagtataatattgagatttgtttatcggttcttaaatcagctggaagtgtttcctattattcacagtgattattactcataacctttaaaagctagtgcagtattcttgctcttttttccaagactaatatgttctctgacttaaagtctcagattttgtattaattgtatggattttatgattttttttttttggctttaaactagtaaagtaatacagaagtaaagttagggcaccaaaccctatgtttatgttaacacatacactactgagtaagtctgttttaaaaacaatttcaatcaaaatccactattttaaaatttgacttcatatccaccccctcccacccacaattttgttcaattggattctgcttgcaatttcatttactttaaaaagggagacacagtaaatgtttaaaaatggcaaatactgtttatgtagcaaagctcgcctacagttttaataagacatgatatggtccctgagactttatccttaacatcaacttaaggagaaaaatctgaataatttggtagtttgttaacagtcacaatcagtagattgttaatttaaaatttgatacttagatttctaggccacatatttatactcacaatttggtaagtgctagtttagctttcagaataccttcaagactgctcacaatttttttttctacttgaggttggtttttttccatcctttgcaatatcacagttacatatacttaaatattttaaaggtatgcatcatcagagtgttgaaatactagtggacatttaaatacttggtacctatgatgcaaatctgtgaacccagccatcatcattctagaggtacatgtttttcactcaacattacatttatcagccatcaatacaactttatggccatcttagaggtgctgacatttttgcttttctttttaactcatttcctagaaatactacatctctaccatctcatccctcccctaaaataattacttgatcaatatctccaagtgctttagacttcagcctgagctaattgtggcttgaaactaacaacagtttattgtttcaagtgactggggtggcaattggtggagagaaacatggcccttaaaaactacttactgtactttatttttaagaactaaaattgtttaattttagtaaagttgtgagtagtattttacttttaaaatttatgctttggttatttgatagtttttttgttctgacccatgtcatggtacttttaattaattaattaattaatacttatttttttatttttgagatgcagtctcactctgtcgcccaggctggagtgcagcgacgagatcttggctcactgcaacctccacctcctgggttcaagcgattctcctccctcagcctccccaatagctgggattataggcacgcaccaccacacccggctaatttttgtatttttagtagagatggggttttgccactttggccaggctgatcttgaattcctgacctcaggtgatccacccaccttggcctcccaaagtgctgggattacaggtgtgagccattatgcctggttttaatttaatattaatcaaagataggtacagttgtttgtgtcttttcatgttggtgtcatgtttgtattgcagtagcctcttaaaggagaaggggcatctaataatggtataattcatatctttaacttaactgtttatagggtaggttcttatcaatttaatttttacaataatgctataaagtaagacaagtattactattgttagtcatcaattgaaaagatgaggaaagccaagtgtcgtggctgatgcctgtaatcccagcactttgggatgccctggtgggaattcaagaccagcctgggcaacatagggagatgctgtctgtacaaaaagtttaaaatattagctgggtgtggcggcgtgagcctatagtcccagctactgggggggtgggggtaaggggctgaggcaggaggatcacttgaacccatgagtttgaggttgctgtgaactctgcacttcagcctgggtgacagaacaagaccctgcctcaaaaaaaaatttaaaaagaaaagatgaggaaattggagagttttttccgactttcttgtaatgacatgtaacatttgttgggtgcctacgtgttgggcactctgctaagtgctttgtattcatatttttaatcttagaaacttcaaatggcatcattatccccatttttcacataagggacacattagctcatgtggctaattagaagaagtatttattacagtagatgagaacacacataggggagtagaatcagggaatagaatagaagccacttatgttttttacatttatatagtttgaatatttagcattaaacttattgctttataatttttaacattccacaaaaaacctgtgttaaaatatgaaatctaaataagctgttctcactgtgtaaactaactcttctgagatatatctttcatgtgagtttaaatttttgtggatttattatgacaagacatggtaggagacagtacaacatagtggaaatacaggctttggagtgagatgtagtacctggtttggtttttttaatccctgctctactattacctgctttatatgatagacaagttgcttaacttttctaagccttagtttctttatttatagaatagtcattataatagtaatttattctaagcatttgtattagtattctcacgtattatcctcataacaaccccaatgaggtgggcattattattaccctcagtttaaataaggaaattgaagcaccaagtaatgagctgaagttcacacaattatcttaattggtagagtcccttcaggttgactctagggcctgcattattaatcactctagcaccttttaagtgttatgaggattgaaggtcgttttaaaagcattcaattaatgtaattcagtcttattaatgaaatgtactgatttgagtacactttcactttttttccagttttaagtaagtctttaaaaataattttccttcatgaagagaaagttaatttactgcatgggggaaaaaaacataaaaggtcaaatggtgcatatgtttaattccttgattacgaaaaacgtattaaaatgcatgaaactattagaggtaaagatacatataactctactggatattttcttgcattgaacttttttttattttttaagatcgtgaagcattccctccaatggctttttgtcagttaagactccaaaagaatcttttataacatagaagatagtattgagaaatcagtgtctggagcttccccagccaaatgtttcttttgagccgattaaacaaaaaagccaagcaaatctgtacaaataaattgattctgattttccaagcaatacatgtgcactatagctgagaatactgtgtatacgatgcaagcaccagaatcttaatgctctgactactacttttttcctctatttaatcataaaacaaagttgaaaaaaatggtcacagatagatttttgcctataattttagggtgttcacagaccctgctctgtcaatttaaaaacatacatataaaatccttgctattgaaagacaatatatattaaacgatatgaaagaagtatttgaaaataaacacaggtagactttttttctgtcctggtatgtgtgtccatgtgttcttttgtctgtcagtcagtcccctagtgctaactcatccttatcctctccccttcatttaggtgaagaataggagcgtgggatttacaatctgatttttaaatagatattaatatttataaaattgtgtaaatttatagaattagaaatacagtagaaatattatctaatttatagaactagaaatcaaaatacatctgcagataagttttttttttttttttttttttgagacagagtcttgccctgtcgcctaggctggaatgcaatggcacaatctcagcttactgcagcctccgcctcctgggttcaagtgattctcctgcctcagcctccgaatagctgagactacagttgcacgccaccacgcccagctagtttttgtatttttagtagaggcggggtttcgtcattttggccacgctagtcttgaactcctggcgtgaagtgatccactcaccttggcctcccaaagtgctgggattataagcatgagccaccactcctggccgtaagttttttaaaacttacggatttgtaaccagcaatttatttcctaggttcttctcatggctctgtatagctaaaggggaaaaaaaatatagccaaatactttgagagtttgctcaaccaaatttccctctaaatggaacaaatacataccatcttcattcacaaagcctttgctgcatgcattcccttagtatactttattgataagccatctgccttacaagaattgagcagattgtatgaggcatttgtaaagtttctagcacataggtgatggtagatttttgtctaatgctggacttgttccagtatgatattgttaggtatcagaaacccaaagactgataaattgccttttctagcctcaaaaaaatgtatttgcttgggggtggagggaagagctatttaacaactaatttcataaaaggcctgttgcttgtgccgatttgcaaaattgtgttaattgggaggactccactgtcttttccgttagtgtgaacaaaagtggctaaaagggacttgatttatccaactgcaaacagggttcccagtgggtagcgggattatgcatacctgtgtctgctcttttttttccttttgagatggaatttcgctcttgttaccccaggctggagtgcagtggcacaatcttgagtcaccacaacctccacctcccaggttcaagcaattcttcctcctcgaggagcctcccaagtagctgggattacaggcatgcgccaccacgcgcggctgattttgtatttttagtagagacggggtttctccgtattggtcaggctcatctcgaacccccgacctcaggtgatccacccacctcggcctcccaaagtgatgggattacaggcgtgagccaccgtgcgtggcctgtctgctctcctttatctaaaagaccttccatctaaatacaaagatctttttagaagcttgagatggaaaagaactaaagcttgttcattaggactaagaggattagtattgttttacggatgtgtataaagcctcattgtctaatattatttgacatgctttcctgccaatatcacgcaccagttaatttttttttttcaatgtagtggttccctacgtgtcctacctgtgaatcttcagagtattatggggaacctgtaagttatttcttgtgtttcaaaagcctatcagaaatcatgcacttttctataatgtgactttataggccaaatgataggttatttaacttttttttttttttttgagataaggtctcactctgtcacccagactagagtacagtgtcacgatctcagctcactgcagctttgacctcccaggctcaggtgatcctccacttcagcctcccaagtaattgggaccacaggtgcacaccactacacccagctaacttttttgtattttttgtagagatggggtttctttgcgttgccaggctggtctcaaacaactgggctcaagcaatccacccacctctgcctcccaaactgctgggattacagggatgagccaccatacccagttgcattaactcataataaaattgataataatgatcatttatatataactagaagctttcccttacttacatccaaagatgagccaattgaaccttctctgtgcatacttccttcactttgctttccacatgacaagatttctaagtctctctctgaagtataaactggaatgcattcacttcacaaagagtggacttcttttcttgaaagcttcaaacttgttcttatccttagggtctttctaatttgttatttcctctgtctggaatactcttcctccagaaattcaaatgtcttgcttcttccttttagtaaggtctcagcagataacactttttccgccatcccctgtcctatttcatttcatcacaacacattagtcctttcatctttgtggggttttttgtgttttttttgttgttgttttttgttttttgtttttttgagatggcgtttcgctcttgttgcccaggctggagtgcagtggtgcaatctcagctcactgcaacctccgcctcccaggttcaagcaattctcctgcctcagccttccaagtagctgggattacaggcatgtgccaccatgctcggctaattttgtatttttagtagaggcagggtttctccatgttggtcaggttggtctcaactcccgacctcaggtgttccgcctgccttggcctgccgaagtacttggattacagacatgagccaccgcgcctggctgtgttgtttttttattgaaagtctgccatactagacctgaagttttatgttatcagggacattcacttccttttccctactctatttccagcagctgggaaaatccttggaacagatttacgtacataatatttgaagaaatttgtgagttttttgactgcctctcaatgatattgtagatacagtgaataaaacaggcatgaatcctgtctccagattctatattttctatagtcttgtttaattgtgagcctaaataaatctgaagtgatttaaaactgtcatagattggttatatttatttgctttaatatatctgtcattcgtcttcaggtatatgtcttattcctatgtaaaacagacattaacataattatttaatctattagacctacaagaatcttcaaaattatgattcaactcttcatttgactgaaaaactgacacaggttcttagaagtgaagtgaaattttctcaaatcacatgcttgatgacaggggtgggttttttttgtttgttttttgtgtgtgttttttgttttttgttttttgagacggagtcttgctctgttgcccaggctggagtgcagggacgcgatctcggttcacgccattctcccgcctcagcctcccgagtagctggcactacaggcgtctgctaccacacccagctaattttgtttttgtattttcagtagagatggggtttcaccatgttagccaggatggtcttgatctcctgacctcgtgatccgcccgccttggcctcccaaagtgctgggattacaggcatgagccactgtacctggccaacagggctggtattttaagccagccttctaactttaaattcagtaattttttgttgttgttgttagctgctaaatgatgtgaaaataaaatattttaaaatcctcttcagttgcataaactttttgccacttagtttctctatagcaaagtatcatctatttgttcagtaagttattgtacataaattggcttctggtggtttaaaggattttattacaactacctttttctttggtttgaatttgtagttttaattatgaaatgtgtcaaacatacagaaaaatgtagagtcatataaaagatttatgtgtacccatcacagagaataaataagtgttaacatttcaggaaaaaaagaaaaaggcatgaaccctgaccttctgttatttgtccttttatcatcaaatattttagcatgcgtggcatatagtaggcactcacaataaatgttaaactattaagtatctgtaactggcagttacatatgtctgattcaaaatgagaaaattaattaccattctttgtattcacagatacttatttatgagtgacgtgcagttagttatacaatcagcctccataaccatgtgttccacatacttgggtttaaccaacccccatcaaaaatattcaaaaaataaaaaataatgacattaaaaataaaaggttttagaaatacagtataaaagctatttacatagcatttacattgtattcagtattaaagttgagtatccctaatccaaaccaaaatccaaaatgctccaaaatctgaaactttctgagcactaactggcacaaggtaaatgctcattggagcatttcagattttaaatgttaggattagggatgctaaatcagtgaatataatgcagatattccaaaatcttttttaaaaatccaaaatccaaaacacttatggtcccaagcattttagataagggttactcaagagtatgagggtatgtgcttacattatatgcaaatacagttgtaccagtcctgaggtgagtattcatggggaattgataccaggaccccagaggatatcaaaatacacagatgctcaaattctttatgtaaaataggatagcgtttgtatataatctgtgcacatcctcccaaatattttaaatcatctctatactaataataatacaatgtaaatgctgtgtaaatagttgttagacaagaaataaaaagtctgtacatgtttagaccatcaatttttttccaaatattttcagtcccaggttggttgaatccacatacatggaacccatggatacagatcaaatgctttattacacaacaccattttacataggggatttgagcatcctctggttctggtatttgtgggagggtcctggaaccaatcccccacagatactgagggacagctatatgcttttctttaaaattctgaaaagtcttggctctagctaatgttagttgatttctatgaaggccataatttgtaattttgctgaggctcacattcagtcaacccatccattttctgtataagcactagtgaaagtcacttagccagttggctctacacccaaatctcaataaccttgtgctctaatctctcacatattgcatcttgactgcattgtgccaagaggtattcactaatgtagatactctgtaaggcttcaagtttgtttgtttgtttttacctccaaaacatctaaaacttttacctctaaaaacattcaaggtcaagtaaattatttagtgaactgtcttaaatgccattgtcattaaggtatatttgtgcgtgtgtccagcacattcattgggactgactgtgtgacagacattgtgccaggttctggactgacccaggaagctcacaactttgagtgatacatgtcaataataaatacatgtatcttctgttacttagcagaaaagaggaagccctaacagcttgcagaagtcatagcagtgagggaaggaatgctctacagaagatgacagataagatgagtgatgttattaataacttgtgtatcggcacagagacattatggtttttgtcatgtttggggcactacaagtcactggactacacactggatgcagttgagagaatagttcagatgaggttgaaaacaaaagcaaggatttttttaatagtcaaaagcttcaaaattattttaagcaagaatatgtatgtgaaacaagtttttcttgagaaattgcagtattttctttagaaatatatacttgaatatatttaagtactataaactgtgtttccaaagtcagctattgtggaattggctgggtgcagtggctcacgcgcctgtaatcccagaactttgggaggccaaggcgggtggatcaccagaggtcaggagttggagaccagcctggccaacatggtgaaaccccatgtctactaaaaatacaaaacttagcctggcgtcgtggcaggcgcctgtaatcccagctactcccgaggcctaggtaggagaatggcttgaacaggggaagtggaggttgcagcgagccaagatggtgccactgcactccagcctgggcgacagggcgactctgtctcaaaaaaaaaagtcatccattgtgaatgaatgtacaaaacgcttattaataagtgtaatattaaaatatatcttttctgaaagttttagtgacaaaacaaattagttacagatttaatgttaccaaaattcatgtacattgaaaatttcgggacattttatactggtggtggtggggtggcatcttagcttgggtttaaatatcattagtaatcggatagctctgtagatgattatcagtatataaagacatcgtgagcagtatttaataagaagagttgctgaagtgacttttgcaggaggatgaatgctttttttaaaaaaaaagtttatacgtgcctcttcgctcttccaaaaaaaaaagagagaagaaaaagaagaataaaacgagagacgaaggtggataacacctttctctagaccccggtgcctctcatttctcgggctgcaggcgacggctgctgggcctgcgcggggtggagccgacgctgacgcgccctgcgccgcaaagcattgtgggagctcgggcccgctagtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctgcttccccgggccaggctgcttgagtggctggtggctggtggatttacttaagacggttgtgttccaggcctacaaaaaaatgcagagaggcagggccagggctttttggaattaggaaacactggctgttattctcgggaaattttttttttccgccttaaattgtgccaacgtggtcgtttggctttggggacttaacgcaagactaaccgcagtctgtacgtcgtatataggttaaatcccttttttaaaaaactgagtatttgttctttgcgttcttggaagaaaggtaacaaaattattcatgcctgtgttaatttggtgttaaactttgtaggttgttcacttattgttattgctgttatgtggttctggcccagcaatataattcaaagatcatattctttttgacagacgcttagtttagtgtgagcctgattacttaatttgtataatgtcaaaaaacgggttataaaccagagattttcctttgtttgaataatatacagatttgtgatatttcacagttgttcttgagaaggatttttataaatgttgaaatttgaattagagtgtatgactttttatcctttttgtctcacttttattttgaaaattatttctatcgcaagaatattaagtggatgaattgtaaagaaaaaatagttcaaagaagctaagaagtaagataaagtgtactactaaaacagacaattggaataataataatagtcttgtgctttttggaagacttattggtggagaagtgacaattcaaatgtcattatcagtaaatatcatatattgagaattttatgatgtcacttaaatactaaacaggaaattggaatcctctaagaatctactgttatggtacgtgtaaccattaactttctgctcaataaaataattgacaaaagtttatcataatgagatatttgttaagtattagcatatttcatcactttccacttaaaatactttcacaagattattggtgttttcaaattggtatgtttctaatttttagggaaatgtacatgtggagagaggatttacttagtttgcatgacgtggagttctgggaacaaacacgtaaatctttattcctgttattttgacagatacttgatttggtaatgaaagacaaatagctttcataacatgaacatacaaaaatagatgctttgctgttgttcagttttctcaagacttactgttttaagcttgtaaaattaatgaacagtaaaatagcagaaaatagtgatacattggatgattttaatagttttattagtgagatatttgaggtattcgaattactacaattctttccaatcctacaagttaaaaattttgttatggttgctgacttttaaatgctgtttattctctgaaggcagttttatgatgcatttagaaaaaaggtaagagagatgtaggcattatactggttcatcttttacctaatgcatgaccagtatactagaggaagttgtgatggaccagagtctttttgttttgtaatcaaatgaatagttccttcataaccaggacagctagtgtgtgcttgagaatgtctccctcaactatatgatctgggatattctgcattaaaaggactcccttcccagtattgggagaaagagagataaattgacacatttttactctgactccttcatttatcttcccacatacaagatcattttgtcttttaaaatgtacaaggttacaataagttaaatgttattagtggccttctacatttgatcagtaatgtagatggctacttttatttacttgatgttgcattttgtttttttaactataagtttcaatacactaatctgactggcacaagttgcatatagttcccagtggtccacagggttcatcattccaaaaatatttattcataacattgaatggctcagattacataaaattctatctgttgtgaacaggtcacctgattgtaactattatctacacagttggccttcttcatctctgggttccacatccatggattcagcccactgtgaattgaaaatataaggagagagcgtctgtactgaacatgtacagacttttttcttgtcattccctaaacagtacagtatagcaactatttacattgtattaggtattataagtaatcacgagatttaaagtatgcaagaggatgtgcacaggtaatatgccatgattttatttttcctccacctcttccccctccctgcatcatgttatataagagacttgagcatctgtggattttgttatctgcagggagtcctgaaaccatggatactgagggaaaactatatgatttcccccaagaaggcagtgacatgcacctgtaactctttttcccctagacatatctgtgacatgcttaactacttttatttttccgatgtcaccttaatcagagaaaacttcccagaccaccctatgtaaaataaagcacctctgctgctgctttattctccttaacactactttttttctatagcacctgtcaccagttgacaggttaagtttaacaacttctctcctgtagaatatgaggtgctttaaaatacatgtatgactgaacctcacccacacctactgaagctcttcatttcggttctgaatgcctattttggggaaacatttctgggattatgacagacatttcaatgacaacctgctctaggaggtttcctgcattgtcattgttaagtccatctatttattccttcttttaaaccagaatttctggcctgtaattttactgagaaatagaaatactatctttacaataggtgatattctaactgtctctacagcatgatggctttgcaggtatttgaaagttgaaccccacatatactctttgttaaactgttattttgattctggttgtttctgaaatgcgtactggaaatgcagcattgtttgaatatctattgtgtgtgagttgctttctaaatgtaccttaatccttacaaacctggaggaaaaaaatgtttttgaccctgttttacaagttcgtgaactgaaatttacataggtattttttgtatgcccaagccatactgccaatgtcagaactagaacttgaacccaagttgtgactctcctttaccacttgatcaggagtttgctgatttagccaagtaacttgtaagatcttcacatgctttcttttagtgggattgcccagcaaagtgcttatcaggtgatgatcccagtgaagtatgtcacagttatgcagtaacttaaggctgctgtaatacggagatacattgaagttcattagtaacttttcagtgacccaaaatggatactttaatggttatataagtataaattagtatattaggtaagggaaagagtttagtgcacctttaaagaaaaaatggttttaattgatgcaccattttattgtatatttctttacatagtgagaagggggcacatgaggtcagcagtcaagttttcaggttaatgtcgtctttgtcacacacctccttttgtgggttggcgatacttttatttatgagctcgaaattctccacttagcacactattaaggtggaaattggaaggctgatatcagtggcctaaacctgaagttctcgtacgttagtaggcatgaataccttgttaagaatctgggccttcatgtaaaaaagattctctacagacccttaggtgaacaacggaaatctcaggttttctctctgtagtctagaagattctgaaatagccctcagaggacacgtaagaactgttaaaaactacaccaccgctcttagttggaggacagaagtggcatgcaggactcactttaccctatcttgttcctcatttctccctactttatattaattctaaagagatacggagtaaaatatgtgtcgtatttggaagcagtacttccacagaattttagagcacaaaaattaatttcaggcatcagtcctctatcttatattaacatattatcttattaagataaattttattaggaggctgaggcgggtggatcacctgaggtcaggagttcaagaccagcctgactaacatggtgaaaccccatctctgctaaaaatagaaaaattagccggacgtggtggcgtgtgcgtgtaatcccagctacttgggaggctgaggcaggagaatcgcttgaacctgggaggtggaggttgcggtgagccgagatcgtgccattgcgctccagcctgagcaacaagagtgaaactccatctcaaaaaaaaaaaaattttaatcgaaaaaatgttaagaatgtaattgtgggcccagataccatcaaaaacttgttttaaacccatctaaaggaggccatttgaagtggagagagatgaaattatatttcttattcacagtattcaaattcatatttaatctgtaccctaccatcacttaacaggttttgatatagccaaaataattggagcattcctatgccattaatgagtaggaaaaaaaatatgagtcactttaaggttgccaagtataaagaatacaatttgagcacgggggcagtactttttttcctaaagaactatttattaaaaatatcatatttgggagtcatttcttttaataagataacaataaaaagtgttaaaagaattggtagaggtcagttttaagaagtgttaagtgcttgctatttcccagggcattgtgttgggtgttaataatataagatgatagcattaaaagagctttgtaatttattgatggaaacatggatgtcagcaaagaaatgtgaagtgccatagcttactaaacctgctaaagtacttgacagtgaggcacacctgcagccccatctattggggaagctggagtgggaggctgggtaacatagtaagacccctcccatttctttaaggagaaattgcttaaacattctttttactactgcgggtgcaacattgttaaattttatagcagcagtgtttcacatctaaaaaccactgtattctttaagaaacattcaacagtaagcctgtataacaaggtggcttaacttgcttgtggatatcctgttaattttgctttgaacttgggttagggtctgtgtttagcctgagaggtccttgtagggaagcttgtatcagaagttctaatgggtttgagttctcaggccatatatagcatcatgttagtgtttgagttgtgataaaaattatggggttttttgttaggcctaaattaaaagaaattatttttcttttcaacaatgaatctgaaattcttagtataaccaaatctgatgcatttacaattttatgtacacattggtgtgtttcattttttagaaactgtgaagcctcattcagatagtattaaaatacaggattttccttttcattaatgagtcctatgatgtaagtgttatattgatgttaaaatgaagtagttttgtaccctgggtgcataaaattgtcagagagaattaaaggagaaagaactcaaacttcatcagagatcttgatttaattcatgtgaagagtgtggattacccccaacccccaaccccatgactctaatacacattagagtgtattaactagggatggtgtgtttatttctgccttagggcactagctttccaaataacttttggtatgggcttgagccatccctgtattcatgcacagagtttcaaggcagaaatttgagctaccctgtaacttaacagttgaaaaaaaccctgcttcctgtgttatctgtcttacttacactgccatagcttgcagtttagcacttgtctttcttttacctaaggaagtaatttgttgagggaactagcccttttgcttattgaaactttgcagggtggcactagtggaacgtagtactactcccatgtgtgcctacattttttcttttatctgaaagtgctccaagccagaaatccttgattatttacagtgcataagagttcttacatgctgtgggtaaaagagtgcagggcatggaacctgtttattttatgcagttcaagaaaactcattgattattgagtacatgttcgttctcatgatattcatttgtccctgatataaaaattgttcatctttcttactctgagaaagccattaggaagtttctaagccccaaactactgttacctgtatctaaaaatagctggtattggtattataaagaaactgttgacaattttgtggtcccctcagtctctgagacttcagtaccaaattgtttttaacctgatacactgtaaatataagttatgattataagtttttatctgaactgcaattcactacattatttcagtgaacagtatatgattgagaatgttttcttttgaatttaactacattagtatacagttaggtttttttaatctgttttacttttgaaatgtgttggtttgtgaattagcatttgttttaactgctattctgtttctcttttatgttatttgtttattttttagtgattcgcctttgccagtctcatctcgtgtctgctttgttaagttccatgatccagactcagcagttgtggcacagcatctgacaaacactgtattcgttgacagagctttgatagtcgtaccatatgcagaaggtttgtgctttgtttaactacctatgtgggcatcctaagatgaccatctacctcagtagatgtagagtgagcattagtagcatgttaaatctaagctattaacatttttaaacccttgttatactgcagtccgtaatttttgcttgcagattttttttaattctaaaaattagaaattaggtctgttattataaggtatttaccttttgttttcttttaaaacatttttaagttgtttaaaaccatgtcccttattgtaactccctgagatacatctacttagttaatttaatgttaagttttatgaaaaagccctgaaggtaaatgattcactccatgtatgcttacagagccttcaaataaatgcatgatgttatttctgttttaaataaatgagtaggttgattttattttcttaaagcttcctcacattgataatctggaaaaaaaaaaaacacattgaatttcagtataccaagggttgcagtgattttggttttcgtgaaagttcaagatttcctgtagcttaggtgccaaatgggcactgggtgttttattttatgccagattttcttgttcattcttgctatatttctagaatatctctaaataataaattcttctctctgttatttgtgtgtgtgatttttatagtggagaaggcaaatgcaaaacccttccagatgcctgaaaaacagtgggtcctctgcagctacaggggattctagacattaactaaaggccagcaagcactcaagtgccccaagtgttttcctggtgtaaccatttgttaactacattttctctctttttacattttaggctgttaaagtaatttgacagaaaaaaatgagcaggttttttggatctaaaaagccactgtgacaagaaattttaataccattttgtaaaattttctaaggcgtattttataattagtttgttcccaatgtactgctacttgatttgcattttggtaactataaattttactcgaatcactgaaatatgataaaactgctggattttaagttaataatttaatatgctgaccaggatttaaatgctttcccctttccttaataaactggtcagtggaagtggaatcttaatattgttcattttagatgctatctgaaatctttgaaaacaaatgtgagcatttacaccataccttgtaaaagttgtgaaatgtctagtccttaacagagaagttgcctctggttttctaaagaaattaacttatatttataaatgggttaagacatgttatgtaatagtacctctgtctccatgatattaaagtgtatgagcccagttttaaggttttgtaatgtatagatagataaatttttgagttagtgtgttttggttaagcaatttcttttatgtcagtgtgcctgttgtaggataagaccatcaacagaaaatttacagaattcaaattcaggatgaataaaatagagtataggtcttggaacaagggtcaaatcatgtgagtaatatgtaaaacattttggttagcctgtaaatttaaattttttattggctaagtattatagttcccaatccctgaacataatacagtatatcatataaatgactttcataaatattttcaggccatagtaatttttctagacctatttttggaagtgaagtatttaggaatatacagtatatagaattaggggaatatttcattcagaattctattgttggtgaatttaattctggtatgatatgctgtattaatgttacctccagtaaatacaattccctccagatttagctattacacttcggtgttagctcttggtcagtgttttagaacagtagacatagtctacggtaaggaatagtcttaattggtaaaactaagatagctgaatttggaaggaactcttaatagtaatggatttggggattttttaggttccttggttaatgtttgtttcttttgtctgtttctttttctttcatttctacacattcatgcagtatttcatggttctatcaaagcagcagtaaaaaaaatactcttgacgcatgaaaattaactggtgaggggcctcattgctatttttaaattgtagttttatttttaaatagtctttttttaatcagaggatcagatgcatgacttttttttttttaatggatgcagatcttctatcaggtgtctcacaataaattcaagaggattttagtttgccagaaatgttgcaaatgcactaatttgagtaagatgttgatactgaatatatcctcttgagacataattttgcatgcaaaattatcccataatctttgtaggtttgttaatattgatgcattactgccctatatctaaatgatcttctcccccttcccctccataactcttggtatctaaattgatgacagctctgacacaagcaagataacagtgctgtgtagtatacatttgtttatattatcggcacttctcagtataggtggaaggaaccattacctttatttaacagtggtttttcttttttgttgttgtgttttacagttcttttccctggttcagcctgaactatataccaggccctgctgaaaataccacccaacagttttcttctgcagcttatccagtttctcttaagtgccctgtacatattgtatgttttatgatgagatgcagtttcttaatatgtattacagaaatactactggtatttgcaaatatgtagtttaattgtattattgaactctcattttgggggcttgggcacattaacagattaatccatctgtatagggcttttgctgttggatagaatttaaattgtctacataaatatttgttttaggacccttagattttatctgaatacacagattaggctttaaaaacagatatatatgtcatttttggcttaaggagtttggctaagttagcttttcaactggcactgtatggcagcattttttggtatggttagcatggcacatggcgaaacataaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccaggtactagttctattgaattcttaaagggtggggaaaaaaacagaattgtgcataaagctaaacatatttgaactttgtaagtactcataagattctagttcagatagcattatcacatgtctatatcaaaatcacaaatagtatagaagatctcttagacttttgtattttaagaacattctgaaaaatcataaaatatctgttctgtcacttttaccattggctctcaaaataacccatgagtagttttggaacagtctcctgaggcatgaacacttctctgaacacactgttaaaaatatattcatttggaccaggaaagaaaactgaagttaaaatttcacaagtgagcccttcatttttttttccttcccctttatcttttcctgttatttggggggttttgaattacataggtggcttgaaaacaaaggcaattcttgatggagatgtttgatatgggaatgtgaaagaaaattggttgcaatagtgtttctaacactgacagtgctgtacgaagcttattttagaactaaaaggcactttaaatactgtgtattctaattactgagattgtaactggtcagtagtttcaaagattgtagtgaatgagcctcaactggaaatttataaaagcattctttctagtgtatcattttgcctgtctaaataattgactaattgactcttaactgtgaagtgcactatagaatgaaagattaggagttcctaagctttttaggtgtgacttttatcacttaactcctaggttatttcttttaacctataaaatgaggatctgagtaattttctttattctttgttctgttttgttttgtttttttttgtttgttttttgttttgtttgtttttgtttttttgagatggacagagtctcgccctgtcacccaggccggagtgcaatagcacagtctcggctcaccgcagtctccacctccctggttcaagcgattctgccccagcctcccgaatagctaggactacaggcatgccaccatgcctgactaatttttgtatttttagtagggatggggtttcaccatgttggccaggctggtcttgaactcttggcctcaagtgatctgcccaccttggcctcccaaagtgctgggattacaggcgtgagccaccgcgcccagtccagatctgggtaattttctaaattcctttaatgtataaagctatgcaatagctatgttggacagtaagttaaaatagtattaacacagcattttgcctgttacgaataaacagttaaattatagaaagtttgatagtttgtgtttactaaataaattgaaacaaggagaacttgtagcacaggtggagaaagtgaggctgtttcaaaagctacagatggttttaaagtagcctcactttcatggtttgtgtctattacattatggattaatcagaattggtgtcaagcaggtggcagaaccctgcagtgatttgaacagggaacatttaaggaattactaactagttataggagattactaggggaactctaatgaatacaggaatcacaagtataagaaacaaccactacctctgaggctgaagcagaaggaacacccatttagttcaggggactcctctttccccatctatgctgaaacttagatttgtttttggaagggtgactagtaaataagttctcttgggtgccctggggagctgcataaggagttggtattaaaacttactgagaggcgagggctactgggtgtttgacatggtgctgcaggaataatcagaaaggggacacagcaaccaggaagagcccctttcttagtcagtgtccttccagcactctttccaaatgaagtcttatatcatggcaactgtcaaaggagaaatgctttgtaaaggtcctgcctccggtagcacaaaacagcagggcaaagaatagtagatttggatcctgagaagcaataaataattaaaatcagcacaagaatatgttgaaatattttgtctttttttcttaatctaggatttaggggggaaatgtgttgtaatgggtggaacatgggtgtcatatagagcaagactcctatttctgttaatagattgttattggaccacagccatttgtttaggtatcgtctctggctgctttcaagctatgatggcagtagttatatggtttgtgtacaactgaggagttgtacggagaccatgtagcctgaaaactcaagttgttatctgaccctttacattaaaaaagtattaacccctggtataaggaactgaaatgaagttttaaataaataaaatttgccatttcacagattggcgctgttccactggctgctttgggggctcctactcttgatcctgcccttgctgcacttgggcttcctggagcaaacttgaactctcaggtataccttagtaacttcaaatttttcacccatttttacagaagatctgtttcattaactgttggtttgcatttcaagagcagaagctaatggctatgttgtagtaattttttttcttgtttaaacttgtcagagctttaaacagtcactgaatgactaactcctttatccattaatggatttcttttatatagttcaaaatagaaaatagattcacaagaagccagtacattatcagtgtgtcatagagtcagagtaaatagtcatgaaaagataagaatgtggtttataatttttctatcatggaaatttttcttttattttaatttagctaacctttttttctgaagttctttgtagaggtcttttgcattatattggctaaggtgttttgagttttacatgtttctttatgtcaaaaagtcttaaaggagacataattctataatacctagactgttcagcctcataatctttagataacttgctaaagctgctctatccaatactgtagctactgatgtcaccggtttttgttttgttttgttttgttttttgtttttgttttttcttttttaatgtggctactaaaaaatttatgtttcatggcatgtagtctgcatggatttctgttgttcagttttctgcctagaaaatatcggtcatttattgttttatgtattctcattattcttatgttttatttttacagtctcttgctgcagatcagttgctgaagcttatgagtactgttgatcccaagtaagcgttttttctttgttttcattggtgatgtggtatctgaatgtctacagaattagagtttttttgatagcttataagaaagttatcaagttatcttttctcaagacaagcaatatgtattgttacctagaaacaaggagagaaatacagaagtaagtaaggtcctctaaactattttgtttcagtgtcatttgagtcttgaatagtaattgtaaatgacttatacctggatgatagcaaaagagctaataagggacaacttcgtttgaagatcagaggctgagtcctgaggatagtaggagttagaggcaaagctgagggaatcactatcccagagcaaagtagtattacatattatataattaatagccaacattttattttaggtgcttttgataagtgctcttcatgctgtcacagaaattgtttccgacttgatgatgtgacagattcatcagtttttttcactggttatttgttggcataataaatttgaactttataccttttccccttaacttggtgaaagtcactatcagtaagtgagagagcatgaaaaggacagaatcgttggacttcagtagttagtggacttttttcttagaaattatctaaaaataaaaccaagcatgtacccatcacccagcttataaaataaaataataccaatacagttgaagcttcctatatacccattatttattacatttcctgttctgcccacaaataactactaaatttgttgtctataatttttttttctttcttctttctttttctttttttttttttttttgagacgagtctcactctgttgcccaacctggagtgcagtggcgcaaactcagctcactgcaacctccgcctcccagattcaagcaattcttttgccttagcctcccaagtagctgggactatgggcacaagccaccacatccggctaattttttgtacttttagtagagacggggtttcaccgtgttagccaggatggcctcaatctcctgacctcatgatccacccgccaaggcttcccaaagtgctgggcttacaggcatgagccaccatgcccggcctacaattttttttttacatgtgtaaacctgtaaggggcatctttagcctttccactcaagacttcatgtgtaattttggtaggcctttggcctctgcctcagttcctccccacctacaaagtaaaaggtaatgctcttccccaaaaaattactatgtcataaatttttttttttttttttttttttttttttgagacgaaatctcactctgtcgcccaggctggagtgcagtggcgcgatgtctgcctcccgggttcaagcaattctgctgtctcagcctcccgaatagctgggactacaggcgcctgccaccatgcctggctagttttttgtattttgagtagagatgggatttcaccgtgttagccagtatgatctcgatctcctgacctcgtgatccacctgccttggcctcccaaggggctgggattacaggcgtgagccaccacaccggcccaaaaatttttaatttatatgaataaaagttcttagcatcagcatattttcttgtactggcatttctaaaaatgtgtttgtttatggaaagttaatggatgttcagcaaaataggtatttttctaattccagatgactcttagtcattaaaacaaatacttgtaaatattcaaaacagtgctatgctatatgttgtttaccaaagttatcatggagtcctcccctccctttttttgaaggaatattttgctaaaataatgttatatacttaagtatttatttgaaatgctcgtgtgcattttaaaatatttcagatcccatttcttggttctgtttcaggttgaatcatgtagctgctggtctcgtttcaccaagtctgaaatcggatacctctagtaaagaaatagaggaagctatgaaaagagtacgagaagcacagtccctaatttctgctgctatagaaccaggtaaacaatgtttatgcaattttgttgtgtgattcttagcaaaaatgattttgacataaatgtggaattgtgttgagtgacaccctagtcgtttaaaatgttgtaaactctgataaaagattgtatagtggagtgccactcagacgtatttggagacaattctggtggtcacaggagtaccaactgcatctagagggcaaaggaccaacatgttgctagatatcctgcaacaaacagcacagccttccacagcagtggttaatctagtccaaaatgtcagtaggattatctaatacttgaaacgatattttgtttttcttattatttatgtttttctaagttgggatagcctaattttaatttttttcattgatcaagagaacctagtgaaaatgcttctgtttaaaatgatatttctttaaagaaaattagttgtcttctttgcagattgtctttttgagagtaaatgaatagatatcatattatctgcccatatatatttagatctatggccctggattttctttcttataaatatcttgttcattaataaatgggaatgttttttaatgtgcctattgttaggaaaataattttaaagtataatagtggataaactgataccaaatgctttatatgtattatgttatttaaccaggaaaatgtcaaataattagccacagttacatggcaagcagtaggaacttttagatagcacagccgggtgtatgtaaagtttatgacacaccgtgttctaactgctgtttatattgaaaatatatgattaaagtgactgaatgtagtttctttatgaactgatgtttttaccaatatttttatgaatttattataatgacattcacaataaattgaaccctattaatgaaatgacttaaatgtaaaagaaactcaatctcactttgatgatagtcagtgaatgtagaatacaatgactttatttctcttgttatgtccccagttaaggaatttcttatgtgtagttctagatttcctttctatatttacacaattgaaaattggtagggaagaggagtgatgagcagataataggaagcgagctagcttactaaaatctgattctgtcacagaagtggactaaaatcagtgagtgaatcatgactttctgcatttgggggccaaatattgagtctgtgaagaatcaaggaaaggaaaggggacccctcatttagaaccttgtcaagagtaaatcagagccagagaatgagaaatttaccctctttatagactgctttacagaaaacacttcacagcctcttaagtctggcaagtaaaataggcaaaggaacctttagctagctgagaattagaagtctaatttggatctaccaaaagcttggatgatttgcaatttatagtatttcagtaagcttcaaaatcgtgattataaaatggttacttgtgacattcaagggttgtatgtaaaagctgaaaactaaggtgaaaaattattagaataacttctgaaagggaataatcttcctatttgatgtgtttttttgtttgcttgtttttgtttttgaggggtctcactctgttgccgaggctggagtgcagtggtgcaatcacagctcactgcaccgtccatctccaggctcaagcaatcctcccagctcagcctccccaagtacctgggaccacaggcacacaccgccatgcccagctaatttttgtattttttgtagagatgaggcctcactatattgcccaggctggtcttgaactcctggactgaagtgttgctcccacttcagcctctcatagtgctgtgattacaggcatgagccactgcgtctggcccctatttaataacttctaaatgcaggttccttttcttttaaatatagataagaaagaagaaaaaagaaggcattcaagatcaagatcacgttctaggaggaggaggactccctcatcttctagacacaggttagattgctttttagtcaattataccttagacaaagataatttatatatgtcacatcttttttaatttgctgttaatctgttatcctctggttaaagtgttttagtaacctctgctgttagaatgtgtgaatgactgttcacacatgtaaaaagtaagaaaagcgacagacgaaatagatgatttatgctttaaaacccccaaaaattcagaggtggtaggaaagcattggaactagagcaacaaaatgaaaaataattgattcattgaattatacaagtttccaaatactgacttgtatttgttatctagtgtcaaaaagtgacatctggtaatatcaccttagatcagatcagtaaaatgcaagtactaggaatctggcatgctcacaacaatggagtcattttccaaaatttaattttctcagatttttatcattggcaacagattcatctattttccttatataatagacttcatttatttttcaaaaaattgtctgccaaatacccaagtctaattaatcatagtttctagattctcaaaggtgataatgaaaaagcagttagttcagctcataactcaacacaggtgtcttccttaatacagccattatacttcataagcatcagaagtgatttatgcatactttccatttcatcacacagaatattactcaagagactagatttaattctgctactatattaatagtactgaagggggatttaataaaattaactttactgcttcatcaaagacatctttataaaagtggcattatttttttcttttactgcaagtgcatacagaaatgccagtgaagaagatagtgagtgactcctagggcagttcaatagcccctaccttgatttgtgttgaagagtcagtatttttacccactatggcttttgtgacattggtgcaaacgtcaacacagtggaaaaggcaataatttgttattactttgaaaataattttgaccttatggaccccataaaagggtcttagagcatccacagttgtgcaaacgacaatataaaagccattgctctaggttattcaccaactatttcagccattcttcgattttcttaatttccaaactcaatcctaattggcctagttgcatcctagttcttctagtcagaaccctttaggattgacattcagaactaggatattccagttgtggttatttacttcagccagtttcagcttcactttacatacccctccatcactggacttttttttttttttttttttttgagacggagtctcactcttgttgcccagcctggagtgcaatggcacgatcttggctcaccacaacttccgcctcctgagttcaagcaattctgcctcagcctcccgaatagctgggattacaggtgtgtgccaccatgcctggctgattttgtatttttagtagagactgggtttttccatgttggtcaggctcatctcaaacccgcgacctcaggtgatccacccaccttggcctcccaaagtgctgggattacaggtgtgagccaccatgcccggccattcaccacttgactcttaaaccttcactcctggcttcatctcttctggaacctagttctgtcagttgtctgccttttcttagtgtccgttaccccttagtttttaccaagggttagataaaaccatttctcctatttattgtcaggatttttgaaagagcagtgtgacttgaatcctagactttgtcacgtctctattaaaagcacttatatcataaaatatctaaaaagtcacatttctgtctcagagatgatcttttcactctgtttttatcttttaatatcattttcttattttaagtcatttcttgaagtattacaggggttatcctgtatgctatgtctgtttattccctgtcacccaccttatcccactgtcttattcttagagttgtctttcagaaacccaaatacagatcatgtcacagatactgagaagttccttattgccttgataaggtgatacataaaaccttagaatggctttcagggttctttactattccgtctggtttatctttttacacgtgtcatttgccactccaaaagttacaggactaattgcctcaacataccattttctttatgtcttcatgtttctgctcatgatcctttctgcctaatgcttttccacatcttccatttccgctttgaggaactcctttttctttcttcaagatacaatgcttgcagtcttaatcttccatgacagtgctctcatagtttagtttaacctctgcaataggatatacctcatgattactacaatttatatgtgtttccttttaccaaactcttaggaaaaaggagagcctgggccgggtggggtggctcacgcctgtagtcccagcacttggggaggccgaggcggaggatcacaaggtcaggagattgagaccagcctggccaacatagtgaaaccccgtctctcctaaaaacacaaaaatcagctgggtgtggtggcgcgcgcagctgtaatcccagctactcaggaggctgaagcaggagaatcgcttgaaccccggaggcggggattgcagtgagccaggatggcgccactgcactccagcttggtgacagcgagactccgtcttaaaaaaaaaaaaaaaagggagagcctgtgtctttttctttatattaaatcttactgggactctctcattttaatattaattactttactatgaccagtgaaaagtagaagtgaaatatgtccctgaatccagatacttgtaatacatcgtaacagaaatcattgttgtgggttgtggtaaccctcaccacacacacacaccccccacaccccacacccccaccaggctcaagccatcctcccacctcagcctcctgagcagctgggactacaggcatgcaccaccacacctggctaatttttgcaccttttttttttatgtagagacagggttttgccatgttgcccaggctggtctcgaactcctgagctcgagctgtttgcccacctcggcctcccaaagtgctggggtgacagatacaagccactgagtccagcccagttgtagtatcaagcatcacatagtgtgttaaatgaccatgactttcacaagctttttgactttattaaaaatatgttacactaatctcttttgctggttaaaagctcatatgaactagtaagtgtagaaaagtgacggtagtacattcccctttgaaaacaactgtttaatctcttaaggttatgattctgatattttatatgcctatatttcattcaaagtatattattggtgccttttatttaaatcaggcagtgtagtaattgctcaagaatacagtcatgaaaagacttacttcccatgtctttgtggagcctatggtagggtagttaagtagataaaaacatcttaggatgtggagatgttattgcaaggaattgtttagtaaatagtttcaaatatggctgaaaataagagattaaaattaaagttaattgagttcaataactcaaatagtttattgaggcattactatgggttttgaggcagttgttttagggagttatggcaacagaagctatattagtacatcagtaagaggaaagaaggacatcaatatttaatgtacagtcccctccgtatatgcaggggattggttacaaatccatctataccagaatccatgcatactcaagtcctctggaatccacatataggaaaactcagtcctgactatacatgggttcctcatccttcaaatactgtttttaatccacatttggttggtggcaaaaaaaaaaaaaaaaaaaaacacagtgtgtaggtggaaccatgccgttaaagctcatgttattcaagggtcacttgtgtgtgcctacactaaggcaccgagctagactctatatactgcatttaatctttgtcattatttggtgatagaggtgttactatccttgactgctgaagtaacaaggtcagagaggttagataatactcttaagttacctggcttataaatgagagtttaacacaagtctttaagatgtccatactctttcttgtaccttgaaaagaaaagtaggcagaaaatttagactatatttgaaatgttgcacagagagaagttgaatggtcactaaaagttaagtgatcaagactaagcaaaggattgcaacttatttttaatttttaaaatagaagagaatgggccggttgtggtggttaatgcctataatcccaactctgggaggccaaggtgggctggtggcttgagcccaggagttcaagaccatcctgggcaacatggcaaaaccccatcgcttaaaagatagaggagaatgagttttaatgcagtagggaggatgacaacatctaaaggttaattgtgcttcttagtcctggaagagccaggtcaggacacaatggatgggggctcggtgcagggagtagagaaacagatatgtcagggaaaaatgagagtaaaagaggcagtttatacaaattgtatatatctgtaaaaggtctgcattgcctggagtttcctaaattgtggattaaaggagtggaatttgtttcagagaaaaattcgaaataggagatggcaacacaataagtagtttctctttataaaatagaaataatagtggcatttactttatggacttacgagaccaatttgtagtttatatatagcgtgatataagtatttgatttatgatgaggaaggtttaagctgcactaatgaggaatcaaataagaaatacatgctaaaatgctatataattgtataagatgatgcaaataagtcatacttttattctccttcatgatctagtagtatttttaaccttggagttgtaagtacagtgggcatagaaggacctatctgacaggttgagcaaatcattaaaaggtgaggaattccaagtgttaaaaggtattactaatttctaaggtgttgaaggtgtttgttctatgggctaaataatagcaaatggaagggaattatcccccatttaattgtttagtccatatgtccgaatcttttgtctgatactaagcacaaaatttatagtctttttacatttatacacatgtattggcttccttttacactattaggcggtcaagaagcagatcgagacggcggtcacattctaagtctaggagtcggcgacgatccaaaagcccaaggcggagaagatctcattccagagaaagaggtagaaggtcaaggagcacatcaaaaacaaggtatagcattgggtgagaaagcaaattttagggttcccagtacccctagtactgtgctacttagtaacaaaagaggtggttggggtgcggggcagagaaatagggctagacaggggaagaaactgtcaatatttgagtttgaggaggctgacgtttgctttctggtgcttccttgtaaactgaaacttcagcttacagctgagggcctaagtaaaatttcttagtagtaggaattgttagctgtcctgctaccttctttcataagaaataccgtaacgttttatttccatctaaaaatatattcaaaaaccagtcttttcgtgtagaaccaaacacttttaaattagtatgcccccagtcatttatagttgtgaggcatacaatttcacagcacttaatttttttagcaactgctttttatctcttgctaaaatatttatcttaattttctagaagcaactctatatttggcattattttgttcatttatatatttagttaaatcatgtcattaaagtaagtacagctggggacacaacataacttactcttgggaagcataaaactcaactgatgagaacagaagagtgggggtagctttactatcattgttaaacctgtaataatggggcttttagtccttatgtgctgcagagtgaatcaaacaaggtagattaatagaacagttatacaaaggaattaagcatttctttaaggactttctgattactaggagaagagtgatggatttaattacaggggaggaactgttaaatgatgattgctacttgctgatattggaagaggtttgagaatgactcgagtattaaattctgaaagatttgactagactcaacgggaggcatgctttcaggtggagaatggtgtttcttgaaataacaatattttgatgtagttggactagaaaatgaggtcagaaaaatataatgagaccgatcgtggaaggctttgttgttcacactatgcacttgatccaggaggcaactggaatgagttgaaaatggtgaacagggaattaatattttcaggtttgtactttaaaagatttctgacagagtacagaatcagtttatggaaggcatgactgggacctactaggggactgttctagtaatctaggagttagatgataaagattcaaatgaagagggaaccaatgataaagattgaatgaagagggaaccgaggatgaccagagaagggaaaaaaatgaaattgagaatgcagaatggaaagattagcttagaacagtaagagagggatactttgattcttaaaattagagaatagttaaagaggggggttgttatgagacttctcattcaacaaatatatatcgtttatctactctttgcttagagtcttggggagaatgatgatcttggggaaaaaatattgtgaggagtaaaaatttataggaatctgtaaaaaaaaaaaattgagttacggctgtagtcaaaatctgttgatattttctaataagccctgaatagttcataatagccgcagaaaaagaagcttgcttgatccatgatagaggttgacatgggatgtgtgtcttggaagaatattcatgatattgatggattttggtagtgctctatgggttttggcctgataggagaggtgggttgggaaagtggtaatcagctgagagaaaaaggagtcttgaggagcctagagatagttaacttattggtgtttaccaagtatatttcaagccaacatcctagttattttctcacccatagtctactttagtctacttgggagaaaacctaggataataggattttaaaagaagttattgtacttcaaatatgccacataaagtattatttttaaaacagtttctgtcagaacaacatttatgcttttaaggatgggattagatctgattatatttttgtgtttgtagtgctatataaattggcatcagctgagtcttctaatgcattcataaattgtgttcatttgttagagacaaaaagaaagaagacaaagaaaagaaacgttctaaaacaccaccaaaaagttacagcacagccagacgttctagaagtgcaagcaggtaaggtggcattgtgaattcttggcaattatttttttaactttgcttctaacagtatcagtacgctgtcagtatgaagtcttttccagaacataagtatttcagtgttgaaaaaagttacattttgctgttatttaaagtttttaaaaggcaatttgtgaagaataatgtagtttatttttctttttacttaatattttatggtctagagtatatttgaagtaacatggaattcaagagaggtgagtttttctctttatagtttaagttttaatggctaaaccatactgaattgttccattaagtaagcttattatagtaagctatatttatcatctgcatgttagtacttgagaatttttctatcccttttaatgactgttgaattaatgggaagcaatgcaggttctggtttgtgtcattcttagactaattctatctttaagctgtcagtgaaaattgaaatgttgcagaccttactgcacaaaaagcacattttcatacttaatttgggatttatatgatagtaagggctggacttcattccatttttcagatctcattcacatgttttgctgcagtgcttgttttattcatcaacattacttaaattcactaggagaaggttcatgccatataaaaaaaaataactgaaatgtataaaagacctaaatgtaagagccaaaactataaaacctttagaaagaaacaaaagtgaatctttaagaccatgagcttggtggtttcctagatatgacttcaaaagcataagcaacagaagaaaagaaaattttggaattcaccaaaagttaaaacatttgtatttcaaaggatactatcaagaaagtaaaaacctagagtgctagttagaaaattctttatatattctctattaagaactcttagaactcagcaatagacaggcaacccaatttaaaaatggcaaagaatctgtagccattactccaaaggagatatgcaaatatctagtaagtacataaaatctgttcaacatcattagtcaccaaggaaatacaaaccagaccacagtgagatatgtcacagtcactaggatggttataaatcaaaaagacagatgatagctgagcctgacagatgatagtaagtgttgattaggatgtggagaaattagaaccctgtgcattgctagtatgaatataaactggtacaggtgttttagaaaacagtctggcatttcctaaaaatgttaaacatagaggtttttgacccaccagttgtacccctgggggaaaatgaaaacattttcacagaaaaacttttatgtgaatgtttgtggcattatttcataatagccaaaaagttaactatccattaacaaatggataaacagaatggtatatctatacaattgaatatttttcagtgataaataaggttgatacatgctacagtatggatgaaacttgcaaacatccatgaaaggccgtgtattgcgtgattccttttatatgaaatgcccagaataggcaaatctataaagataccaagtagattactgattgctggggagatagggaggattagagtgataactaaagggtagggagtttttggggtggtgaaaattttcttaaaaactaaatttttaagcatgaaaatgaaaccaaatgtaagtacagaaggaaatgctgaatcaggcctgagggataggtggcaaagagatagaaaagatggaaggtactacatatattttcttaccttaaaaactgttgaggatttttttttttacctgttgctttatataatgtacttgtaagtgccttctcatgctgtattattggatcactctaaattaaggcatcttctgtgagttattaaatacccactgtgtttgtagttgtgctacagtctgttgaaggacacggaaatgtaatataaaatacttcttccgtctagagaatttggagtttcagttacataagacagtagcaaaaagtataaggtgcacagtcgtgacaatgtttgataagtgaatgctcagttatgtgtaacgtttccaggacaagggtcacagagggctgtgtaagtagaaaaaaagcttcatttggaaattagacaactaagtacagggttttttaagtctgataacttttgagaatcaggaacagaatttttttttttaagttacagtaaaaaggaggggaaggctgtatatcagctgtatatcttcaaagtaattggtgaaagcagggttttgggggactgcaggagggcgattttgctagagtataaggtttctacctttccactaactagttctctgaatttcatctaatgatttaaaggtgaatgtggggatattttattagtaactaccttctatatcacattattgaattattctgtacttactctgaacactgaatgtttgaaccaaaaactaacttcttcagtaatagtttacttcacacgtcacccctctcgcattagttttgttaaatcagttttttctcaagcttagtatttctaacattttgtcatcaattaaaagaattactagaaattaggagttttcttgagggtagtaaagggaaagattcatggtttgcagatgattatattactcatttaattgtttagcttataccagtattgtgaaacaatctttcatttttctgtttttttgagacagggtctctctctgttgcccaggctggagtgcagtggccctatcacaactcactccagcttcaacctccgcaggctcaagtgatcttcctgcctctgcctcctgagtagctgggactacaggcatgcaccaccacacctggctaatttttttgtattttttgtagagacagagtttcaccatgttgcccaggctggtctggaactcctgggctcaagcaatcccctcacctcagcctgccaaagtgctgggattataggcatgagccactacatctggccacatctttcattgttagaatcatctatgatgtgtctgcatttttaagatcacactgtattttaaaacctagtttgcacatttgtgattctagagagagacgacgacgaagaagcaggagtggcacaagatctcctaaaaagcctcggtctcctaaaagaaaattgtcccgctcaccatcccctaggaggtaagaatgttaatcatttaaatgtattttttatatttttcagaggtttttcattttaaaactgtcctgtagtttttcttttcagcagttacagttcttaagaatgttttaatgtattctccttctgacttgtgacttaaacaccattaaggactgaacattttagtcctataaacaagttagttttgtagcctgtgttacttctccaaggttttgaagttggatctttgctgtactacttatatcctgtgaaattgagtcaggctcatcatctaaacaagttaaacctgttgctgtacattttactgtcattctagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagtatgtttacaaattgatttatttttatatttggggtgatgttggtactttcagaagttatttttctttggagaagtttacttttattattctccttggcaaagcaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttattttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgtttgggtggctggggttaagggaaaatgagacttggaattgtagcttttatccaagttttgagtataaatagggttttgttttgttttttttaacctaaaaactgaaatgccatatagaaaaacagcattgtttttacagtttgtagtaagtaactttttaaagattttatcaaaaagaattttgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaatgttttgtccttatttatttgcttaaatcctttaggagtgaacgagaggtggtagctatacaatgagcttttttaaatggaaagataagagtccagtcatgcatttggtctttatttcatagagctggagataactgtgttccttaccttcagtttcctacgggtaaaatggaagtgattgctaccttgcaaagtacagacatacctcggaggtattgtgggtttagttccagactacaataaagcagttcatgaatttttttggcttcccagtgcatataaaagttgttggctgggcactatggctcatgcctgtaatcccaacactttgggaggccaaggcaggagtgcttgagcccaggaccagcctaggcaacatagcaagacactgtctacaaaaaaataaatagccaggtgtggtggtgcacacctgtagttctagctactgtggaggttgaggcaggaggatcactttgaacccaaggagttggggctgcagtgaactatgatcatgccactgcgctccaggttgggtaatagcaagaccccatctgtatctgtaaaacagtaatttttaaaatgtagcctttggtgcctgggacattaaatgatagctgctatttgattatggggcccttaaaagttatgtaactaataatttgtgtagggggtaatgttaaaagcacaaaataaattgcataccttttattgaaaaggctgtgttgcccttaactgttttcatgaagatggatcttaggtaagtttcctcgtggcaattctatacatggaagacagaaaaatgcaaataggcacttgggaaaaggaaggagaggataaaaattactgttaaccttggagctacatcttaaaactgagtcaggttctggagtgtgcattatacagcttatgtcatgcagattacagtattaatacatcaaatttatctc

SEQ ID NO: 13564 - DNA, 11318 bp, Human
cagtttagaggtcatgcagcctctggctccaagtttctgaacctccccaaattgctcctggggataacatcactattgtaaaacctaagataagttcttgagatattttgcagaccctgctctccatggatcagttgaaaccacccagattggtaatttggctcaaccagttctgccatcctacccaggaacagaaaacagcaagaaaaactcacgtctacccactatgagtccatctccaacctgacccatcagcactccctacttcccaagcccctaatcgccgaattatctttaaaaactctgaatactgcttggggagactccattgcaagtcccctgtcttgataaatgggctatcggtcagcagcaggcaaagtgaaccacaatattgggtggttacactcctaggatcaagcaatcctgctgtccggcttcccaaagtgctgggattacaggcgtaagccaccgcgtccagctagaacaaatgatttcttaaaagcaactcagatatttaaatattatttaaaactgtttctagacaaatcggagtgactatgggacaagcacatggtcgcaggactttggacgcaggcagtgaggacacctatgagcgatcagtggggtcctacggcacccgtggaactgctctgccttgcaggcgaaagtgtggtcagctatatcggagcgcgatgggggcctgagaggcgcatctgcgcaggcgcccggctcctaagtctacccaggaactgaccctgctctctcctttccctgttagacatggtaagtgtgagtttagcgctgctgtccggatgggttggtagcagacagggtagagtagggttaagcacactggtcaccttaggattggtttcctggtgctggagaatggttaggacacaggccttggaaggttttttgagtgtgaaatattactcagcgttttctgcagacctcgcgggcaatgccgcttctaattttatccaggccttcttctgtagggagggcctgttaagagttgagcagcccgatttctgaacccctctaaaaagctgtggctgattggtggcttttttttttcttggagagggggtgtcaaagatttctttaaaatcgttagtgatgtggtctcgctttaagatttttaatgggatcagaggaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgaggatgtgctgtgcctttgaacttcagttaagtgtgctttggacgtctgaggctgtgggcttattagaatctcagtttttacctatactgagagggcttgccagacaaagtagatgagggtttgaggtacaaaacgggtttctctttttgtagttaggggtaatactttcaaggtcaatgatgtgttggcatgtattatctgaatctattgctgatgtgtaataacactttagctctagaattactctgagaccttgaaaaagttttaccttaaatttttaaatttcgaggaaaactctgggacaatcttagcaaaaagtagtaaacaacttagttaagagtaaatgtttttccctgtagtatccaaactcagttgtcttagtctaccgatttgtgggatatatggtatgtattaattttttacttaagtgttaggttcccataaccttgaaaatactctattagcaatcatggagttaaggccatatggatggggctggactcgtttctgcctttatctgctatctatctttatgccctgaatttgggttagtagcaaactaagatgcaccacctgttaaaaaaacttctttttttccttttgagagctataacctcactttgttgcccagactggaggacagcggtgcgatctgggctcactgcagcctccatctcctgggtttaagtgagccacctgaatagctgggattacaggcacattccaccatgcccagctagtttttgtatttttcgtagagactgagttttgctatgttggccagagtggtctcaaactcctgacctcaagtgatctgcctgccccagctttccaaagtgctgggattacaggcaggagccaccacccagccacaaaacttcttaaaatataatgcattgttgagtgtgggaaaaatttgtttctggaatcctaatactaattttcatgtatcattgattagccactgttttatctgggcttaaacatctttggcatgtttagggcattttgatttttcatgtagttatataatttactaatagataataggttttgtacagagtccacattaaaatagatgtctgataaatatggtataggtactcggaaagaaatactctccctgaacttcactgatgaaaaaggtagatgtttttctgtctctggctcatgggagaaactaaagcactgtttgtattgtcagccatagattaactaatcctgtgcttctcagataattgtttttttctgataatagttgtgtctgaagatggcttctaacattgagcagcacagattttaaactcactactgatcagtgctgttaaggtcaggagaggtaaaaatagcagcatggctaatgagttacctttgtgtttaatctctttataacttgttaccagttcaaatgacagatttaagaaattgtgtattattttaggaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccaggtaaatactaatcaaaattgcaacgatcttgatagtatgttctcttacttcagagttggaaattgaaactgtatcaggatttggtcaaaaagttttgttacaagtgaagctgtcctacaaggtcaatgatgtaatggcatgtattagctgaatctaaagttgatgtgagttctaaaattacactgagaccttggagggtaaaatttttatcttcagtatgtgtaaatactgtaaaatagctaaatggagctatttgattttgatattagtgaacatctacctggtggtttaaagtctttctggtactactgggtgctgagatgggaagatcaggactttgtgtggatgtgagttagtatacttgagtatcttggaatgccaagttaaaatttatatgtagaaaattatactttaaagatttgagttttcttgatactatctaattttattcaataacaggagagtctgcatatttgagaaaaggttatatacacagagacaaaaggatgtgcttgacaacttaaaaagagttgagcataagatcattagaataaacctgaaagggacatttacctaatacttgtctttattgcagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggttttgctagtaaccagtttataagtttttcatcttttcaggtcccactaagcagctggtctaactggagttaatggtctgctggaacttccagcatgcactgtggtagttatatcagcatatacaggagcactggaacagagggggccagtctaaaagataaggtaggtggaatttttttccccaatatttggtggctttgtaaagttttttaaaaactacttgctggaaagggaaaaatatttaaaaaaaaactttacaaacttgctgaatatttgagtggagggagggaatagaattttatttgataaacgtagataatctctgctttagggatgaacacagtgcaggccagagagaccagctgcttcatgggatgtgaaaaatctacttttataaagtagggtaagtttatttcattattagaaatggactaatactttgggttctattagttttcttctctttggttttcttctctttctgggctttctttaagcagcttaagataatttgctgttacttttttgtggcagggtcttggctctgtccaggttggagtgcagtattttgggagacagttgctggggctggagagctctgttgcccaggctggagtgcagtggtgcaatcttggctcactgcaacctccacctcccaagctcaagcaattctcctgcctcagcttacagagtagctgagatgtgcaccacaacacctggctggtttttgtgtttttagtagagatggggtcccctggcctcatgtgatcctcctgcctcggccaccaaaagtgctgggatttcaggcctgagccacaatgcccagccccacctaattttttttaaaaagttttttgtagagatggggtcccattatgttgcctcggctagtctcaaactcctaggctcaagtgattctcccacctcagcctcccaaaatgttggaattataggcaagagctactgtgcctggtcaatttgctgttatttttgacaaaggaattttcttgggaagtaaaggcacttcagatttagctttcctcctgactaccctaaagtgaaagttaagcttgaactcaatttaaagtggtagttgtgcagtgtttgtttttagatgactcatgtatgatttggtaacacctgccttgatttgatctatttttattgtaggagaaattgacacaagattctctttttgtgcggtggcaactttggctttgttggtaagctttgaatatttgattgaaatgattaaagttcatgaatactctggaattttttttttttttgagtctgatctgctgaatactctggaatttaacaggcatctttttttttgtttgtaggggaagcttgatgctattaatgtggaaaaggcaatcgaatttgttttatcctgtatgaactttgacggtggatttggttgcagaccaggttctgaatcccatgctgggcaggtaatttatgaatacagatgaaaatgtattgtcattttggaagccagtgtagtaaaataagaaaattggttatttcagtgtttgtcaaatacacataaagttaattcgactgtaatagggcatcttacataagaattgcttaattgctatcattactttgctttatatactatatacctttctctgtcggtggattcgtctgacctaagcaaacataagtgggtttataagcaccaaaacacttttgttttccattaatttttcactaaccatacagataaaaaaaaaacaacacatttttctttctttcctaagataaattatgaacctcttttcttgtgccagagaacactgaatatgtgaatggatggctgtgaaatactagccatgaagaaattttgacaataatatttcagtgcagaattgcatactagtaatagtatgcttggattttttcagatatgtggtattaatacatgtttggaattttaagtgtcagatcaagaagaaaaacttaagatataaagtggtgttttaataatttgagttttatcacttttaatgtcaagaaattattatacacataaactttatgtctgtaattttagatctattgttgcacaggatttctggctattacaagtcagttgcatcaagtaaattctgatttacttggctggtggctttgtgaacgacaattaccctcaggcgggctcaatggaaggccggagaaggtattgtttgataagccatattctgctagctttagaaccttgagtgaatgctgctgctttgtcttgcctgtttctatattgtaaattggccatgagcttatttattacctttccctgttgtgaattttcagtaatatatcctactaaaagactccccttgacaaagtagacccccatgagttgaaatactcattgatcctaatgtccatttccagacagtcttgtacaggaatctccatgtttaaggacagttgattttggcaaattggattttttaaaaattagactacagaatttttgtttgcaatcttcttatttaaggaatacccagataatttggtttggagagaagattattaaattttcctccacataataggtctctcttatcaggtctgtaagggacaaatagtgaatactcatttgcaactatgtaattgtcctgtagagcaagtgcagccataagtggtaagaaatgaatgagtatggctgtgttccaattacaattattatggatggatatacttgtatttcctatgtcagatggaatcttgctctgttgcccaggctggagtgcagtgacgccatcttgattcactgcaacctccgcctcccaggttcaagcagttctgcctcagcctcccaagtagctgggactacaggcgcacggctaatttttgtatttttattagagacggggtttcaccatattggccaggctggtctcaaactcctgacctcgtgatctgcctgcatcaacctcccaaagtgctgggattgtaggcgtgagccaccgtgcctgacccaggactatatttaaatgatttataaatgtaaaaactattcctacactatagatttgactcaaggattgtagcttgctgtgcccctgccctctgaatgggacgtggtggtacagtagctgggattacagtcatacaccaccacgcccatccaattttgtatttttagtagagatggggtatcaccatgttcatcaggctgatcttgaactcctgacctcaggtgatctacccgcctcaacctcccaaagtgctgggattacaggcgtgagccactgtgctcggcctgtatttttatttttaaaccttagtatttctgaataacaacgggtagagaaacacccgcagtagctgtctacaatagagtgaaataaaaagcctgaggaactgtcaacagaaaaatgggtggccgtggggagcaccgggacctgcacttgcacacaatctagggcagcttctaatgagtctatgagttactcagggatctcattaaaatgagatcagccttgagtggggttttctttatagacttctgtcaccatattttgaagagcaagggtttagttgattttaagcaggtgtgtacccccctggacagtgcttgtagaaaaacagaactatacccatggatttcatgattatactgctagcttcttggttaaggggctgagttaggcattcattgcagatagaaacaaagcagatgcatgcttatcagtgagtactgagatatttagcatggttacctatgaattgaagtttggtctcttcttacccattaattgattatctttcattctaagcaagtatttcataccctgcatatcagtatatccctggatttcgtccttccacatggtttgacactttgaacatcagattacctaagagtgagacttaacccacttttaaattgttctcaaaattagggaaataaaagagaatgaaattgtggcaacttttttccctcctagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggcaagtaatatttctgacatatttctataaattatttcagcgtttgcattacttcatggttccatggatttccagggtggcattccgagtgttgctttgaaagcagtttttttttctatttattgtagagtgtatgaaggatatagaacaatcttacagaaatttcttgtcgcttgttgctaacaaaattagtatatggtaaaggtcaggtattcataatttgaagttaaagaagttttcattttgtgatctgtatataaattcttttttaaataggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttggaaatgattgataggtttgaatatggttattctgaattggtcacagacttaggttaaatggcaatctaccatcttaaaatggggttgtgattcggactgtccttttttttttttttttttttttttttttagcattttatatatcagaattacccaaagaaggagttgtcttcaaataaggaaacactaacgggtaagttgatggtcaccacagtatttttttgcacctgtctttttcttaaaaagctaaaatgggtacaatcactcttttttatttttttgtgacagaatctctgttgcccaggctggagcccagcagcacgatctcagcttaactgcaacctccgtctgccgggtttaagcaattcagccgcagcctctcgagtagctgggactacagccgcacaccaccatgcccggctaatttttatgttactttagtacagacagggtttcaccatgctgaggagctggagaccagcctgaccttgtgatccacccacctcggcctcccaaagtgctgggattacaggcgtgagccaccacgcctggcctaaaatgagtacaatcactctaggggtttacagttttggtgaaagtgaggtattctctatttttaaattttattttttagagacagggtcttcctttcttccccaggctggggcgtagtagtgcaatcacagctcactgtaaccttaaactcctgggctcaagcagtccttccacctcagcctcctgagtaccagggtctacaggtacctgccaccatgcccactatgcccagctgatttcttaattttggggacaggcactgtcttccccaggctggtctccggaggtgaagtaatcctctggcctcagtctcccaaagtactgggattacagggaggagccatcgtgcccgatctgaaaataaggttttttgatggaaattgagatttttctcaagtatgtttggaatgccctgtgcaataatcattccaagaacagagatgttcttaaggactgttgtcactgcatgtgggtaaaccgctgtgcataactggtttattgagatactcaacagtggcaggatttcagtagtggtgtaaattaatgtcttctaatagcttctgtatggcagtatccagataatttcgtcatgtttaatccatggatctctggtaagttggtactattggccttatttaaggaattttctaaaggtcaccactgcaaagctggagtttgaacttctagtgtgccattaactgatttatatgttagaaaccacagtactagaaattggtagatggggaattgttaactgagagatcttacccagtcagtctttccctgtttcctactctactatgcacacagccatgtgcatactatcttttgataatataactatctttcctatatttggtcacaagatcaaccttaggtgggttatgctgtgtgagcattacacgttctcattgtgtcaaaggcactgggtgtactgtgttgggtggtttctacatttaaagataagctagtgtgcttggacgtgtgggaaatgcatgtaacatttgcaataagggagattgggtgctgtgagaataatggggctaacaaatcgggtggtcattgatgggccttgcagagttctggtcagtctgatacctgcaggctgaggatgttccagtgaggttcatgtggaaagtgatgggtttgggaatggctggaagcagggtcatagacct

SEQ ID NO: 13565 - DNA, 58543 bp, Human
  misc_feature (1)...(58543): n = A,T,C or G
caggcaccacatccctagtggggccttggggtccagaaactgtccccagcttccagtagaggatccgggcataacctgccctggggcacccggctctggccctgggcacacctggaccaggagcagcagaagagattcaggtcagaccccagagggcacccccagctaggcagaggggaaaggatcactatggggtaggggtgtgggccggttgccaagcccagtttagggaccccacagatccctgcagcccacggccctgcctccctccctccctcactggcgctcagcagatcaatgctgcctttgctgacagctgagaatcgagctcgccttcccgccccttcccccgcccctcccgctcggcttcgtccctcgagatcctcccggaggaaccgggaagagtttgctgcggaaggctcaccctggggcagggcctgcggagggagcggctggtgtggccgcagctttccgtggaggaagagggaaagaggatcgggaaacccaagttaccaaccctgtgcagggcccaggagggctaaaggagagggactgccccctatagccagagagatggaggtcggggactaagaaaaactttccagctggagagggaatgccctgggacaaagtatccccttttctggctgggattctgtgggccttgggtagggggtgtgtgtcccctctaaggctggcttagagctcatctcccaacactccatctgcccaaacccagttccctgacctgggagtggggcaggggagcaggcccctccatcggggaggatcctcttctgggcagggtggctcttcccccatcacgatgaagggaagctcagaggtggcagttggtgggagaaagacacacccaggcccactgtgttccacacaccctgatgctgcctagcagcccgtgggctccaggcctttcaggtaagagcaggacaaccgccgctgcccacccagccacacacagcactgggcacactttaagcacccgcaccaggcacacagtgctcgaccccaacggacacacctcatccccttcggactccacctccactttcgcagccacccacacccgacccataactcacacctcactgactccatccccgcacctggtagacccacagccacccaccctgcacacacaagtagacgccgttccaccggtctacacctaaactccacgggacactgcgtcccttcccctgccgcccgcggccacaactccacattccactttccacaagcacacacgaggcgtcccacccccgggctggccttcggggccacactgccccacgcagctgtggacaccacttgcacgcgtccggcttcccggccccgcgcgctgcccccgccacgcggttcggcccaggcaccaactcggccgcccgtgcgccctgccccgccgcctgctccgcgcgttccctccctccgcctcgcctcgcttgctcgctcgctccctcccgatttgggaaggcagtcgcggggcggtcggtggaggggcggcgcggaggagggttacactgtactctccctcaccaccgtctggactctatgctggtggcacacccaattactcactgatccctgaacttagctccatgttttcagaatgtgctagctacaattcctgaaatgcccttttacttcccttttcactaattgagctcctatacatccatcaaggcccaatttaaatggcccttgctgagaaacttctaattgctgagccagagtcagcaaagacctcttcagtgctcccatgtgaacttctacaacctctattattagagctcatatacagtcattcagcagctatttctttggcaccttctgtgtgtcagacgttgttttaaacattggtgatacagcttaaaacaagtctgacttctctgctaccatggagcttatattgatgattgggattgagggcctgggtttggacttnnnnnnnnnnnnnnnnnnnnnnnnnnnnnnnnnnnnnncgcgcggagctagtggcgctcacggccgtgcagagcgaacagggcgaggcgggcgggggcggctccccgcgccgcctcggcctcctgggcagccccctgccgccgggcgcgcccctccctgggccgggctccggctcgggctccgcctgcggccagcgctcctcggccgcgcacaagcgctaccgccgcctgcagaactgggggtacaacgtgctggagcggccccgcggctgggccttcgtctaccacgtcttcatgtgagtttgcgaccccgcgcccttccgcgtttccccgcgcaagcctggcctcccggggcacggccgccccgccctggctccgccttctacccccctgcctcagggccgaccctcatctctctccccccaggcctaagcccggtttctgatcccctcgctgagcccgaccctaagccctgatctcccaggcctgacccctgcttgacctcgcttctgacctccccgcaccgcaactgcttatttccatcctgaccgccaatctctgctcctctgtcccaggtactcccgaccgccagctgcctcccccaagtccgcttggcgaagtctggggcccctggagtgggcgcccttttcctcttccccacccctgcctccctgtgtcccagacacaaagaggaacccttggctcccacacgcttctgtcacctgctccccagctctgagctatgaagggctcccctcaggggtgctcctctccagggcggccctcattcctacccctgcccagctgactgtgggtgtgtgggggtccctgtgggccccctgggccctgacactcgcatatgctgtgtccgacttgatctgtgtcttcgctcagtcttcccctccaccctcaacttcccagtggcaacggcggccgccctgcctgccctgccctaccctgccggcttggcccagctcgcctgccttgttggctggcagcaccaggcctggctctaggcaccaggggaaaaagaaagaggagaggggtaggtttggaaacactgacgctgctggggccccctcctccctctcaccaggctcctacaactttcaaaaacactgacccctcttgggtgtgaagagtgaattttggcagctcagagctcagtcttggggtacggcctggcccagccaggaacatgagaggccccgcagatatcagttgaagggctgggcctgacgctgggacgctcagaggtgcccagagagagacctctggtccctggaaaatgtgtggctattaatccctttttgctgccaccagagagggccctttggcgctggggtctcctgggtggcccacctgcctgcccacctgactgtctagcagccctcctgctggcctggctgtccctctgccagcctgagtttccacctgtgtgcgagttggccagtctgctcacccttccacctaactgtccgcagtccttctgcttgcctgtttccatccatctgtggcctgtgcagttatccgggtgcctgtctgtgcatctgcctatccacctgtccacctgactgtccactcttcctctacctgtcttttccacctgtctctgggtctgtccttcggcctgtttctcgggtgcttgctggcctgcctctgccccatctgaactgggcccacataatttcagaggtgaaggggagaaagatgcggcacagggaggggcagggggggaagacagcagggctctctcggccattaagtgcgttgggggtggcaaccttgactctgtgcagagacctcagctgggctaggctggggcagagagttgaaattgctcaggacatgaggtcaagcttcggttcagggtcaacggtttgtagtagcccagtccttagtgtccattgggaggcctaggatgaatatttgtggctataaagaggcccgttggagtgaggaaggcccagggctggtggagttgggggtgaggggatggggactacttcttaggagtggctacagagcagcctccttgagtgcctaaggagggtgagacaccccccagagaacaactgtgccctccgtgggctcctcttgggaagggacttttccaaggcatggcagggcctggggaagccaatagggctctgaggtggggtccttacccccccaggcttggccttacagcccccacaagggtcagtggaggtgaaggacctgcctcctgtcccctggccagctgctgttggtgcctcctttgaaaggaccgccccttcctctccaggagctaatccactggcacctttgccccacatcctgccctttcctgatgccaggaaatgccctcgccagggccgtgcttgtcctgaccacttgtccccgggagcccagggccagggcatgtcttgggaactctgggggaagaagtatggtgtgaaagtgtcctggtgtttaaggatctcagggaattggtcacccatcttagaggtcaaaggggacagaggtgtcaggaaccccacctcttatgtgctctgtgacgttgggttgattgctgggcctctctgagctttaggtctgtaggttgtcaaagcgggtagaaaccccaaccttgcggcctctctcttggatgaggtaatagagtgggaaagagcttggtaagctccaggggcctgtctgagcttgaaagacggttgttattattggggctggaggagggggcccacacagaaggtctctcctgtttgtgaggagctccagatgtggggtttctcagtcacactgcagggtcttgccaggaagtacttcctgctgttggactcctagccagaccattacactttgggtcaaatcctttctcctcttcccaatctgcctcagtggcagcccaagtgaggggagtccagggagtactgttagctaggacccccttcccagagacgcaggctgtggcaggaggggccccagcagaagagcctgcaagagaagggctctgggcggggcgcagtggctctcacctgtaatcccagcactgtgagaggctgaggtgggaggatcgcttgagcctaggcaacatggtgagacccctgactctacaaaatttaaaaattagccgggcatggtggtgcacacctgtagacacaattacttgggaggctgaggtgggaggatcacttgaacccaggaattctaggctattgtgaactgtgattgcaccactgcattccagcctgagtgacaggatgagaccctatcaattaaaaaagagagagaaagagaagggctcaggaaggagggagctggggtgagaggagcgcattcgccctagggtatgcctccctcccatctgccagcccgtcccctctgagccccacacagaacctgcatctttctggctccaagaggtgggagattgcctagagtacaagcccagatttggcctgtcctgcggcagctgcaagctctgggaagagaggactgctgactcctgtcttctcctgttgggatccagaatgaggggccactgagcccctctccaagctttccctctctctgtagaccctcagtctgatcaccaagctgcatccccctcctatgccccagtccctgatttaagccctgaagccttcacaggccctgctctctgaattttaagaaataccacctcgtggcccatcctgctcgctgagcccttatggggaatgctcgctgtccccttgctgccccctctcaaaggccactccagcttcccttgaagtcagagtgctggagggggctgagcaagaccctatctcccttcatcctccccagccactatgagccgcaggcctgccgctcccagcccccagggcccagcagactttctctatgtgaaggtttgcggctctgtaaacatcctccctcagccttgtccgtggggtcagaagctgtgggaatggggaggggaggaggtggcagcagcttctggggcccgcagactcctaacccccgagcccccgacctcccaccccggccatctgagaaagaacatcgcctgggttggaaatcatcccagcaaagtgtcctcagaaccctcaggcatccccgctaggtcagtcggtcctcacattttgacagccccattttacttgtaagaaaactgaggctctggagaccaaagtcacctgggaaatgagtagcagatacagcggactctgtgcagagacctcagctgggctaggccagggcagagagttgaaattgctcctgcttccttgtccaggactgttcgctccgttcctagtggccaccgggcttggctcttggagtctgaaatgaaatctctggttgtgtgtgcagcaccaactatgcacagggcaccctgctgagctctctctaaaccggtctcattgtgtccttctgcagccttgtgaggtgggcactgttatcctcctcatttgacagatggggaaactgggactcagcagaggccacccagttaatgtggaagagcctcagcccggagcgggggctgactgggagctgttgcgctcagcaccacagcctcagctagcagcaccccaagtccaggctcctcaagaacagcactcctgtgtcatctgtccgtccatcccagcaccccgcacacagtcagcagggggtgggcagtgatggcattttgtggaattgagtggaaactgccagcctcacccagtgcagccacgttttagttgtagaccacgtcactgctgcgtacctgtctgaatgtctcacacatgcactcactgcaacatcgacacacatgcacaaacacacacacagcatccatccaacaaaaagagttctagtttacagctgcccctaccttttccctgacttcacagacactcaccatggacacacacccgggcccgtggctccagcccagacccctaggacagaacaaagcttgctcctgtccttgagtttttggccttcacctatacacaactgcagggctgcccttgcgggtctgtgtgtatttgtgtagccaccttggagggcagcctcagaactgtggaggagcggggtggctggcctcgtagaacttcgctggcgtttgctcctcctggggggtcctcgggggtcctttgatctgaccttggggtatactgctgggtacaccaagacacagaaaggggcagctactcatccaaggtcacacctagtgagttagtggagaactgtgccaggaacccaagccttttgtctcccagatcaggactttagataacaattttcctaacctagccaacaggggagatggatgctctaagaactttgcccttgtgattgggaaagtctttgagtgtgacccacatttttcgtgctgctgtttttcagccctagtccttttgcttggtctttgtaaggagctggggagaccatcctgttcttatactgccttcctcctcctccttgcactccccttcacgctcctttgcctccttcttctgaagttctttggtgtcactggagccggttcgatctctcactgacggcccaccccaccccaactccatagtacgttcattcttccattgaagacgcgctgctagatgtctaacttcaatccctattgctgccgaagcccttatccttgggatatttaagccaggagtgtttcaagaggtggttattattcttgggctgatggcagcactttgagtggatgattaatttcaggctctctgagccagtcaaaggagctggaactgcctgggagcagggaaaaaggaaggccgaggccctgcccacaaaggaggctgcccagggaacttccccagactccctcctacctccctagcaccaatgtgggtctttggggaaggtccgatcttcttgtgggctatggagccccccagcagggaattctgcatgtttgccctgggggaagctcctagtgtgggagttgagaggttgaggatgggggaatagcagggacttttcgtttctccagaagctgtcctgcggggagtgaagagcacgggctctgaggctgacagatctgcgttccttcctggttctagccttagcagtcgtgtgtccttgggcaagttacttaacctctctgggcttcagttttctcatctgaaaaatgggagtaatcataatacctgcctctaagattgtcaggactggatgagataaggcaccgaacactgctgggcactgttagccatgatcatcgttactgttattattatgctgttatcactgtcctcattcttctcctccggggagaggtgtggtaggtgtgctgggctcagcaaggtgagtgtgtctgagtctgctctggagagaataggagctatgtctgcctgtgtcctggggcgagtggttctccatgggagctgaggctgtgtcttttcagcctcctgtgggccctgcccatgagagtgtctgacttacattctctcgtgtaacgctcacagccatcttatcaggtgggtgctgtcttcttcatgtcacagttgagcaaagtgaggctgggtgaggggatgtcacccagctcatgaatggagcccagcctggctacctagcatgctcactgatttgtttcttccttcatctggcaaacagttacagagcatcagctccataccaggaccagggagccagagagagctagaccatgcctgtaccctgcctggcagagtgggggattgggggtcactgtgaggaggtcgcagagtctgccgggaccactggcctcagctgcttcttctcccagggagaggtttggagagaggtctggtctgtgtgtagctgtgagtgtgtctgtgagttatggggaggacggtgtatgccagagggccactgtgcggccgagtttgggcctcatggtccaaccctggcagctggcctggcccccgagagataaaagtagagccatggtgcccagagagacagccagggactcctgggagaggagggcactcccccactctctcctgagcaaatgatcatggagaatgagggcagggaatcccaagggagatttagagatctcagtccccatgcttactgggaaggtgtccacccccactccaccccagttcctgagcctcggtatcttcttctgtaaaatgggcctaacaggaaagtggacctctcagggctgcctggcacacagtcgtggtgggcaaatgagagagactgctgtctcaggaccttgaaatgcatagggtaccaggtagggagctctcttccagcatcttctctgggggcccctcaggtgacagggtgccacttcacagggcactcagggggctgcctgcccccagtggaggctctgaggggctggagaaagggtgctgagccgacctcagtggctacacagagcccccaggacttcaggttccctgggcaaccctgtccctggggcaggagctgcgtgccctggggatgaggcacaggaggggcagccccaggcagcagactaattgggctgggaatccgtgggcagcgcctgaggaagggaggcaacaggagctcagcgattccctccctcctcaccccacggagatttgggggacagtggatagagcagggtctctagcctaaaggatggagggaaaatcttgaggcacattctcctgagactccttggacacccaggccgggaaggtgggactggaggaaagctcactggaaataaatggagcatggttcccatcaaagcagaggagatggaggtcagacagcaggaaggactgcccaagaaccaggaggtgaatgagattttctgggatattgtttcaaaaacttggagccccctgtctagccgggctggacaacatttactcgaattgtccctatcaagcaaggaatggctccctactcccacagagcgaaagatggaggggagatgcctgttccctttgagcccaactttggcggggtgtgggtcgggggtggggtagggatcagatcgggtacccactggcttttgggcagtggtgggagggtcacaggctgctcctccttctctgccacttctctctgggagcctcgggcctgtccaggttgctgtctttgggtttattttttgctgggcttggctgtcccctgggaggggagggggcagggagagaaaggaaaagcaggaacagctttgtcagcacaatctcaggcgccttcgctactgcccgtcttggcccagctgccaccctctactggagggaccagcccctgggcacagtggggattcagaccctatggaacttcctcgcttagaggcaggaccagcaggaagggactaggcctttctacccccatcctctctccatatatccctgctatacagaacctcaggtctcagcgctggagcagatccacgggcttcatttcacaggtggggaaactgaggctagaagggacctgatggctcaagggcacagcccacacgggggccttttccaccttccctccttatggagtaacatgggagaaatgctgcctccctgctgcccgttccctgggtgaactcattcactcatctcattttccagcctctggggattggtggcagtctggtgggagagacgggggacggggaaaggacagtgtgacccatggcccagcagaggaagggaggtacaacctggggatgcacagaggctaggtgggggtatcaatccctcccctatatgctttttatcctaaaaaaatacattcgccctattttacagacagggggattaaggtgtaaagaagttaatgacttgcccaaagtcaacatagctgacaggtggtagaggcaggatttgaacctagcatgtgcatctctgggagccatgcatttggccactccaccatgctgcctccccaaggggcccctgtgggcccttctttcttttcttttctttctttcttttttttttttttttttttgaagcagggcctcactctgtcacccacgctggagtgcatgatcactatgatcactgcagactcaacctcctgggctcaagtgatccttccacctcaccctcctaaggagctgggactacaggcgcacaccaagacacccagctagtttttaaatttttctgtggagacagggtcttgctatgttgtccaggctgatctccaactcctggctccagcgatcctcccacggtggcctcgggagccaccatggctgcctgctgggcccttccttcttgaatgcaacccccctggctttcctcaaacctgcctctgtggcttttctctcttggttctatcagcaagcagctctgcctcctctttctgccccttgaatgttggggctttgtctcaagtcctcttcacagtacatagtttcagggggtggtctcatgcactcctacgacatcaggggtcacccctatgatgacagcctccgctctgcagtttcatccctgcgcttcctgcctgctgacacctctcctcctcattccctgggcatctcaaactcagcatctccctccaaacctgccctccttcctcaatccatgtgacagtgactccccgatccccagtgcccaagtcagaaatgccctccacacaagcatcctttgctctcacctaagaaatgacttacagtgtcccaaagcattgcgctgtttagtgcttctgtgcttttccttctgcctgcaactccctcccctcttctgcccactgcatcatctagctaactcctattcatccttcaactcccagtttgagcaccacctcttcttggaagcactccctatccccattacccccaggctcaactgagggcccttcagtgcccccagagttctgttcacccagccctgtgcgttttttgcttttctgcatgggactatgagaactgggtgtgtgggggttgaacacaattcttggcacatggtcagcaatgagtgaatgtttgatgaaggtggcattggggccaagtagtaaggatgagaagggttttgccaactagagagaagtggagaaaagacccctcagccctctgtgtggagcactgagctgtgggtgttcatgatttttatcccgagtgagctccaggtgaagggaacagcagagcaaaggccttgagatgggacttccttcccctcactcctttgccccaagacctgcagagcacagggccttgattgacaggctgtggaggtgggccttaccctgtgggcagtggggagccatacacggtgacaggccagggtggggacactggatgggaaccagggtttgactctttctgagtgagtgctgtgcagacgtgaggtcatctattttttccagtacccgctaggtagcaggcactattattgttcccattttgcagacaagaaactggggctcaaagaagagaaacaccacatactaagttacacagcttgtctgtggttgagtcaagactcaaacccatgtcggcatcagggccaagcccgagctctaaatggttctcagcctcgccagctgacccaaggcagtttccagtggcctaaggcaaaactgaggagaataaggacggggtggcgactctttcataaagctaaatttattccacttaaaggactgtcttttagtatgagatgatgtcctttcttttatgaaatgatgggctgggaaaaaaatgtccttgcttggcaaaataaaaagttgacaaccttatgcagtccccaaagtgtttttggaaattttaccggtggtgcgtgaaatccctgagtctgggcgccatcccggctcctccccactgagctgtggagccagaagagggaggggtctggtagggacagagggatcaggggacagaggagcctcaggtcccgcactttgcagtgaggaccaacccaaggctctttcctaagattgggttgggcgggtgggggggtggggggcagatcagccagaatcaagggctcacccctcagttaaaggagcactggaccgggaggcagcaggcttgggctcagctcctgcctctgcttcctggaggctgtgtgatgccaggcaggtgacccaacctctctgaggcaccagcttccttatacatagaatgacaattgccatctgtccctgctcacctcacggggctgcttcctatagcaagtgcttggtaaactgcaaagtgctgtgaagaacaggggggttgtggtggttttaccttttttttttttttttttttccttttgagacagagtcttactctttcacccaggctggaaggcagtggtgtgatcatggttcactgcagccttgaactcctgggctcaagcgatcctcctgcctcagcctttcatgtagctgagaccgcaggtgcacgtcacggcgctaggctaatttttaaattttttgtagagaggggatcttgttatgttgcccaggctggtttcgaattcctgtgctcaagcaattttcccaccctggcctcccaaagtgctgagattacggacatgagccactgcacccagccctggttttactgttcttatcttgccatcagaggatcccacttctctagggtcctgggcccctcatctcactttcacttttcacttgcactgctttgagccctgaggaagagacatatgggggagcggggcaggtggaatgacacaggccctgtaaaagcagggtggccacactagcaattcctgtcctcaggctcccctggaggacagctcagagatgcccaggctggagacctggggaactctaggaaaagaatgcacgaagctggagccaggctagagttctaagcacagactttgtcactgagtaataagattcatagtctaatctctaccaggtattgtgctaaatatttttcacactgcttcatttaatccttccaagagccctatgaggtaggtcctatcattatccccattggatggaagatgacactgaagcttaaaggtgaaacactgcccttgtcacacagccaggaagtggtgaatgcccaagaggacgggagttttctgggctcagctcagacaactgagtgcctggagaggccgagtgtgcaacgattctgtgacatgagagggtgggaacggtttgcaggactgtggtggggggccgagggggtaatcagtgcacatcaggggcaccgggttggggtcagaaggcaagagacacgatcctgctggctagcttctagcagtcacctccctctctgagtctcagcctccctctctgctctggctctcaataataacaaagataatactagcaggaccttactgagtgcttaccgtggaccagatgctgctctgagagcttgccacgccttctatcactttttcctctcaatgacactatgaggtaggtactgttattatgcctacttttcagatgaggaagttgaggcacaaagaggttacgtgacttgcctgggtacatgtagcagggccaggattctaaccacaagagtctagctctataggctgtgatcttacccacctaactcacccggactatgtctgcctgcttctaatggggggtgatatgaggagaagttgagccttaaagttcaaggtcctgggccgggcgctgtggctcacgcctgtaatcccagcactttgggaggcagaggcaggcagaccacctgaggtcaggagttcgagactagcctggccaacatggtgaaaccccgtctctactgaaaatacaaaaaattatctgggtgtgatggtgcgcacctatagtcccagctacttgggaggttgaggcatcagaatcgcttaaacccgggaggtagaggttgcagtgagccgagatcgtgccactgcactccagcctggatgacagagtgagactccatcaaataaataaataaataaataaataaataaataaataaatacagttcaaggtcctgctcccaccccgattctaccctggggactcattccttccctctctcgccctttcatttgagaaaccttcacttctaaatgaagttcagctgcttatgccagtctccccgggccaggccctgtgccagactctggggacagagcaatgaatcagaccttcctctgctccctgggggagatgggctgggaagctggcagttaccaggcagggtgataagtgccactgtccaggcagcacggagtccagtgggagcccagcacagagggccaagccctgccccaatctgggcatggctgggaaggcttcccagaggaagaggcttaagttgagactgaaagatgagtagaagtaggagttagctaggtgaaaaggagcaaggaacagtgtttcaggcagagagaatagcacaggcagagacccagaagtgaggctgaacagggcatttgcaaagaacagcaagaagtcagaagagcgggatcctagaggaggcaagaggtatctggagaagaggctgggatgcaacagggccaggctcggcagtgaggacaccgggctggggagctgcagcttcctgagagggtgatgggaaggaagtgatgtcaggagtaacatggcagattcgtgttttagaaactcctttctgggactggcgaggaggatgctggaggggtaaggactctggcaaggagccctggggatgctaccaacttgtccccctttttcctttaccttccccccagggtccagcctcctgagtgcctcctccagagctattgaccaaccctgctcagggcctggctcaacctgacccggagccctaggactttgcctatagggaaagttcagctgcttatgcaaactctggcttggggggagatgtgtgtggttgagctgggagctggtggtgtgtgggggtggccttggaagcagagagggtgggtgcaggcgccgaggctgtctggaaagggagtctggggatataagcttggggtccatgggggtccctagaatagtggccttataatggctccaagagggtacactgggatttggcccagataatggagggacaccctggcgaaggggcagagtcctggcagttcagccagccccagctctgtctttttcttgaagctcaacagagtatggaaatcattggtctcacccagccccctcattcttctgagggggaaacaggctcagaacagggcagggactaaactcaggtcagcagtagagcccagaccagaacccaggctcagtccaagcatcttagttgtctccaatgatgataaataacagtgaaaacctttctgcagagcttcccaggggctggcctgggcttaggcaccctctggatggtcttgggcagacgtttttcacatctcgagccttagctcgaggtccaaaatactacctgtactgggaaggaggtcctctctcccactgacagtccacaaagccgttttaggcatgctggacccattgtgggctttacttattgtttgttcaatgaatcccactgaattcatgtaacaaccctggaggaagatactattatgctattttgtgctgaggctcagaaaggagaagtgacttgcccaaggtcattcagctgagaagttgctgacttagggctggactccaggggtccagatgcctgtctaggatccctgatggacacagccccatttttgagcctgcgctctcagcgaaaatcagttggtgtctcaacgagacccatcgtcagctgggcagggtgtgtgtatatatgtggaagctgggctgggctgctggctggaactcaagccacaccaacccctgtgcccctgtgtttggacctggctgcagctgctgcccgtgggggaaggggaccttgccacttgccctcctgcatcaagggttttttctccttggcctggctgcctgggcaaaggagctggctgtggcatgaccatgtgggcacctgccagcccctcccttgttggggtctgttcatctaatgcccttcacatgacaggcatggggtgggccctggctggggagagggatttgcactctcctaatccaagggctgcagccctccctctgtcttggccagggccgtgggagaggtttgtccttgccccatgcccagcagccccagctcagatccctggcatacacccagttcctctgcttggggccttcccctgtcctgcttctgctccccaccctcctactctgtgagcagaatcaggagctagggggcaatgctggggcattcaggactgatggaggtgcagtgctacatagcatgtgggactgaaggatgggggcgatgtcagggaggtttagggcacatgttggggcaaagttgagggaagatgattggggtgcagagcaggagtgtttggggctcatcctgggccaccccttcctggaaaaatttggctacaagtcagggaggcaaatgtgtgggccatgccccccccctcgctaggcagtaaacactgccgtcgcctgggagacaagaaaacatcttggtccccccacggttgtttataccaggactccctctccttctctggcctggtctggcctctccactcctgagctgggctacctgagtcgagggtccagcccccggtcatggcaggaggccctggcagcacgcccactggcccccaccagggactgagcactcaccacctcctggtggcctgtcccattggaggccctaggtcttattgatcagaaacgtgctcccaagccttggcctccacgagggaggcctgggactgtgccctggatttgctccaacccactgcctgaatgcagtcactggcctcccggtaacctcagcttcccatgttcagtagcaggcaggatctagattagagcttttcaaactgtttcaagtcatagatctggttctttgaatgacacctgatacagaagcacaatatataaaacagatcaaagtagggctactctgggtggagtcacgggttggggcccagaattctacccactctatgccagcctatatggccctggcatatcaacccagagcctgtacatggtcctccttgctctagaacacattccaggtaaccctggaattccctggccaaatacttatgcctacttccagggtctgcacaggcccttctcccaggggctgtcagagcagccctaggctcaaggacggctgtttgtagtgggtatagcaaaagcccggaagagcaggctgaggcacccccaggagtgtacccaaggcccctcccagggagggatgggcccagtgtgggaagagaatctgaggatcggagggtagcaaggggctggctgtcccttccctgctggattccagcatgggattccaaggcatccaagaactaaaattcaaacctggtcttctaggtcattatgaaggtatatgtgtcaggaaggatagagcaaattttatttaaaagtttgttaacctgattgaaacttttaaatatttagacttatggtatgtgggtctccatttatactctctccccagtcctgccagagttaggggtgagcttgcatcaatcctccttccacccacccacctacctctgcagcaaccccaagacagccttacccagaactctcaggcttcacaggacagtgtggaagtcccactcgctgaaactcaaggccctggtgactgcatctttctgttcactccccagatactgtctgagcatcagctggggccagcctgggggttgtggaggagccagactggccttgccctagagggatggatctcagtgaggagtaagcgggtaggaacactctccctcttgtagaatagtgtgagaaggggtgcctgagggggcccacaggggccctggaatcctaacgaggggctaaagaagctcctctattcaaagccgatcatggatggatgaggtggaagagagacagcccaagaaggggagacagtacaaaagccaccaaggtggaaatgtacagggagtggagaagtcgagtgtcgctggtgcttaggatgtgtgtacagcctcaaacgctggtctaaggagcttgggttttctattttaacagtaagaagctgttgtaggattgtaaatggggtaggggctgaggaagaggcattcagactgcaaggtaagtggactggaggtggggatagggggctggaattgtggtggtcagtgagaggctggctggggggaaggggaatgggggtgagtcctgggctgaccaggaatgggacttgaggggctaggaagaaagaggggatcttaactctgctttctgggaccacatctcctatctcctcctcctttgttctgtctcagtttttgtcttcttctcctgctattccactgccctaggtctccaggctggggagaggggcactcaccctaaaccccctctccaaagcaggccacttcacacaagtggccaggcaagaggccgcagttgtataagaggcttttctcagctggctggactactcattcgttcatttattcattcattcactcaacatttattgagaacctacaatgcaccaggccctgcactaggttttggagagaaagtaggaacaagatcaagtacctgcattcatggagcttacattgaggggggcgggagaaccaggaactgtatctatccccggtgtctaccatctggcacctgtgcctgggctggatgcctgggaacagggactcttcccattacctactcatttgttccagctgccctgtgtcagcactcacctctctggacaatgacagaggagaaggggtcccatgcccaggatgccagccccagggagcacctgtctctgtaagaacagcctggccctcggggccaggacctgggctcaggcctagttcttcctactcactcctgactttgagccctttgcaaggacccgactttgatttctttatctgtcaggtgggatttggggaggtcctgaggaggcgaggggaccagaatactggacctcagctccagtattctcccttggtgggcaactcctttggctatgatgggagggggaagggggcttgggactcaatattatcatcattacccatacaagatagtaatagttgctacctattgtgtaatttattccgcactatctgtatggtcggtgtgtcttctctccccattttccggatgaggaaactgagtctccgtaaggtgaaatgacttacttgaggtcacacgtgaaactacctactccaagagccctttaggatggtgctgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgttaatttggaaacggaaaaagtagccggccgggcgggggaggccgcggggaggtaaccggagccgcagcaccgccccggcccctcccgctctcggggcctggcattggcaaagccccgcccctcccagggacgcaagagccccgcccaccattccccgcccccggcatgccccgcccatttccgtaagccccgccctcgccgaggcgggctgggggcacctgggagtgccgagcagtggcgcccctgctgaggagaaggagcccgggcgggggaagggggccgagggctgtgctgggggaggagtcccccaggagccctccccgcaggaacccgtacctctcccgagaagtcgcgcagggtgtctgcttcccttgtccctacgtgaacccaagcctttctgcaacccctctgtaggttcacccaggggagacccctgcctccagactgccggaccagggatcattggtcccattagaaagacgaagaaactgagtcctgagagggacagttaacttgctaaaggtcacacagccaaggcagagcagagctgaattcaagcccattcttttgactgagatacatttagggactgtctgcctcatttagaagaggagggggcatcaggaccagagatacaatttgtccccttccccctatctccagcacggtttctgtggttagtaagttactggaagttctgcttatcattattcaattatgggagggttttggaggtagaaggaggtccctctaaactttccatgtaaatgaaatgtaaaagaccctcttctggggactcccagaacacagaagtccctgaggactggcagcttcaggagccgtccacggccttgcttcccattagggaagctggaattgccagtcccagatggatcagcaaaaaatagggccctcagagactcccacccaatcccttcctcccactgaggaataagctgagactcagacacagtttcccaagtcttcagctgactggtggcggagtcaggagacagaacccaccgacccagctttctagctgtgtccacgcccttctgcttctccctctgctgccccccaatcctgacacctctctcacagccaccactcaggatcctgcctccatcagctgggcctgcaggctgggcagcctttctctttacaggcggaggaaactaagaagagtatctgcagatgtcctcccagcttccagttaaagaccctcccaaccacccttccaccttagctgtgggtcaggcccagagaagctgcgctcctggcctcgagtcacacagcaagccttttccagcttgcaaagcccactggattcagtctggctggtcctggatttggggttcccactgggagcatggctctcagggcagctgtaaccagatgccccaggtgtggcctgtgagtttgcatgctgctttgcttattagtaacaaaggcattgaaacccctcttcctcattgtgtccccaaaccacccactgggtggggtcctcaatggctgagtctacagaactcctgggctgggctcagtcttggcacctgagctccccagggaactctgccctccacggtgctcctcttcgaccctgtcagctcttggtgctctctctgccctggaagtactgagaacccagtggcaaggactaactctttcccttgtcttggactcttccctccctctccctcccccaatatagtgcacaggttctgctgactcagaggacagaaggctcctttgaggttaccctgacccctgccaggttcaagtagctgggaaactgggcaatgcttgaacccactgccacaaagtcacatgcagcaggaagggcaggggcaggtcccatcttggccccaggatgagggaatttttgaggtgggagtgagaggcaggtgcctgagtccttctacagacagaggagaaatccaaagaacattgcattaggaatcaggaaatctgggtgccaggcccaactctgtctctgatctactgtatgatcacaggtaagccaggcccctctctgggactcagtttccccatctataaatgagaaggttggttaatctctaagggacctttcagtgcccagatatagccagtatctggtcatatcttgccacttccgcttcccctcatacaagtcaccatcatcagctggtagtggctcatgcctgtaagcccagcactttgggagatggaggcaggagaattgtttgagcccaggagttcgagacgagcccgggcaacatggggagaccctgtctctacaaaaaataaatataaattagtcgggcatggtggcacccacctgtggccccagctactcagggggctgaggctggcggattgtttgagcccaggaggttgaggctgcagtgagccgtgattgcaccactgcactccagcctgggtaacagagtgagaccctgtctcaaaaaaaaaaaaaaaaaaaaagtcacacagggtgaagtggcatgtgcctgtagtctcagctactcaggcagctgaggtgggaggatcatttgagcccaggagttctgggctgtggtgagctattccaatcaggtgtccacactaagtttggcataaatatggtgacctcctgggaacagaggaccatcaagttgcctagggaggggtgaactggcccaggtcagaaacggagcaggtcaaaactcccgtgttgaccagtagtgggatcacacctgtgaatagccactacaatccagcctgggcaacataacaagaccccatctcttaaaaataaaaataaacaaaacaaacaaacaaacaaaaagtcactggcatctcttgccaggattatactttccaactcacaatggggcaaacgtcattgctccctcctcccctctcccccaccatagtccgttcactcagcagcctgtgtgatctttttaaacataaggaagattgagctactccctgctcaaactccccatctcactcagagtaaaagccaagatccttaccatagccagtagatggtccgctttccacctcccctgcctctctgccctcaccccccaccactctccccttgctcattccactctgggatcactcctttcctggtagttctggaacacagaaggcacccttctggctcagatgtgttggatttgtttttccctctggaggtgggatgggggttaagggagcatgaggtgggggctctgacctaagcctgccagtctgagctcatgctcagacacagcatgagtaaaggtggggaggggaaaagagcgcgtttgccattgtcagggacagagctatgataatgcagtgccaagtgtcaggttgggtaccggctagtgaagagcaagttggcctggtgggtggggctttccttgcaatcatgctaaggggtttgggcctgggcccacaactcagtggatttcacactttttaaaaaaacagcaaagctttttgttcacatgaaatttttttttttttttaagatggagtcttgctctgtcgcccaggctggagtgcagtggcgcaatctcggctcactgcaggctccgcctcctgggttcacgccattcttctgcctcagcctctggagtagctgggactacaggcgcccaccaccacgcctggctaagtttttgtatttttagtagagatggggtttcaccgtgttagccaggatggtctcgatctcctgacctcgtgatccgcctgcctcagcctcccaaagtgctgggattacaggcgtgagccaccgcgcccggcctcacatgaaatttttacgccaaagccagcatgtaaaactgagccacccgaatctgcacggagctgctcagtggaaccgagggaaggtttccactagccatcttgcttgagtttctcaaatcctggctgcctaaattccaccccatgtttccccttcctttcaatggcatcctgcttgggagggcccacacctccctgtttgagaagtcagctctgtctggccagtcccaacagatggatgcccctgtgtcctctttgttccactctggctcttgtcaacacattgctcagcccactgacctggtgcaacaggtaggcaggctggcacggcagaaggaagcagacagaacaagtcggaaggtttggggctggtgcaggtgggagaggaggaagctattcctcatcaaacaccttgtctagaagacactgcctttcatgtcccgtgggacagaaaccattcaagctggctcaataaaaactggcttctgtactattacatttgggataaagaaaaagaaaaattggcttctggaggtagaggacagatatggtaaggaaagagaattctttagaggcttcaaggcagaaagcacattttggattcatgggatagagagcagggggatgaggttccagcgtagtgcagtctcatggcccatctctctgcacctctgccaactttcctctgtggttcttagttccattcctgcgaaagacaatccgattggctcagcccaacctatgggtgggcccttcttgggtcagtctccagctctccatgaatctgtggcggccaggagagtgctgtggagccaaccgcagggctgtcatgtgtcgctctgcagtctgggcgccacaaaggggccggctgagagggctgaggggtgctggaatccagcctatgcccaggggtggggcagcccaggggaagggatgcctgtgctaatgggtccgtctagaggggtcaagtttttataacttgtcaggctaacgggaatgctttttttctaagccatcctccaagagggggcatttttttcatagtttgttctatgtgctggcggctgctgtccctccagggacagcctcagggaaactcagctgagggccaactctctcctttctaccccactgctggagagtcacaaggcggaagggactttggccattactgagtagtgctccacctacatgttgcagacagggaaactgaggctccatcagggccccattgcaatttctaagccccagcgcaagcctctggcccagagaagcagcagcggcagtggcggcggccctggtgtggggccctgggtcacgtgctcttgctccctttgccatatttagaatcgctggatcaggggaaacttctcctcccagcccctgaggattcttggaaagagcctcgctctgaggcctggcttactgcccctccccttattcccctgcaggagaaagtaagtgcctgctctctctagaagagtctgggggcctccaggctgccccccttgtcaggaagtgcctgtcaagtctagctgaagtcccttcttcggtatcagctccggtttggggtttaaggagcccctttcttccagaaggtgatggtggccatagcttctgccctctagggaccttggctgaatggaggacagactggcctcagggtcctccagctgaggggagacagagccctgcctttgggccctggtctagggggcaaggaaagagtcacgcgctccccaggccagatgcacaaatcacttgagcttgggggttggagaccagcctgggaaaatagcaagaccttgtctctactaaaaatcaaaaaaaattagccaggtgtggtggtcccggctactcaggaggctgaggcaggcagatttcttgagccttggagagtgatgctgcagtgagctatgattgcaccactgcattccaacacaggcaacagagcaagaccctgtctcaaaagaaaagaaatcagggaaactgctggtggctgggcagtccccagacactggcagggctcagtctgggagggacgctggaaagacgagggaaggaaggaggctctggaggaaggagggggcaaggcctggatctgtatttaccttggccttggtggatacttgggggtggggagcggtcctcttctcacacaggctgcttcctactggataatcaagccttaaaaacaaacagcaacaaaaaacctaaataaaaccctgaaatgcatgtgttgagtgcctgtgatgttccaggtctgaagagccatcctcgctgctgaggataatggtcctgtgctcccatgggacccctctccaggcgtggtcttttctcccaccttcctctcccagctccatacctcctccatctcttcagatcccccaccccaccctcctgcccacttctgagagttgggccttgcctcttcccagagcagtccccagtgagtaggggctgtcggcctcctcccttcccacagcctcctcccacctacatgccttcctgtccctgtggaagctggagggatccttcctactccacaccagctcctccctggctctggatcccagcctcccatcttccttggggacttcattccattgactactcactctgtctccccgcatcttcaacttctccttcttgatctcttggctccttccactctggctctctcatcttaaaagaaaagaaaaagattccctataccctgcatccttctccagctacgatctctgatctcttctttgcagtcaaacatcttcaaattgttaaacctacacttactgtctctacctcctcactgcccctcccctttctcactttttctgggcctgttctggtcttcctctccttctgagagaaggctgcccttgccaagggacccagtgaccaatgtgtcaccaaatccagaggacatttttcacgccttatctcacttgacctcttggcagcatttgacactgttgtctactcccgctttgaaacatgttcttcacgtggcctctctgacacttctctcttctgctttccctcccagctctctggctatccctcccagtctgcgtagagggcctctgttcctgctgcaccgctggggctccatcgggtcctcctctaactttgctacaagctctctggactgtctcagctgctcctgtgacctcagtcaccacctctaccctgatgtcccccagatctgcatttccagccgggtctctctcttcatacccatggagtgtttgcccagtgcccatagccctctctctctctcaacatgcccaccacccaacacctgctcctccagtggggtctcccccgtcccatgaaggcactcatggcaccttcatccatccaatgcccaaaccagaaatagagaagttgttctccttcctagttcccgtttccagttaatcaccgagccctacttcctgcggtgttttccaacccatccactcctcttccctgctgccaccaccctgggccaggccacagtcatctgtcgtctgagctattgtggagctttcttggtctttctgctgagtcttatctcctttgatctattctgtgtacttccccaagtggtcctgagatgcaaattggactgtgtcatttcctctcttagaactccacaattggccaggtgcggtggctcacgcctgtaatcccagcactttgggaggccgaggcaggtggatcacttgaggtcaggagttcaagaccagcctggccaacatggtgaaaccccgtctctactaaaaatacaaaacttagccgggcgtggtggtaggcacctgtaatcccagctactcgggaggctgaggcacgagaatctcttgaacccaggaggcggaggttgcagtgagccaacaccactgcactccagcctgggcgacagagtgagactccgtctcaaaaaaaaaaaaagaactctacaatgactccccattgcctttgggatcatgttcacagtgcctgagaatgctactcaaggcccctgggtctggccctctctggtttttccactgcccccttcactttaggccacaccatccagaactgctggccgttctgggctgcctcgacggccacattcccactgcttgcacatcctgcttcctctgcctggggcaccccgacccctgtccagttacctcctccaagaagtcttcactgatccctccactttggttgtgcggaaggcttcttgggactctccccgaccccttgagtacactgtcatggcctcgtccatcccgtcaccactgtgtcatgttctgtgttgttaattccttgggacctggattattcatttctggttttacaataaacctggctgagtgtaggtgtctgaagtgaatatagcccagaggggtcaggtgacaacctcttttctgctgtgagatgccctgccatctttcctacccccatcatatccccatctctctggcctggcctcccagcagctgtccctccagggacatgttggacatgtcgagagagagagccgtggacactgggcaaacgcccagtgggtatgaagagagagacctcagctggatccagggacatccccagagaatctggagctgagctgatggccgatcctctccaccccactgctggagagttaccaagctacagggaccttaaccatcactgagttgtccccgacctttgtgtgtgtttctgacagggaaattgaggcccagagcattagtagggcccggtggtccaggtggtcttgggctcaggtcctgcgcttatgactttgaacaagtcatacctttcttttctcatttgaataacagctttattgagatataattcacatacagtaaaattcctccttttaaagtgttcagttcagaggattttagtgtattcacagagctctgcagtcaccacagtatacgcctctgaaccgccctctccttatcagggtgatgatggtacggttccatggggtcactgtgagaactcattaagaacatgcatttagagggcttggcacagtgtctggccaataggaagcctttggccagcaggagcagttatggttattacttcaggtcaccgcatgagagccacctccccagcagagctttccccctcctgccctgtggccgcttctggacagtgacttgaggaggtataaatgtggagaaggcggtgattgcagttgtttaaaagccctgagctggctaataattgagtcagctgcaactgctcccatcacctaagccagtgattctcaaagtgtggtccccataacagcagcaatagtatcaccagggacctttgtagaaaggcatattttccacttcaaacttactgaatcagacactgtaggaataggtcccagaaatcagtattttaacaagccctccaggtgactctgacacccaccgtagtttgaaaaccacaaatctaagcaaaccattcactttttcatctctaatcctcttgctccctcctgaacgagtgggatagtcatgggatggggagacgggggaaatggagaggaaaggttggataagccttgtgatcagaccagctggggagagccagccaggcaacacccgcctgtctcattctgcctcctgggctgggcagggagaaagaacatgggccacaacttgcaggcagacatgatgggcaaagatgtcctagaaagtggccgctagtctggcctgtctgctggggagattagagagggcccaggccagccagcacccatgtttcatctatatttgtatagatggagaaactgaggtcccagagggggccagagagaatccttagaaagtcctttgatggatgaatgaagccacaccctagttgtggcaggcatgagaccccagctaaggggctccttcaccttgtctcctctacccctgacctccagatactgatctctcttctgctgtccctgtgtgaggaccacccccactccaggaaggccaaggcagcttgagggtcagcctgagctggggttctagctgcagctctgccactgattcactgtgtgatcctgaacaagtctatccctccctgagctctatttcctcagctggaagatatggataattattcaggtgcctggaacacaggatcttttctttttttgagatacagagtctggctctgtcccccaagctagaatgcagtggcgagatcacagctcactgtagcctcaacctccctggctcaagcgatcttcccacctcagcctcccgagtagctgggaccacagatgcacacccccatgcctggctaatttttgttttgattttttttgtagagacagcatctcacaatgttgcccaggctggtcttgacctcctggactcaagcaatcctcccaccttggactcccaaatgttgggattacaggcatgagccaccgcgcctcgtcccaggatgttttctattagtccaagtatatcccttcaaatgtaatgagagtatcaagggtatagaaactcttagccagtgggttaaagcagggagaagtgaagtttgggggctttttaagcagcgtccgccaaatggagatggtcaaggtcagaggcgttactttttaggaaagacatggggcagccagaggagtcagggatggatgtgctttggggacctcttcagtgggtacaaactggaggctttggcttggtaacatggtgttttgatgtttggttacagtgaactcctgctattcatttacttagtctttcaatagtgctgtgaaatcaatcaagcaatcggtcagtcagaataaggggcaagagagtggagatgaggccattctttcagagaggggatggctggggaggcccctccaaagaagtggcattggaacagacctgggtgaggcagaggaaacagtaaagcaggttcaaagcctggaggtggaaatatgttaggtgtgttccaggactggcaaggaggccagaataagtggggtgcagtgagccagcaggagagtgaagaaggtcaagtttggaggcgggggtggaggcacagaccttgcagggccttgttgtcagtgccgaggagttggactttccctctctaagtgcgatggaagtccgacgagagttttgtggagagcgatggtttccagctgtgcattgtgggaagatgaccctggctgcgttgaagggagtggtcacattcaggcacagtggaggcagggaggccaggtaggtgccagatggtggcggcttggttgggatggtgcgacctggcctgcccagggatagattctgaaggtagagccaatggaatttgctcagaaggggatgtgcagggggagggaaaggaagaatgaaggagcctgagccctgggggagccgtggtgccgttactgagatgggtaggctggaggtgaggaggacttgaggacaaattgagaactggtgtttggaggtgttgggtttgagaggccaccagacatccaagaagagtcattgagcaggcatttggacacacgagctggacacctgggagaggctgccacatcctcactcctgctaaatggcagaggcgactgtggtcaaggggtggggcaggatccaaagtgggcttttcttgtttttgtttttgtttttgtttttgtttttgagacggagtctcactctgtcgcccaggctggagtgcagtggcgcaatcttggctcactgcaagctctgcctcctgggttcatgccattgtcctgcctcagcctcccgagtagctgggactacaggcatccgccagcaagcccagctgatttcttgtatttttaatagagacagggtttcaccgtgttagtcaggatggtctcgatctcctgaccttgtgatctgcccacctcggcctcccaaagtactgggattacaggcgtgagccactgcgcccggccttttttttttttttttttttttttgagatgatgtcttgctcttgttgcccagactggagtgcaatggtgccatcttggctcactgcaacctccgcctcccaagttcaagtgattctcctccctcagcctcctgagtagctgggattacaggcgcctaccaacacgcctggctaacttttgtatttttagtagaggcggggtttcacgatgttggccaggctggtctgtaactcctgacctcaggctatccacccacctcggcctcccaaagtgctgggattacaggcatgagccaccgcacccagcctgcattttaaattttatattagtttgttattaccgaaacaacccatgtttgttccaaacaatatattagaaatactggctgggcgagtggcttacattgccagctctgggaggcagaggcgggaggatcacttgagcccaggagtttgagaccagcctgggcaacatagttcaaccccatctctacaaaaaatttaaaaattagccgggtgtggtgtcatgtgcctgtggtctcagctactcaggaggctgaggtaggaggatggcttgagctcaggaggtcaaggctacagtgagtcgtgatcatgctactgcactccagcctggttgacagagtgagaccctgtctcaaaaaaaaacaaaacaaaacaaaaaatagaaaatacagataagcagaaagcaaaacaaaagccaaatcacttaattttaccacccatagataagccttgctgactctgggtacgtgtgtaaaaaccatctctgtttcaaacattgggatcacattgccgttaaggttttataatctgctttcctttttttttaaattgtgaagtggaaattttatagatgtgtaattactgacatggcaagaaaagtgttaatgatggccaggcttggtggctcacgcctgtaatcccagcactttgggaggccgaggcaggtggatcacgaggtcaggagatcaagaccatcctggccaacatggtgcaaccccgtctctactaaaaatacaaaaattagctgggcacggtggcatgtgcctgtagccccagctactcgggaggctgaggcagcagaatcgcttgaacccgggaggcggaggttgcagtgagccgagatcacaccactgcacttcagcctggtaacaggatgagactccatctcaaaaaaaaaaaaaagcaaaaggaaaaagaaaagtgttaatgaaacattcaagaagaagtccccagagtggcccactgctgcctgagcttctgaggtcagctgagaaacgggactggagggtgtctgtcaaggccggggtaaagtcttaaaaagtcctggctgtggccattccccgaggagagggctgcatgagataacctcatgaaggacccttctggtcctaaaccctgcttcagctgcagtcccgatgcaggtacatgtggccgctgccttttttgtgattaattattgaacatgaggagctggtgctcttctcttctgttctcccgtaccccgtgtttttgctgactcagctctggtctggaactggccgaggaataagctcttctcgaactcattcactcataacactttaccgacatctgccacctaccttctcaaaccaggggtatttgctgggatacacttgccccccaaaaaggtcaggaacccctgtccaggaggtgtaagtgagccagggcagtgccacgccctttgcatgtcttccttccatagcccccacttcatagataacgagatggctcagagaaggcaggtgacagtctcaaaaccacacacacaagcaggactgggatccaaactcaggtctctctgaccccgagctgctgtccttaaggtcaccacgaaacatgaatataaataaagccacatagaaggtgacttgggccacacatagggaggcaagcatcgggagttggcagttctgaaggggggatagtggggtgcgggaatcagaggctccgtagagctttgtagcatttgtgttcctgtaggcgtggacgatgagcagagtctcgcaggcacagacatgaggtgttctgcgtagcatgcaccgtgccagcaacggtgcagaggtggggagactggggacatctgggaaggctggcgggtcagtacacagagatgtatttccagagaagcctgttccctccggagtctcctccagggtgtgtgcatgttcagcacacccccatcctaaagaggggtgctcctggaggccacctcattcgcctctgctgtgtctgcagcctgtgacctctcacctcgctctccttcacccatccacataccgcaaggccaccagtttctctcctcatgcccttggtcctcttcccatccactgggaggttgggaaccctggctctaatctcagctctgtcctgggcacactgggcgacaaagggtgagtccttcttcctcttcgggcctgtttcctcgtggtgcactgggggatgagggaagtattggatgtgctagggtctaaagttccttccatttctatgtctctggttctgggccactctgtagtttcatgctgtctgcagggaagttcctggcctcgatggcccagctccacactgcccaattcccctccctacatcctctccctgctgcatcattccttctctacctgtcctccatgatcctctttccttttctagctgtctcgttacttaattccacgaaggcaggggcagttgtcccaattctgcagatgaggccaggctcctgccactttggagtgcataagaaagaaggtccctccttcatccgctgaccttccctgagccctgggctgacctctggggcacttctcccaagacatcttaaaaccaagctggggccaaggccaccacttgtggatggctagacctggaggaaccctgagtcagtctatttccactgccagacctgctactcacagatgagtgactacctctctgagctgcagcctgcagcagggggcaattgagatagttgtgaggtccagtagcttggggcttgagggctgctgcctttggtgcccagcacagagctgtaactccagggaattccaattctgatttccacataattttctgaaaataatgttctcctctcttggctctgtaaccccctgccaggggcaccttggctgtcctgtccctccaacaatctaaccctctccctcatgttgtaattgcagatttttgctggtcttcagctgcctggtgctgtctgtgctgtccactatccaggagcaccaggaacttgccaacgagtgtctcctcatcttggtaagtgctgggagtccgggactgaggggggctgtgtgaggtagcacctctgggctgggagtccgggactgaggggggctgtgtgaggtagcacctctgggctgggagtccgggactgaagggggctgtgtgaggtagcacctctgggctgggagtccgggactgaggggggccgtgtgaggtggcacctctgggctgagggctgaaggtggaaagaggcttctcataccatggctcagagagcagcttgctgtgctgtgttccctcagctgtggctgcccctctctgggcatcatctccactttatagcaagtgttgggggacctcctgcctctatgcaagggcttatgatgggtccagaatagaagtgagtaggctccaccccttctcaggacaaaatctgcaaactccacgtgtggtggattttaggtcagtttttgcctaaacacaaaacaccaaatggaagcccctcagagggagacagctgacagccagcaaccccttttgtcaccaggtcagagttagggagtctgagacagctgggacagggagggcctgttgaggagcagaaaaatccgatcagttcatggggaccggaaggggaggacacactagggcttttagtcttcttgcaggaggcggagggggccacctgccctccggaatcgtcaagtccaggaaactccaggagaggggtccgaggaggccctggtccccctaacccagggactcttggctgggtccgcgctgtgacctgggccccagttctggagactgaggaccagaactcaggcccctggtcccacaggaattcgtgatgatcgtggttttcggcttggagtacatcgtccgggtctggtccgccggatgctgctgccgctaccgaggatggcagggtcgcttccgctttgccagaaagcccttctgtgtcatcggtaatgaggcgcgccccgcccgacctgacccctgaccccaggagccagggtgacgcctttactcccaatcccgactctgaccctggagacccgcacagattcagcggaccctccccctccctccccagtcccctgccacatccccagaagtccccgcctccgggtccgtgcgcggggtaggctggctgtgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaacccgcgcgcggagacccgagggcgtgtctggggcacgaccggagcgggcagggcggagagggcgaggtcagaggggctgtctccgtgctgggaaggggtgtggcctgcgggggttggagccctagcaggaggcgaggtctaagggggtggggcggagtggagtctgaattaggtaggggcgggcctaggagtccggaccggatcagggggcggggccggagaggcggggcttgagggtttcccctggatgcttctgggtttgaagggaccactcgtaccacaaagtgggcagctgaggtgggacttgagggtggggctggagcggggctagggtgggccccaggtggaagcctgaaagtgggacttgggggacggggcaaggtaggccgggtgctggagtcctgagcctggaacctggagactcaaggcaggcggggtgggggtgggggtgggaatgggggtcggggtagggggagtgctggcggtttcgcgaaggccggggcagggtcgccgtgatgggaggagctgagaaagaaaagcgagcctgggactccgggagatgggggacctttatccctttcccgtgtggaagccccccacatctcccaggcaggcacagcgctcctcaccgcgcccctccgcctgccccgcaggagctgatcaccgcctggtacatcgggttcctggtgctcatcttcgcctccttcctggtctacctggctgagaaggacgccaactccgacttctcctcctacgccgactcgctctggtgggggacggtgcgtgagggtctttgtagggctgcccttctccctgggatcctccctgggaacttcccgaggtctgcccatcgtgactcctgactcagggttgagcgggcctgcccctgccctctcactagagctgggacccccctgagaccagccccaatgctaaccccccaacctgctctggtggacctgcctctgtccccagctagccccgcacatcaagaccttgtgactatacccctttcccctgaccagcccaggagagggagaatccatctatgaccctaaccagcccccgtgggtgaccaggggccccttccctcatgatcaggctcctacctgcctgtacccccaacaagccgtaggtggcccccgtgaccagtcctgcctgtaacctgtttgtgtctccagattacattgacaaccatcggctatggtgacaagacaccgcacacatggctgggcagggtcctggctgctggcttcgccttactgggcatctctttctttgccctgcctgccgtgagttgcctcctgctcagttggtgggggaggctgagggtgggacctgctcacccctgtcacacatttgcctggggagcctggggtacctcagaggggcaaggatggggacacccttgcagcctcttactgccccaccactgccagcacattcccccaaccatgccctatccctctagggcatcctaggctccggctttgccctgaaggtccaggagcagcaccggcagaagcacttcgagaagcggaggatgccggcagccaacctcatccaggtacaagatgcccgggaagaagccctaggagcagggccgtgtgactgcactggtgtgtcaaccctgtgtgctgacccatgtccccagcccaactgtgacaccactttgaagctcaaaagggctatgtgactttcctggagccacatgccaagtcacacacagagccaggatgctcactgacagtgccagaaacttccccctgcaccaaatgcctggtttagggctagccagaactgccctattgcccaactccagcccaacttcacagggcctggggaggggcggagcccagacaggagctgggaggcctctggtggagacccactgctgcccccatcagctgtgcagcagtaagcctgccccacttccagcaccttcattcattcattcattccacaagcactcacacaaatgaagagaagatggtgcagacagggcttttaggaatctcaacatttagcaggtgggtgggcctgcaaagttgagctgggcaaggagacagaaggaacagccagaggggtgggtaggaagccaggagtgtgtggtctcagtttccctctgtgccatggcgtgttgtgactgtgtgtgggctgaggccagggctctgattttctgtgaccctgggactaggccttggctttttctagtcaggggtgtgtgtaagggaactccttgcaggaaatgcttcagggaatactggcccagtccacctctgcctgctccctagcctgtcaccctctgagccccaaacccaagcctcactcagcccttccttatctctcctccccagggtagaaccctcctccctgtcgctgttatctccagccaccagctcagccttttcttcttagcgtcccttggggcacaatggccactgtcccctgggagctggccttctgaggggcattgtaggggcaggcggctggcactgtccatgccaagagacagctagtattgtggtgcccataattaatgagacagctctggcagctgctccccagcccatgccaggggcctaggcaagcaggaagtaaaaatattcctgtcttaggagggtgcctggctggtgaggtcagcagtggcagccccttaaggacaagaggcatccaaagaagggaggcgtccagggcccagctctgccttgtcctgcctagcagcctccatgcctccctgctctcactgatggccacactcacagtccctccctggctcttcctacgtggagggagagggacagtctctcctcctgtctgactttcatccctcctgctgcagaggaagctcggcaagcccatggatgctgaggggttggtaggtaatgcttttcctcccctctcagtccttagtattcccatgggcagtgacaggcagctgggaaagatggagtggcattgctagtaataataatgacattctgcaaacatttgcaaagcacccacatgtgccagacactatatttgcactgagaatgcagcggtaacaaagacacagcttgcagtctagggggagagaaagttatcagtcaaatacacaatgaataggtattcatcaaatgtgataaggggaataacaggagtgtttaacagaggaacctggcatgaagtgcctactatataccaggcactgagcttggcatttaatatacaactgttcatttaatcctcacaacaccctggtaggcaagtagtgttacatgcgttttacaggtgaagaaactgaggtcctgaagctttacttaatttgtcctcactaataaggggcagagctgggattggaaacccatgtctgcctgacaacaaaactccagctcttaacctctatgctctatggcccctggctctgacattgatctgctttgtcccctcggggaagtcgtttctccctaggccttactttcttggctgcccctgtcagtggctgtggaattggaactggcctctggctctgggtaacccacaactggaccaaggactgggttctttcaggggagagggctggtggggactgagaggcctcactgatgccccatcccccacgtcccccataccaccaggctgcctggcgcctgtactccaccgatatgagccgggcctacctgacagccacctggtactactatgacagtatcctcccatccttcaggtaggtcctgctgggggtgggggtgggtggggggctggcagcaatgccctttgaggacaagtggctgagactcaaccctggagggtggaaagggggtgatggctcccaggggagcaccctgggctggctctgcagatcctatgtaattcagagcctggagtgtcctttattccactctgctatgcccagggaagaggtggatactggacatagggcattggtgaagccctgccccatggctgaaccccggccctggagtgctggcagtgtgcatgctcacccataggtgatgccatctagggcagtgatacagccagctcgtctcccctcagtcctgaatgggggacagagttagtggatattgcagctggttggagaaagtgtgggatgggcagaaacatgtgttccagacttaggtgcatgctcctaccctgaacccccatgtaggaatatgtgcccacttttactgggccagtcagcagcctcagggcccagaagtgggtctgccccactggcccgggccaggctaagactgcatgggggtggcaccaggagagggattattaatagcatcacaaaggtgcgtgtggccaggtgcctggctaggccctcaggcaggaatgaaaaccatggagcccagctcggtcccacgggcaggcgggcatcaagcttgtggctggggcaggatgctgtgctcagcgcttctgcgggtgccttttttgcctcattagttctccaggagaagctgttgcgcgattccactcgcctctgcacctggcttccccatccctgcgccctcccagccctaggggcttcccaggggagaagcaggagagaaggggccgggaagaggggctcccagcatcacactggtgcccccacatctctccacccggcagaggcaagctcctacctcagagtgggaaggtgactagattagaagagaggccttttgttcaaggctgggcattcgagagtggggcagggctgatttgtaagaaatacaatgtgtatgagggaagatctgggggtgggggtggtcagatggtctaggacctctgcccagaggaacagagcctagtctggagattctggatccactgggcatctgctaccctggaccttagtttgctcatcccatgcaatgggaaggcaggcaggagagagggaagataccctccttggctcatggcagcagaaaatggcctggagagttaggaagaagccacggtcccgaatctagtcttcaaaaacccagtggcaagagtgagtgctggaggggaaggaagctgggctagccaccctgtcacaccgccctcctcacctccatctccccttaaaatccagagtcagatctggagggaaaggatgtcagggccactgctggcctctctgaggaggcacggcacgttcaggcagtcagcttgatgggctgagagtaagctccttgcacggctgcccttgagctgtgccagccttcacatccatgcttggcatccctgggaactgggggtagaaagggagtggggaaggccagtctcccactgtccaccctgtcctattctggccgggctgtcagtgaacacctctagagcagcaggacctggcaagatctgagctcaggagctctgtgcccactgggtgaggggggtggtgccatggccctgcctgccactgatggtgccctctcctgcagagagctggccctcttgtttgagcacgtgcaacgggcccgcaatgggggcctacggcccctggaggtgcggcgggcgccggtacccgacggagcaccctcccgttacccgcccgttgccacctgccaccggccgggcagcacctccttctgccctggggaaaggtaggggccccgtggggctgccacctcctcttgcttctcctcctcttcttccattctctgtcctcatcctctctcagacctgccttcagccacttcgtgggtgtctgggcctgtttgggggactcctaggccgtcagagggccagacaggtacagactgagggcctctctggaggggtcaggctggactcacctttttgtcctgtggggctctgagggtctgagtgggagagatgtccatgccatcctttcccatcatctcctccgttcatggcattgtcctctttctttctctgttcccacgtcccccttactcctccatccctgcacccccatccctcccgggaagctggacagaggaggaggccactggccacaggtgcttacggctcaggtaatcgtgggcaccatcctggggtgtgagggcagggaaccccctcccccggcatgttgctctaggagggacttagtactgaactcgcctcttgggaacgagatgccagctggaaagagagctctgtgattaagacctctgtaggacctgcgtaaactcagccagtgactaatgttcctttcttgtgcagcccttgtctgcaactttgctaatcccagagggtcctcttggggttctgtttccttccttactgaggtacactttggcgctcccagccatctctttccccttgaactgtctctcctgaagctttttacaaaatcttgaaagaagaacaaagaacaaacaatgcttacccccacataaacgttcctaaagagaagaatttcaggcatgtttggataagggaagcccgtccactcacagcatgggaaagtggctgctcttgtagaggtttagctttgaggtcaggggttaaatccccctcattctttttccctcgtcctttacccatctctttgttttgtctcatcttcacacatcacccctgaaccagccaaatggacatctggcctttgagcttcaatgtcattctgagccccaggcccagaacaaagaataggagaagaggcgagccgcccagtgatcagcaggggaggcgtggtggaagctcgcctctgccacccgatgctgtgtgtcctggaggaagccttcagtcattctgaacctgtgtgtcctggcggaaaatcggcagtgtttaggctgattggggctctgggtactctagagtttctgggctgaaaaggcctagggaggagttttggtgcagaggatgcagggagcagcctcccttccttgttctcagtgagggcacttctgggccaggggctgaacaggaagtgggtggagagggagagtccctccaggtctggggctggagggaggggaagcgtgactgccaggccaggctgagagctccctgggagagtagggcccctctcagattctctgcccgaaggtccctcattgttaccttcatccctaccaaacatagtttccaggcggaaactcaagagtttttgtatcccagcaatcctgtccaggacctgagccagggctctctgtgcttccagttcactctggtctcattttgactgaataggaaggcaaggggaatggacattagcctggggcctagtacctgtacactccccacggctcctttggtccctgacacccccagggcccaggaacagattactactaagggcttggctgtcactgactcccagcctcgtatctatctgcctgggaggggacttggcgagtgtctgggacacagggtgatggtagtaaagtggccctttctcccagggaccccagggggctgagccatggtttgtagatcagtcaccaggctcaggcccaatggccatatcgttaatcgtggctgtctagaccgccagccaggacacccttcctccaccaaaaacacacacacatatacacactcggttggccacacctctggtggtgcttggggatggacctgggccaagtgtgcccacaggaagtggtgctaaaggagcaggatttcctgggggatggcattgccagggccagcacctctcctcttcagggttttgcaatgagtttatcaaaccatggtctccagacctcctgcatcagcatcccatggggtgtttgttcaaaatgcagatacctggacctgtctccaagcccacaggatcagaatctctggagaagagacacagccttctgcatatgtaacatggtccccaggggatccctatgcaaagtgtgagaacatctacgttctggtgatggggctggaggatgatttaggtgggggtccttctttcccaccagctaccggaggccggccccatcccagcagctccccacactctgcccacagcccctttcccgctaacctctgttcgtgtcttattctcaaacttccagccagatgtttaataataaacggagtttctttcggatccacgccagctggagaccgaggtaccccctcgcctgctcctcctgtccccactcctccttgccccacccaatttgggggctggagaggggacaggatgggccaaggacaaggtgcatgtgcctgccgcctgccgtctgccttgggtgcccagtgaacccctcgcctttctgggatgcctctgctaggtctggggcatgggcccagggtgccaggaggggcacgtgcaggagccttaaggatgtgtgctggctctgctgctgatgccctctgtgatcttggccaaattgcttcccttcttggacctcagttttccgtctgtggaatgggcagattgaactagaggacctctgagggtccttctcactctgacttttgccaggccttgggcttagctttctgtctccctgctacccacctggggacctagcagatgcctgaaggagctgggtttggcacctttgccagctccaggaccccagctcttttagcggcatctccatggcattccttggtacctgccctgtgccaggacttgctctgtgcactagggacacggtgatgaataaaacatcgtcctcggagagttgcaaagagtaattgcagctcagtgtgatgagtgcaacaaagggaggaagcacaggggctgtggagcccgggtcaggcacacaacccagaggaagccctaaaagcagtgggtttcagggagggcattccaggcagtgaagcagcacggacccaagcaaggaggcaagagggagcacagtgtggggaaaaaagctggcagcccagtttggcccccctgagactggacatcagagcgaaggttgggggcagagctgggtcatgcagaacctaaaagcccagtgtgagcttcaccctgttggcatgcttggcagcctgagctcatggagtcctgggtttccaaaggtgcctctggggccctgtgggctggggtcccggagctaggagatgagtggcagggctcctggctgcccatgtgtgcttctgctgagaggtgttttttcctagaaacgtgggttctggaccacaatctagctactacccactattcgtgtgtccttgggcaaatcacctgacccctttgcacctcagtttcctcagatgtaaaatgcagatgtaaatagggtctgcttccactaaaactggacctggctccaataaatattggccttatttgatttggtatgttcagcagttaagatcttatttaccttaaaagaaaatagcttagaaaccatggctgtgggcaatggtttgagctgaagcgttgagctaaggagtctctgggtcaggcccgccattttgcaagcctcctttggctgtggagggtgtggacaggaaggacacagccatggcagaggccagtggcgaggctgtttccatagtccctgaagaggggctgtatgtggcttcagaagtcgtaggctgcctctgttcccccagtgagagtggccctgggagggcagatcatgaggccctaaagaaagtccttgtggaagtgagttcaaggggttgggaccagcagggcagcctgggcagagctcggcctccccagcagggcagccacagtccagcccaccccatctttctcccaggtaccaacagatccttagccagagtttcttgaccttggcatcattgacattagataattctttgtggattgcgactatcacatgcatggtaggatgtggaacagcacccttggcctctacctactagatgtctacctactagacattgccacatgtcccctgagtgggggaacttgctccagttgagaaccactgctctacaccctatcctgattgcttgacccagaaaaagaacatagactctgaagtcagagaaggctgggttccagttcttgctccatctcataggagctctgtgaccttggccaaatcatctcacctctttccgtgtatataaaatagggatggtaaagaccgcccaccacacacagtggctgagagaactgaaagaactaaggcagcctgatgggaccctgcacgttctgggagcctgggaggggaaagagctttttggtgcccactgtgtgccaggttttcttccaccttcttttagctttcagacttagaggagctgatatgagccattttctgggccctgcccaaggaactggaatccagacccactcctgggaaaacagtgccttcttgcattaaaaaggagctcagggcctctggctggctggaaacttacagaaccccacaaaccagactggaagcttcctcaaccatcacagaatcagagctggaaagggacctttcaaggtctctagtgcaagccctcgaactccttcctccataagtcctgctgagtgcaagctcagccttgcttgcattacttcttttgacagggaggttgccctcttctccagaacgccattggagccttatgtggtgggcgcagtgatgtggagttccaggcccttggccaaagtgtcagggccttctccactctcctctcttcctctccctcttggaggagtggaggacaggagaaggggttgcacggaccgggcagggtggagggtgcttgccagcatgagggagcctgcaggaatggctctgcagaggaaagtttgggagagccaacctcaaactttgattggaatctttgggatgtgtcgatggagtcctgggccagtggagagcatgctggatagtgggaactgggaactgtccctgtccttttgataccctcagggcccccatccttgacctattaacctctcccctctgggcagaggccgccacccctaaggatggccctacatcctggccaccttcctgaaggtgcccctggtttcgaggtctccctcacttcagcaccttggctccctcccctccaccccatgccctgggcatgggagaccccagttcccacccaataccgaaaccagaatctcttctctgctcaacccttgatctgaaagcctctgagagtaggtgacacggtgtcctcccccaactcctgccccacttcaggtctcctctaaggctggctggtactctcttgatctggggccccagacatttggggtgggtccccctgaacccgaacctgaacctgtcggaatctctagtggcaaaccacagcaggggaggcagcgatgacgtcacagggcatgggatggaggacatttgcataggtcctaccccaacagccataacattgtccttgaacctcttggacacagagttactctaccagatcatggttaaccagggcttgtcctggggaatgaggcctctgctaacttgttttcctccaacgtttggggaacgtggtggggagttggatgcgggaagggaagtctgagtgcatgtgtagacgtgcacgtacacgttcacatgcacacagactgtgtaaatgctgttgaaccgggagctcagtaggcagtatgggggggtagatctttagcggggatccaagaccacacaggcaggatgtcaatcaaggtgggctgaacttaggtaggagagaccacagaagaacatgttatcaaatagagaccctcactgagagggcaggcaccaggcatggcctgggcatacatgtgggcccagcagctagaaccatggggccgaggccctcagtaggccatcacgctgcacgcctccagggcaccactgcatggaagtctgtgtgatggagtccttattttgcagtgcactgcctgcacagctgtacgaggccctaaaaccctgaccagtgtgggatcagatagccgcagcagtggggagtggaggaaaatatgaaatgacacatgtaaacacacgccaacatatgtacacacaccagtgcctgtacacccacactcgcacatgtgtgtgcacaaggtgtgtgtgcacatgcgggcgtgtgcacaggcctgagcgcgcacacgtcttctgtgtttgctgtgaggactggaggcctacctccgtgtgcatggccaggtgagcttccgaccctcagcagcctgtctgtgcccaaaggggtcgccacccccaccctctgcccactcacctgcgccaggcccagctcccacatcctcctgtctgtgtctctgactttggatttctcccactccttccactctgacatctgtctcctgtgcaccccttatctgtccgggtgatgaggggtgggatgtgggtggtggggagaggatctgcttcgactgaccccgaatcagcctcttgtaggagtgagggcctcccttaccacatccttgttccatcccaagaagtctccgcttggcggggaatccagacctaatagccacccccaagtcctaagtcagctttgtccccactcacccccacccccagctctggctaacttggctctctcccaacctgcctgccctgccagcagccggatgggcatcaaagaccgcatccgcatgggcagctcccagcggcggacgggtccttccaagcagcatctggcacctccaacaatgcccacctccccaagcagcgagcaggtgggtgaggccaccagccccaccaaggtgcaaaagagctggagcttcaatgaccgcacccgcttccgggcatctctgagactcaaaccccgcacctctgctgagggtaagcccccggggggctgagtccgatcgagggccggctgagggtggcagggcggggacagtctgggctgggagcagaaagatctggctcgcgtctcagctctggaactgatggaccgtctttgggctctggtcttctcatctgtaaaatgggcattataatatttgctctgctatacaatggacatcagactgtttgggaatcacgtggagggtggcatttcataggggttagcagcacaggctttggagcgagactgcctggatttgcatcctggctttgtcacttatcttaggcgagtgacctaatttctctgggcctcattctcctcattcataaaatgggaacaataatagcatccacttcctaggattattgtgaggattaaatgagataatccatggaaggtgaacagaagacttttgggaatatagtaggtgctcaacaaatagctaaacacaaatgtactttggaagcggcaggaatgcatccttgatgagccctgactatgcactgcccagcactggcttatctcatttacttctcccagtgaccctggaaagtaggttctgtttttgtccccactttacagacgtgggcactgagatctctcagcttgtgagtggcagaggtgctctcctcaagcaggtctattcagctccaaagcccaggccttctgcctacccctcttcacccagcccaggctgcaagtatgagactgtggaccatgctgatgtcacttttctgagttttggctctgctggagacttccactgtgatttaggcaggagactgcccctttccatgcctcagtgtcctcttcaggaaaatgagagggttggaccaagccccctggaagacttctcccagctttgacatactttaggcccctgggtggggagaggtggggtgagtgcacaaggatgggggatggggacagctccccctttggccttggagggaggggacccagccatgctgtttctgcctgtgctgtgtcagccctcaagatgctgctggctgacacctcagagtttacagaaccccatagaccagtctttgagaggtgctgcccatagaagcctgggcacagctggtgcccaggacctcccttccctgtcctggaagctgtccgggctcttgccactgctcctgtgaggcaaggacagcatcacctctctgcgcaacacagggcactagcctcagagaagcttctctcattcagggaagaatggtttgttttaagggccttccctagtagcagagctgggcctgggagccagccacttgggtgtccttccatcttagctgaaggagaagactgtgtgcatgattacatgcagtgccatcaaaccccttatctctggggctcactgttctgcaaggtggaaccagtggggcttcctccagggctttgtgcaacaaacttgccctggactaggccagctgtgccctaaagcagctcccacctacccaccaggcagatgtttaccctgactggccaccggggcagatgggcatgcaacacactggggctttccaccctggggagggcagtgagacacaggagcccccaagaaggttctgagccctttctgggcctctgtcttcctattggacactctactggtggtttggcatacaagggtcggatgggaggttgggagtggccccttcggtgggccacttgccccatacctgccttttcagatgccccctcagaggaagtagcagaggagaagagctaccagtgtgagctcacggtggacgacatcatgcctgctgtgaagacagtcatccgctccatcaggtaagactgaggcctgaggcgagcacccccctccgtgtgccacccactgctgctccccatctgggcgggtggatcacttgaggtcaggagtttgagaccagcctggccaacatggtgaaaccccgtctctactaaaaatacaaaaaattagccagacgtggtggtggatgcctgtaatcccagctacttgggaggctgaggcaggagaatcacttgaacctgggaggcagaggttgcattaagccaagatagtgccattgcactccagcctgagcaacaagagtgaaactgtataaaaaaaaaaaatgtattttttatggtgggtcttggtcaaaaaagtttgaaagcccctgctctactggctgtctccatgcctcaaaaattaagcagggaccagggtctcctaggccacggcctaggcatggatctggcctccaagctccttggtgtgccgtcctggcctagtctccatctccagcctgcagctctagctccagaaaccccctcaacctccaagttttctgggctccccactttcttccctggctgatacacctgcccacaagcctcttttcttgtattccttttaaaattagagtcaggctgggcgtggtggctcatgcctgtaatcccaccactttgggaggctgaggcaagagaatcacttgaggtcagaagttcgagaccagcctgggcagcatagtgaaatcttgtctttgcaaaaaaaaaaaaaaaaaattaaaaaattagccaggcatgttggtgtgcccctgtagttccagctacttgggaggccaaggtggaaggatggcttgagtgcaggagtttgaggctgtagtgagccgtgattgagctactgcactccagcctgggtgacagagtgacaccttgtctctaaatagataaatagataaaatcagagtcagctggacctgtccccactaccccccacagtctgaagcctctgcttacccccttttcacccatccattctctcccctccatgtgcccagtgtcaaggacatagtacctgacctgccacctgacccaagccagctctcctgggccaccccaccgacctctcagccagcatgccccaaacctgctcctcttcctgggctggttcccatttcaggcagtggcaccaccatccacttggtcacccaagccatgggagtcatcctggactcagaccagggagactttcagccccacctcctgaactgctccaagctcttccatatctcctcccccatcccctaaagctagtttccctgcccacgcctctgcccctccagggtattctccacacaggctggcagagctggcatgctaaagcagagtaactgagccgggaacagtgggtcacacctgtagtcccagcactttgggaggctgagacgggcagatcgcttgagtccaggagttcgagaccagcctgggcagcatagtgagacccccatctctttaaaaaataaaaattaaaaaaaaaaaaaacagagttattgatgtgcctgccccacaatgtcccattgcccagtctctgccagagatgcagggctcttcaaagcacaccccagcctccttctcgaggctgatctcctgtcttctcataccatggcaccctgaaccccatcctccaccccggctggttgattaacccctttccatctcatccctgtttctgctacttggaggtaggggaggctgggagacgcagcagaggctgttcatggtggccaagcaggaggtgccctggtgctggacaaggggatagcaaagagatggagagggtgctgggaaagaatccctgctctaacaggacactccctctgagccccctcccccaacaggattctcaagttcctggtggccaaaaggaaattcaaggagacactgcgaccgtacgacgtgaaggacgtcattgagcagtactcagcaggccacctggacatgctgggccggatcaagagcctgcaaactcggtgggtgcaccgggcctgttgggaggcaggggcagggaggcagcgaccccagccctgaatgaagtctgaggccaacccccgagcacccccaagggctcactgctgcagctgagtttctagactgaggaggtccctggcttgcagtgccagcctgaggccagacccagcacccgtcccaaggctgagaaacaacccaaccatagtttctctgtgaggtgggtcctctgtgcaagccctattgactcatatgccttgggggctttgtttagaatgactgtttcctggtcctaaaataatcagcctaaaataatcactgacctcccatctcccaagagaataggcaaattgtcctcactgcccacctcttgcctctggaatcctcccacatctctctggtagacccagcattaggaagaatcctcaccccaagacccacatcacctgcaccttgcccttctcctcttctggcctgcattttcactgtccactcattcatttaatcactcgagaaatagtcagtgggcatttactacttgccagcctgtggggatatggcagaaagcgcagcagagttcccacacttatggagctttcattctagtggaaggagaataagtgataaataagtaaaactggaatatgtcagacaacgataaatactaaggaggaaaataagggtcaggctgttagggtttgcaattttaaataggtgagaaggttctagagggaacagcaagtgccaaggacttgagaggggcaagtggctggagtgttggcttcagcacagcagggagcctggtgtggctgcactggagtgagaggtaggaggtgaggtcagagggctaacggcactcagagagtgtaaagtcctgtaggcccctgcaaagacgttggtgttcatccaggatgagctgcaagcattggagggttttgtgcaaacgactgacaagatctgaattgtcttttaaaaggatcaccctgggtgctgtgttgaggatggacttagcggagtgagggtggacacaggtagaccaatgagaacctgcttcagacttccacgcatgagaccgtggggacttggaacagagtggcagctgcagaggtgggacaagtggtcagattctagatacattttgtaggcaaagttgacagggttttctgatggggtgttaagagaaagaagagagtcaaggatgaagctaaggtttttggcttcagcaagaggaaaaatcgagttgccatttgttgacatggagaaggcaatgaatggagcaagtttcggtcaggagatttgggaggtgccgggtttgtgatgcctatctgacattcaagtggagtgttgatctggcagttgaatagagaagtgtggagtgcagagcagaagtacaggatggagatgaagatttggtgtcgaaagtgtagaggaattgaaaattatggatctgaagacatcaactagtgagtggagtaaatagagaatagaggtcccaagagtgagccttggatcctgcagtgtttccaggttgcagagatagaggaggaactaacaaaggagactgtaaaggagaggtcagggaagtaggaaaagaactgggagagggtggtgtttcaaatgaagaaagggtttgctggaagaaggggtgatcagatgtgttgagtgctgctagtaagtcaagtaaaatgaggacaggagttgatcaatggatttagcaacatggggttatttgggagcttgacaacagtagttttggtgaaatggcaggggtgaaagcctgactggagtaggtttaagagagaaggggaggaaaggaattggaggtagaggatagagataacactttcaagaattttgctgcaaaggagagcagaaaaataaggtgaggtcagttctagccttgtccacccaccttaaaagtcacattcccacgtgtctccactcctcccatcctctttccccttttccccaatccatcttttcttttcttttctttttttttttttttgagacagtatcttgctctgtcgcccaggctggagtgcagtggtgcaatcacagcgcactgcagcctcgacctctccggctcaagtgatcttcctgcctcagcctcctaagtagctgggaccacaggcatgagctaccatgtccagctaatttttaaaaaattatttttgtagagaggagggcttgctatgttgccaagtctgtctcgaattcctgggctcaagtgatacctccctacctagcctccccaaatgctgggattataggcatgcgccactgcgctgggcctcctagtccactatttccattcctctttcaccagacggttgttttacttgtcaggttcgtgtgtggtgcctttgcttggccagtggagaaccaccagagcaggggccagtccctccaccctcaactcagcctccatctggcagggcaatggccccttccctcagattgcctgtcccctcgtggtgccttctccttcatcaggcaacctataattcttgtggaagggagggacggcgtgtccccgggccctctgatggttcccttacccttagggtggaccaaattgtgggtcgggggcccggggacaggaaggcccgggagaagggcgacaaggggccctccgacgcggaggtggtggatgaaatcagcatgatgggacgcgtggtcaaggtggagaagcaggtgagtgtaggatggggtggcggagctggccataccaagaagctctgggggccgcggtgacatggggaggatgcgtttcccacagccacagcccaagggtccccgagaagacctaagagccccctccccggccgaagcccccgccctcgccgccagacattcccataaacccgccctctcctgctaagccccgcccccaggctgcataagcccgcccataaccttcagataagcctacctcagttccccctactccatttgaccccgcctctcagttgtcgctgtagctcgcggactatccccatcggtcacacctaaccaccccccgggttatgcaccagtgcccagcttcgcccctcgctctagccaagctccacctttccaggcgggatttgtgcttcccagataagccccgcccactccaccggctagggtccgccccgagacccaagccccgcccccggccgcgtcccctccggtcccaggccctgcttcccagctgcgccccgtccccaggtgcagtccatcgagcacaagctggacctgctgttgggcttctattcgcgctgcctgcgctctggcacctcggccagcctgggcgccgtgcaagtgccgctgttcgaccccgacatcacctccgactaccacagccctgtggaccacgaggacatctccgtctccgcacagacgctcagcatctcccgctcggtcagcaccaacatggactgagggacttctcagaggcagggcagcacacggccagccccgcggcctggcgctccgactgccctctgaggcctccggactcctctcgtacttgaactcactccctcacggggagagagaccacacgcagtattgagctgcctgagtgggcgtggtacctgctgtgggtgccagcgccccttccccacctcaggagcgtgagatgccaggtcgcacagagggcagcagcagcggccgtcccgcggcctctgggccccccagtgccctgcccactccatcaaggccctatgtggcccacctggcaggggcacagccccgggagtgggagcgggcgctggggccctgggccctgacccagcttccagctatgcaaggtgaggtctctggcccacccttcggacacagcagggaagccctcccgccaagtccccgccccacttgggggtgggccaaggtgcccccacaggtacccacaaagcacaggaccctgccacaaggcaggtggacaccatatatgcaaaccatgttaaatatgcaactttggggacccccatggggtctctctgtccctcccccattgggagctgggcccccagcagtagctggtctcaggctgcttggccaccaccctgtccctattctttggcttatcactccttcccctcccagcatggggcctgtttctcccctgccctctcctaagggcaatgcctgggcctttcttcccatttgcaagtgtcagctcccaggggctccctcctcctgctgggtggccactcccctccttggccctccagacaccactcatagtcagcacaggtttctgtatcctccccaaaactcccagacagtgcttcgtggacgatcgcacaaacatagccttttagtttctccagacaggaagaaagcctctcacacttaaacatgcaatgacgtgacacacttggagacatgagtgcagagccactcagccgctcctgggcctctgcagcagatgccagtggactggccttgcagggtgacgtccactaagaggaagacccccaactccatctgagcaggagaaggagctttgaagtaacccgagagctctccaggccccacccagacctttacccgctccccttcttcaagaagatctcctcctctctggtccaggagccctaacccactgcctctgcctgtccccaagggcccgcctccgtgtctccacagcacaactcgggcccaggcctgacaccactggagagaccccaggcccacttctagccaggcctgtgccttcctagtcactctaactcccagagagaataagaatgcatgtaatagctataccaaccgcgcatccggctttcacatgcactgtctcccctccctccacaccccacttcttcacttcaattggcagcgccacatccaggcgtcagcccccattcactccaggaacactttcttatccccacccctttgctcctcttctgcaaagccaatgcaggtggcaggaaggtgaggggtagtggaccaatggcaaccctctgtgggaacaaggggccgaggccacgctgcctgcatctcgtgctggggacctgcatgcgccagcaccagggcttggactggatcttactcagtccatggtgcccagcctctgccccaacatgccctctgcatgtgaccgtcatgccctggatggagccactcctggctcaccccacctgcactgcactgtccccagagagccacccctccacccactcagagacagctgtggagagggccaggagaatgggattaccctatgaccaaggagacatgggaagaagccctccttccttccacgatcgaggttccgccatcaactcggttctcggatatgcaagtacctcactttgttaacttattaacttattggtttcattaaagttttcaagaggaggtgattgttcttggttttgttcagtggctgtgaggtgaggctcctggtttgggggtggggacaaggagatttggattggtcgggactctttgttgtatacaacaaaaacccaaccctgtatggtttaaacagacaaacaaaaagaaacttattggcacagagaactgagaagtccaggggatagatttggtttcatgcacagtgagatctagatgcttaaacgtgtcaggactct

SEQ ID NO: 13566 - DNA, 36899 bp, Human
  misc_feature (1)...(36899): n = A,T,C or G
tggggtctcactatattgcctaggctggtcttgaactcctggactcaagaaatcctcccaccctgtgtcagcctcccaaagtgtcaggatcacaagtgtgagccactatgcctggcattccaaacattttttagatttggagctgaatgcagcatgggcaggttgtcagggttgaagcactggtgatccagatctggaaggagccagaagcctctaaaagaggccactgcaggagcctcctgacctggtttctgggaatccatctgcttcaatgattttcctaaaacacaaatctgatcccatcacatctttttttttaaaactccttcagtgaagatagttaagaacttgtggcagactgcttctagagaacaaaacaggaacactggggtacagaaataagagatttacttttcatggatacccttgtgtagtgtttggggaaaaattataaccatgtacatatattcactattcaaaggaaggtcaaaagcctctcaaaagtttctacagctttccactatccctaggagaaagaaaagcctttacttggtctataatgctcttcaccgtatggccctacccaactcttcaacctaatctcatgttaatctcgcttcctgtggcccttgtggacttggctagactggccttccaattcagctgtgccggcctctttgggcttgtacacaggcttttccttctgcctcacttttaaaaaaaaattattattactatttttattttatttatttattctttgagaaggagtctcgctctgtcgcccaggctggaatgcagtggtgcaatcttggctcactgcaacctccacctcccaggttcaagctattctcctgcctcagcctcctgagtagctgggactacaggcacccaccaccacgcccagctaatttttgtatttttagtagagacggggtttcaccatattggcgaggctggtcttgaactcctgaccttgtgatccgcctgcctcggcctcccaaaatgttgggattacaggtgtgagccactgcgcccggcctactattattatttttataagaaacggggtctcgctatgttacccaagttggtctcgaactgttgggctcaagcatgtctcactttcttatccccgcctctccctttcccatctttgccgtctacttaggtctctgcttcaaagttactttttcagggcgggcttcccgcctgaattcccaatcaccaccggacttgggtcagtccccgcgctgggcactcactgccccggcaccagcatctctgcagcaagcacccataacaaccataaagtgtaatgagctgctcagtgtgcctccctacatcgttagtccgaggagagggtccctcggtgcccagcacagtgcgtggcacagtcggtgctcagggagcgatagctagatgaaaccgtacttttcgggatcctagtccatccaaagcagccgccttcggggcaggtgtggggaggagggaggccgacgaggagccaacgccgcgcgaccctccgcacttccgtcttggaggccagggtggcgctgccgccgtccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattcccctaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagcctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaactgtaaagtgagagacttagggtcagataagcttggagacaccgcatactgtatagcagtgatcacagtgcgagtttacttgctaaacactcccaggattcttgcgttaaatgacttggtttaatcagcgtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctggggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttttttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgagccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagcttagagctggttttattaggttgactctgaaggttattagaagtcaaagctttaaacaaaagctgtgttattagagtagcagttgtttttctacacgtatttgactaaagccattcagtgatccaagaaatgtttgttttgatcctatttaaacctgacgagaaccttctgaagtcctgtgacagagaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccgactgccttttacttctttgttgttattgagaacctgtcaatggtgtgacatacaactgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcaacaggaaaagatccatatacctgagtgatatttaatacagaattcttgagcagaggatgagttacctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattacgtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaaggtaatactggatttacctttaaagcttaaaagtcttaaccagtttaatttcttctccctcccacctctacacagatgtgtaattcccttttgagtacagaagtttacattgtatgtgatttcagcatgaaactctcaaggtattgttactgaaatatgccttcagttgaaaaatcagaattatattgttgtttgctaaaaaaaataatttgaagaactacttcttcgttgaagcttgtcaattctgccaaggcagcatgatacgagtccagagagctgttgtttttacacagtaatgagtgtgaaagtggtaaaggcaactcgattagggcattaagccagatggcatgtatgtgtgcatctgggacttactatgtatagaagtgagaaggaaatgaacatctattgtgtatactggtttccaggccgttcatcagtgccatatggcctaggaggagcctgagaagtgggtttctgggtcctcccaagctttcactggcacagcttcgcttacatctatttgctgttttggggttttgtacaaacattcatttaaggaaaatgttttgctgctttaaaaaggtggggatggaaaactactgatctagtataatggcagtggcccaaatttggagaggttgctgaaaagtggctttaatctgagttatgagagcagatctgcttttggctttagactttactggcctgaaagctgagggtcacactgacagctggctctggtctggggctgccctggcaagattctgggctaattgggtcatgtttggatcttagcttcccctctcaccagctttgtgaacatgggcaaattaacctcttcaaaatgtggattccttttctgtaaaatggagacaataacaacacctacctctctaggttgttaggaagattaaagaaactaaaagtcagtgaagtgtttccctgacttcctgacacatagaaaggaatcagttaggaattagaatggttttgatcttacagtttgctgtttatttattcatcatccatcaaatttgcattgaatgctcactgcagtcagaccctcactggtgctggtgatgcatgtgatgagcaagaccagagaagtcattgcccacatggaggttacctgtgggggaggcaaacaacaaacatgaaacaaaacgagacgtctgtcagaagctgtgaagaaaccaagtggagtgaggacagagtgactggggaaagccactttgggcaggtggtcggggagtctcccaagagaggccatttgagctgagaggccagtcacagcgagagtggaatgagaagtgcggaggcgcagggctacgaaggcgtggttggtccgggaatggaggggaggccggcatagctaaggcagagtgactgagggagatggtcagagagcgggggtggtagccacagccaggttctacccagtcgctgggccgcagcaagaagctaggagtgtactcggaggagtgggaagccaccgaaaagttgaagtgtgggagtgatgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagtaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctggcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccaggtaagtaagacattgaaagttttactttgggggagatggagaggagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctggggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatttaagcaggcctccatacacttggagaaagcatctgataggtaagagaccaaacaacagaaagaaagaaacttacagggaactgaggcgctacaagcagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattgttgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcatgtgtaactttgacaaacataaaagctaaattacacaagtgaccaaatgatctatttccttattaaaagaggttcaaggaaaagtcatacttgaaaattccttatcagagggaaactaactttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtactcgctgtgtcgcccaggctggagtgcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagcaatctcagctcagtggaacctccacctgctgggttcaagtgattctcctgcctcagcctcccgaatagctgggattataggcacctgccacgatgccgagctaatttttgtatttttagtagaaatggtgttttgccatgcgggccaagttggtctggaactcctgtacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctagtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctcttttttttttttttttttttttgagatggagtcttgatctgttgctcagactgtagtgcagtggcatgatcttggctcactgccatctctgtctcccgtgttcaagcgattctcctgcctcagcctcctgagtagctggggctacaggcatgcaccaccacacctggctaatttttgtatttttagtagagacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaagggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaataattccaatatgcagctgagtttgagaaccactgttcctagttaagccattcataggttcgtggacatgatttttttaaagctacatttgtgatttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaaggtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctgagctggtggaatggtggggcatggccctgcttgtctgtgggtggcagtagagtgtcatggttaagagcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctactttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccagctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggagtttaatgattttgaaggaaactgttgtattttaaaacctcatatttaaaaaatgtttaagttattaaatatattaagatgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcactgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgttatttataatagtaaaacattagcaagaatttctggttcactagaacagttgaatattacggaggtgtacaccttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcataacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattaattcatgggatccccagccatagtcctgggagaactgctgggttggagcactggttggcttaaccgtatccaaagattttccaggctggcgtaccttgcgttagatttcatgccgagggcatgtggcattctcagcccgctgtactgttaggcacatggaggagggacgatgcctttaatcacctttgaattcccagcccagggtgacagggatgtaaagggaagggcacttatttacgtttttcagcagtcagcaaatgtgaatgcgtactatatgctgggactgcccttgtcactgaggacaccgtgctaaatgagacggacaaagttcttgatctcacggcacttagacagcatcactgtgtttgttgacctgaaattgaactttgctgatactaaggcctcaggagtggaccagcaaatgttttgcagcatggggctttggggtcaggaggaacagggcacagagagcctggaatcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtctggactctagaaacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacagtgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggcactggacgtgggtaccccatatacacagccagtgagcagtgggccagactgtcttcaccagcagaactgcttgttatggtactttgaacgtggctgattgagcataattctaacctcttctcccacctggtggtaccaggagattgtcttcattttaaattttatttatttatttatttatttttttgagtcagggtctcactctgttgcccaggctggagtgcagtggcacaagcacggcttgctgcagacctcctgggctcataagatcctcccacctcagccttccaagtagctgggactacaggttcacatcaccacgcccagctaattaaattttttttttttttaatagacagggtctcgctgtgttggccaggctggtcttgaacgcctggcctcaggcgatcctcccatagtgcagggattataggcatgagccattgcacctggtcaatagtcttttttttgagatggagtctcacactgttgcctgggctggagtacagtggcgtgatcttggctcactgccacctccacctcgcaggttcaagtgattctgtttgcctcaccttcccaagtagctgggattacaggtgcctgccaccacgcccatctaattgttttgtatttttagtagagatggggtttcactatgttggctaggctggccgtgatctgctcatctcagcgtcccaaagtgctgggattacaggcgtgagccaccacgtctggcccgttttttttcaaacattccccaaactgagggtctgacacgcccgttgttgacatcatggtcccccacaatggctgggtgtgtgggtggtgtgaaaaagcctcccagtaattaagttcctgcccctatgtttaagatcactttggctgatcacttgtcaagtgctggccacataatgtaaggtttctgaaaaaagagatcccagatggctctccagagcttgcaaagctcgagcagccccgccacgctggctgtggcagacaggatagggctgaagctggatttacaggagggcaacctgtgcccagtgtttactgacccgtccccggaggcttctccctcatggggaggaaagctggtcacattcctcgttcctttcttaatgtgacctaacaataggcacagctatgtgtaacttcccttcagtaacttccttcagtccagggaacttcccttcagtccaggggatctgggcagttcttagcagtctggagcagctgggctgaagcctgacttcacccttcctttgtagaaatctgctcttttcccccgaaaaacatttccgaggattgtggtgcctggactagcatttagcatggtacctggaccgtggaaggtgctcagaaatgccactcctccttcttgagtaacacatttgtgtagttttcaaacagtcttggtgaccttggggcagctcggggggtgagcagcaggagtttggtaacctgccaccatataggtgtctgtgatcacattggtccctaaccagcatgaatggcagccgaggcaggggttgtgtgctctttgctaagtgggaaaaccaggtctcagagcagttgtgatcacccagaaaatgtcacctggctggtgagtggaggggctgggggttccaaagttctcatctgtgtctgctgtg

SEQ ID NO: 13567 - DNA, 21526 bp, Human
caggcgtggtggcaggtacctgtagtcccagctacttgggaggatgaggaaggagaattgcttgaacccaggaggtggaggttgcagtgagtcaagatcatgccactgcacttcagcctgggtgacagagtgagactctgtctcaaaaaaacaaaagcaaatcatgttttgttgagtttgtttagctgtgtattcacaagttgattggcatctctcagcccatcccaaccccaccccggaatgctcttcccaggcttcctaacaggtattctcctttacctggattgcatttgtagaaaacactctgcttcagtgggaggcaaggaacagaatatttctctgtctagggcatactcttccatgttatctgattccaattctatgggacctattttaccattctgaaagctacagataaccgatagaaatgaaaaataattcttgtctatggatatgcaaatgcttatattttgaagagagacaacccttcctcacttccccccaaatcccctagtttgcttccattttacacattcatttcaatatttctcttctcttccttcttttctttttttttaggttatctccctctgtgccaggccagagtgcagtggtgcaatcacggctcactgtagtctcaacctcctgggctcaagagatcctcccacttcagcctcccaagcagctaagactacaggcacgtgtcatcatatctggcaaattaaaaaaaaattatagagatgggctctccctgtgtttccctggttggtctcaaactcctgggctcaagtgatcctcccatcttggcctcccaacttgctgggattacaggcatttgccactgtgcccagcccatttcaatatttctgatcaataaatgtgcctgtccttcagattctcctttgaattggctgtcacacctcttcagtttcttcactgaggagttaaacataatcttgagcagcacgtgatattgtttagctctgtgtccccaccaaatctcatcttgaatcgtaatccccctgtgtgtcaagggatggacctggtaggggatgattggatcatggggggtggttttccccatggtgttcccatatagtgaatgagttctcacgagatctgatggtttaaaagtgtttggcagttcccccttctctctctctctctctctctctgtgtgtgtttttctctctctcgccactttgtgaaaaatgtgctcgcttttccttcgctttctgccatgattgtgagtgtcctgaggtctccccagcgatgtggaactgtgagttaattaaacctctttcctttataaattacccagtttcaggtagttctttatagcagtgtgcaaatgggctgttacagcacatattcatttttatatctatattgagttatcatttaacctgtttttgaaaattatcttttaacatgcatttttctctttcttattatcttcttttgctaaaacctgttctccagtagcttcctaagaaagggtgcacaggagacccattttttgagcccctccttatctgacaatgtttttgtttgaccctaacctttgattaataatgcgactggatgttgaacttgtgaaaggaaaataaaaactcaggaccccaattcagtatgccaaaaggaaaaaaaaaaaagaagctgaaagctgagtcatgcaagaaactgccttttcttttgctcctaagtagatggctacagataaaagattaaatatctccacaggtagctactccatgttcaccttatcttatgtaaagtgctgatttactgagcaggagacagatatgtaactgactattccctagctgctcttctcctcttgcaatgtgtggattaccatacccttcctctatcccctccagagatgaatttttccatgtctgtttcccccatttaaatattgaagccctcactatcatctttggagaaagggacagatcatagacttgtttctgtgattctgtgtccttttcttccaggcatgtccttaaccttggcaaaataaacttctaaatggattgagacctgtctcagatattttttggttcacaaactctagggtgggaaatatttcccctcagaactttgaaggcattgccccctcatcttctagcactcaacatggccattgagatttgatggcattttaaattccaacatgtttattaatgagaccagttttttctcactagaagttacacataaaatacttaaaatagttcctggaatttaatgaactgaattaatgttagctattactatcattgaactattttttttctctgacattctttaatattttaatttttttttctaaaagacagggtctcactcttttgccctggctggagtgcagtggtgcaatcctagctcactgcagcctcgaattcctgggcctaagtgatcctcctatctcagcctcctgagtatctggggcaacaggcatgtgcaactatggctggctaatttttaaattttttgtagagatgtgatctcgctatattgcccaggctggtctcaaattcctggcctcaagcaatctttctagattataggacttcttggcttccacaattgcatgagccaatcctttataataaatgtatatccatctgtatatgtcttgtgtctgtctctctacctatcaatctatccatccatccatccatccatccatccatccatccatccatctatccatccatctatctattttattgtttctgtttttctggagaaccctgactaatacagaaggtgagcccaacttctcactgaggattctcaagcctcagcctcttgaagtgctgagattacaggcatgagccaccgcattcagcctctgattgtcattgacagtgatgtgctctactgtgagtctcttttacccactgtgctgggtattcactggccctttcaacttggaaacgcgtgtcctttggctttgcaaaaatatctgtagcattgattgcctgatttctctccctctgatcagggcctctgcagcatccgactccagggcactgttcaccccatattctatgaatggcgtcctctggagttgtgctgttgcacctgcaccttttatttatttattttggaacacattggagtaagatgccagactgccttgatcctctaattatcttatctctttcttcttattttctatctttttgtcttttcattctactttcctcagctcttggttgaagaatttttcattctgcttatgccttaaaaatatctaagagcttttttttgttccctttttttaaaagcgttccattgttgtttgatgtgtgggctctcctgttttctttctgagcatattatatctaatttttgaaggttgtattttctcccttgttttaattttctgcagatacttttttcttttttactttccccaatttgtttgtttctgactttcttcctcaatctctcctgaaccattgtttctttttaagatcagagcagattcttaggaacttttaaaactgtatgtgggtgggattgtcacctagagtgcttttttggagagtaattggatggtgtgataattaattttatgtgtcaatttgacagggtcttggggtgtccagttatttggttaaacattatttctgggtgtgcctaagagggtgtttcctgatgagattagcatttgaatggatggactgaataaagcaagctgccctcctcaatgtgggcgggcaccatacccttgaaggcttgaatagaacagaaaggcaggagaatttctctcttggcctgaacacttgagctggaacgttggtcttctcttctctgtggactgggacttacaccatcggctctcctgagtctccagcttaaagacggcagatcatgggacttcttggcctccacaattacatgagccaattctttataacaaatctatatccatcagtctatgtcttctgtctatctacctatcagtctatcaaccagtccagccatccatctgtcatctatctatcttactggttctgtttttctggagaaccctgactagcaaagatgatgagcccaacttcttgttggggatccccagatatcagcgggcagagtgtctccttttggcaccttcagtttctccagaaatgaacctttccatttccatcctaagggattgcaagagctgtggacttgccaggagggaagggagcagaggcccccacagttcacaatgtaatgtttcccttaaacacagcccccactttcagctgggaacccaccctttccttgccggtgctttgtgtcctcaagactggacataaggtgttgaggtgtggtgtgtggtttcaccacacaatcatttggggtctcctgagagaggtggggggaggggtgtggtctgcttgagcaggtgagggaaatggattggggtgctagctggtaactgtatactgactttcttttgtagaggcagggtctcattctgttgcccaagttggagcgtagagtcatgataacagctcagtgcagcctcgaactcctaggctcaagcaatctacctgcctcagcctcctaagtggctgggaccacaggcatacaccaccatgcccagctaatttattttttgtagagatggggtctcctatgttgaccaggttggtcttgaactcctgggctcatgtgatcctcctgcctcagcctcccaaagtgttgggattgcaggcgtgagccacggtgcccagccagtatactgactttcagtcaacctcatgctttcagtgccagttcttcttggtgcctgatgattgcaaacccaggatttattggagagtctctgttcttgatgcccaccctgcccctccactttcccacacccccttcacctttaccatacactgtcctcaactcttctgaggctgctcccaagtgttgggtgctttgatcctgtctgccattgcctgagctcctgttctctccatccctgtgggtcaacagcttttatttagttcattcccttactatcattttcatagagttgaggaggtagggaggagatagaggcaggaagttattctaccacatttgtccagagtctgccctgtttgggggcatcagtgggcagagctggaaagccatggtggctgctgagatttggaagtacaagaccaggaggaaggaaggaggatgcttaggtatggggctcaggtgtggggttcaggtagcccgtgcatggtgaggaaagggaacaaatgagaagagtgtggtagatggtggtgtgttctatctattttgatggtgggtcaaaagagggaggtgaggaatgggttgagaggatttggccccactttgaatgcagggcgaggggaaaccagcatctcagatgtgcctcagtttgtgcagggctaagtgggacccagagcaggaggggcagacttggacgggaggccagtgactctggagtttgcagtgaatatgcagggtcctgggtgtgatgcttgggttgtttatctggcctaggggaagcgaccagaaggcacgtgcctccagtccagccaggctgcaggtgttaaaaatctctgcagtcacattttctggcttctctgaacagcccctgtaggtgctcacacatgtacacatgcatgcatatatatttatatatatatacatttacatatttatatatatttaaatatatttaaatatttaaatatatttttatatatatttatattttatatatgtgtatgcatacacatgcacacagatgtacacacacatatgcacatacacatatgcacacacacaccctacaactcagacctttcctttcagagctacccctgaccgagacttccttgccatgttacaaatgagcatctcttttagagtagtgtaatagaacgtggcacttcttgataaaaatagaattctttgacttctgcccaggctgcctggtgggcaggctcacagcctcgttctttctcagctttccacgttattaatttttagtgccaaaagacagttctgctgctccaggcctccagctgagctctgctaggttggaagtcccttctcagcctgattcccattagcacagagcttggagaagacccttcctcactctgatcctgctgcctggagctggcagatgcactcctcacccagcagccaagacccatgctcctggtttagaagggtccgtcctgacagctatctccactaggcagcccagggttcctctggacacaggaccctgccaatttattagtcacggtggcaccggatagacacagcttcacccagtgatctgccggcactgctctctcttcctccagtcctgggcttcttcatgtccaaaccacgtggagaacaagataactaggatcagctcttttggagatagaagtcaccttccagcctgggatcagtggcatagtctcagcccaggtctggagacagggaggctgccatgcctgccagccccatccagccccagctggcagcagtgtgaaatagtgctcgctaaaatgagcctgctgtttgcctagatgtgtgtttcccaataattcagagacctagataatgggaaaggcgaacatctcgtatcccccacttccctcagcaaaaagagaacagtgccgcagccacaggcaaggtgggttagaaaacctgtctgctggcagattattgtctgtaacttgcctccttagttcttccaacactctctccttccccctcctcccctcccatggtccaaccctgagggttccagcagcagctgggaggtctccgatgttatctcagagctcccaatctgctgacatttgaaaatcttctggctataacttgctcacttagcggctgctgctctgcagccctgagccctcctaaaggagaccctacacagaagagtacaatgtaaacagccgtcgccagagtccccccagccagagatagcccttgggtacattttgcaatattttgttttgtttgctctcagaccggacttgcccccctttttagcacagcccaattctactacgtatactccctccttgttctttttgtttggcattatatcctaagcatttccctgcatcatccaagctctgtgggatgtcatttttaacacccacacagcgtcctctggtgtggttgtatgacaagtcacttaactattccacacccaaagcctccccttttccaaactcttccctgggacctcctgaaggtaacagcaagatctgagcagcgctggatggatcctgctctcagtcccctgtctgggaacaacgctgagccttaacagggatgtcagcttcctagggctgctgtaacaaatcccacaaactgagtgccttcaaacattgtctggtagttctggaggtcaaaggtgcagaacgagtttcactgggctgaaaccaaggtagggctgtgctctctcctgaggctttaggggagaatctgcttcctgaacttttctagcttggagagctgcattccttggcccttcgtcccccttgcttctcttccaagccagtagtgtagcatcctcagatctccctctgctttcgtcttcacgttgcctttccttttctgcagtcagatgtccctctgtccctcttataaggacatttgtgatgacatttagggcctatgtgggcgatccaggatcatctgtagatctagaacttaaacttttttttttttttttttttttttagatgtggtctcactctgtcacccaggctggagtgcagtagcaccatttcggttcactgcaacttctgcctcctgggttcaagcgattctcctgtctcagcctcccaagtggctgggattacaggtgtgcaccaccatctccagctaacttttttgtatttttagtagagacagggttttgccatgtaggccaggctggtctcgaactgttgacctcaggtgatctgccttggcctcccaaagcgttgggattacaggcgtaagccaccgcgtccggccacattattcttatttgcaaaacaaatacttatctggcatcaaacagatactttgcatccggcaaaaacaggtggaggtgactgaaggcgaatgtgggaggtcatggtgggttaatgatcgccagcgctgtccggtgaaatcaaccacctgtgacaaaggtggtttttcacttttactgaacaagcatgctattctacagtaaactccttaacaaatgtagcttttcaaggtccttaggactattacctttcaatattattgggaagttctttgctcttcttagcagactgcgaaactcaactttgtgatgacaagatacagaataaatgcatattaactgaaattctaggctcacacctatgtgagcttttctctctctaacaagatgtcagggccggttcagggagttcatctccagccacctgtgctaatcatcgcccatcctttccaagtatctaatgacactcccaaccaaggtctctataatttccagccaaaaatgagttacaacatatggaacatctaattttctgtttccattctagttattttattcttatgagcttgtgggctccatctaccaacctctgggcaaatgctcatctgacttccatagacacacagcaagcagacaaccacacaaagaggaagagggagaatatttaccagccatggaacatctgctctgtgcttatatctcatatgcattatctctaattatcaaaagaaggtattattattattattgttccgcattcacagatgacaaactgaagatcagattggttaaatacttgtccaacattaacttagcatttgggcatcatagttggaattaaaacttgggtctgctcatctccaaaaacaccctaagccttaccacactcatgggacacagctgcagctgcaggttctgaaaggaaaactaaaacttcagaacccagttcactatgccaaaaaggcaaaaaaaaaaaaaaaaaaaaaaagccaaaagctgagtcatgcaagaagctgactttccttttgctcctaagtagatagctacagataaaaggttaaatagctccacaggtagctactgtatgttcaccttatcttacgtaaactgctgatttattgagcatgagacaaatacgtaattgactatcccctacctactccgtttcctttgcaacatgtggattcagtcatgtgaccatacactgcctttctcctctccagcctacttttccactttaaatatcaaagccctcaaaatcatctttggagaaaggcacagactagcgactgtttctgtgatttcgtgtctttttacttccagacatgtccttaaccttggcacaacaaatctctaaatcgattgagacctgtctcagatacttcttggtttacaagatggaggctgaaattaaagagaaagatcctcactcaactcacagaggagcagaatgggaagaggacttagtgagaattccctgaacacaggagaaaaccgaagcccagagagtggatggccaagtccaaggtcacacagccaagtgcatccgagcagcgcaggatccaggtttcctgccccagtgctctttctgcagcccatgccacctgttttcatgctatctcagttcaccttccagctacacacctgcaatcagaaacagaaagtctgagagtgtgtgtggagccaaagaggggacagcagtggtgaggccagtttcatgtcttgtgatttattttctccctttctttttggactttaatcttaagtggacagcaatttggaacagtgtcagcaccttgttggattgtgctgtttgggagaggtgacacagagtattttaaaagagcaggttaagaacttttcacaaggaatcaattgagagaaaataaaatagaaacagactgtcccacatttgggctgagcaccaaacacatttttttttttttttgagactgagtcttgctctgtcactcaggctggaatgcagtggcgcgatctcggctcactgcagccttcacctcccgggttcaagtgattcttctgcctcagcctcccaagtagctgggattacaggtgcccaccaccatgccaggctaatttttgtatttttagtagagacgaggtttcaccatgttggccaggctggtcttgaactcctgaccaagtgatccacctgcttcggcctcccaaagtgctgggattacaggcacgagccaccgcacctggcctcaaacaagctttttaattgcattcagaagtgcaccaactaggcacagacctctggcatggagacagaatgggaggttcttggtgtctggcctggtcttgcagaaatcagggagttgcggggaccaggcagccactgtgcatcagataggagtttcagcagcaggcaacagaaagcctgccaatgtagctgaaataagaagggcttatttttatccctgaacagaagcttccagcactggttcatcagatcagggcactgagctggcatccccatttatacagttttcctttccttcacctttgtaagatgcctggcacagctctgagcatcaaatatctgtgccatgtgggagcacacgaggggacaagtggggaatagggtctcctctgtcctctgtccccaggctggcttctctcgtggtagaaggacccccacagcaccaggcctcataactaccctgctggtaaactgcaggtgctgtcacggcttcctgccttcgtatatgaaatgttccttggcagctggactgctgtttgtttaccgcacgcacagctctgctgcctcttggttacaccagtgagctattgctccatgacaagccacaccgaaatgtagcaagcacttattgttgcccacatgtgtcaagtcagttgagtgtttctgccaaccggggcctggcttggcccaccttggctgagcttgctctggtgctagggtcagctagacaggtcggcaggagaccagctgctctagaagagcctggacaggatgaattggttctccttccacgtgcatcttgcatccctccagccaaggatttgaacccaggtctcgtctgactccaaatgcaccaagaggatggagcccagagtgacacagaggaagaggcccctggatggatgcatggggaaggtgaggcctggaggtgatgtgcttgagattaccaggctcttctgaacctgggggaccttctcctatgatagccctgctcctccagacccagcaggtgatttccccaaaagccgcttacagtgaacgcacctgatagcaataacttaagcatcccctgagaatgacccttatggcaggtgcaggtgaatgtggtttggagttctgagctaaggaatctgggagtggccaacctggagattcattcctattccttatctatgaggaacatctgagctcctgtcccgtcctgtgcaacacggacagtacaggggatcaaggccctttgttttgggttaggtaaatgttgccaggtggacactgttgggggagggtgctaagtgaagatgctatatatgctgcaagctttttgtaagttgtgtggctctcctgcccagcccaccactgctagatgctctcccctgcatgtaagccccagtaaaactccatgtctccttcagcagccctgggtcctttcttcagcctctcaaacctgctgccatccccattggagtagataggggttcagcataacagcagccaccagctggggaaaggcgtggcatttggagctccctacatggtcttgactctaatatggagggaaagaaaacagattctgccctgctcagtaaagccccctactggcctcccaccctggactgtggacaaagcttttttttttttttttgagacggagtctcactgtgtcccccaggctggagtgcagtggcgtgatctcagctcactgcaagctccgcctccccggttcacgccattctcctgcctcaggctcccgagtagctggggctacaggcgcctgccactacacccggctaattttttttttttttttcatttttagtggagacggggtttcatcgtgttagccaggatggtctcgatctcctacctcgtgatctgcccacctcggcctcccaaagtgctgggattacaggcgtgagccactgcgcccggccaacaaagcatatttttttcctctgaggtctttaccctataactgcaagtggtttcatgacactgcacatgggttcttatctggggttggtagattcaactcaattccacaggtttactgggtgttgcctcccatgcttggagccaggaggatgcagggaaatggggctgccaccatacccgctcttcttatgatcccatcacatcattgcaccctttggggcctggcaccatgctctggcactttgcctccatcatctcctttaacctctgagctctgtcaggaaggcattactactatccctggaatacagacaggaaaactgagttggattgaggctcagagaggttaagtcacttacccaaggtcacaaagctagagagtggcaggccagcatccaaggccagcaacacgagctccctctgatccaaatggtgactctatgtttgatcagtgctctgagaactctccaaagatctttatcaactgtcatctcttcattgcccaggcccagtcagggagccacttggctgcggtcccgctgagatttaggggcaggacccctgatgtgaggtggaatgcttggtcacgctgttcaagcctccaccagtcactcctgactggttatggacactcaatgtgccccgtcctgtgtgcaatgcagtgtgggaaggggatcaaggaccttggctaatcccaggcatttccccagaatgtcccaggtgtggaccccttgggaggtgctgggaagcaggctggtgtcccacaggccttggttccatcccagctgtgctgtgctaagctgaaactctttgggcagcttgtttcacctcatgagacttctttttctgaactgttaaatgggatgattcgacctctgcttggcttttggtgacgattaaacgagatattagctgtaaagcatttcatcccgggtctggtatagaagaagcacttgataaatgaaagctctgttgagtatgatgatccgtcaccccaggcatcagtgggatctcacagcaggaacaatgcctaactcctaactgatgcccagtaaacatcgggtggatgcaatgtccaacaagacagatattcatgttcagttttacagaaaaggagacagaggccagaaaaggaagaaagtgcccaggtcagccggctagtaagaggcagagttgaaatttgaaccgggttctggctggctgcagctccactgctccactactgcactgtctgagagccaaaaggcaccttgtagtcaggcaggcagggagctggcttcttgctgtcctgctggatcctgccctagtgtggccctccctggaaccaggggtggggctggagggcagggcactgagagagatctcctgggaactgtaccatctgcacaaagggcacctgctgggcactctgctgaaagctgtctgcaaacaccacttcctgcctgcctccctgggggctctaagctcaggagggggtgagggcctatgtctgcacgtggtgaggcccctgctgggtattgtaccacaccttcattgtgctcagggtggccagtggaggcccttcccagactcgagctctggtcacaagcccaaccccctccttgctcctgtctgggctcacctggaatctcctgcctcactctgtggccagaggcacctttggaagcccaggtcacccctactactcatgcccctcatttggaaattttcataatctacctcttgttaatgattccatcccatctataatgcttttctatttttctgaatttttccccgataggctataactgctgcaaagatagagaattgcaatgattaatatgcatttatgtatttccaaaaagttaccagaatatcaaactcatgattttgtctatagtttggttagattcaagctatttttatatcataaaacaacttaaaatttttttatttttaatttttgtgggtgcagagtgatgtatttatggggtacccgagatgttagaatgaagctattaaatgtgagtgtgaacgttcacctttttgcagatcacgggaattacaagtgacatcctgaagtatgatcacaaatgtttcaaattaagccttcctgctaagtttccagaggtgtgtggctcggacgaagtgtttccagaccctgatctactgcatgtcctgcctgttgctggttctttgcagcagtccattgaccaatgctgtctacagcttgagagcctctgcaggccagggctgctctgtgcacatcctacgttactattcaaactgcacagcagcatgaaaaacaggcccttcttttctctcatttacacatatgtgaagaagacacagcaagtgagaaaacgtgaccgaaagccacgcggacaggtggccgcagggccaaacccaacttccgtgatgtgatctggctacagtttggagcccacatatttcaatagttatccccaggcctggcacgtcaaagaggctccagaaatgtttgctgagtgagtgatgaatcagcaatttctgattttctcctaaacttagagaataagtggcttgtctgcagtcacccagggcgtccctgacagaggtacaagtaaagcccagatctctgcatctctggttcaaggccttttgtactacacaccgctgtctctttgtcatcattaaaagcaaggctcaagggacatgttttctagccttagttccccatctacaaaatgggcctcatggaatggaatgtctccacttcactccagcatcaacaagtggggaattctgatggattcaattcgacttctttccatgggcgtgttctaagcagcctctttgttccagaagctgccctcagccagagttggataagccaatcctcactccccagcctcctctggatagggatgaagaccccactggggttggaagtgcagaggcagacaggtgtatggagtcacctgtaaattgattcaagtgagccaggaaagcagcaaaggaaagagaaacctgagtgacgacgtggtggaggaacagggctggaaagaggctgctggctgtctggcttcgcagctctggcctcctaatcagcctcgctcttgtctctggtgttctctggctcttgtccatctgtctgtgtttctttttgccagctattgactaatctttgctgaagctgagctagaattctggtgtttataagcaggtaactagctgagcactagttgataactttggagttagtggataaccacagggctgggctactaagctttttcagttgaaaaataaataaataaataaataaacaccacacccagctaatttttgtatttttagtagagacagggtttcaccgtgttagccaggatggactccatctcctgacctcgtgatccgcctacctcggcctcccaaagtgctgggattacaggcgtgagccaccacgcccggtcacctttgtcctgttttctacaggttagaagcaaggcacaagtcatacctacattcaaggagaggggaccatgcaaaggataaactgcaggtgaagaacttgagagctattttagaagctgccttccacactttacaatctactttgcagctatactgagctcttagcaactccctgggcctgctgagcacctcttgcctttctgcctttgcgtatgctgttccctctgcctggaattccatgtcttctgcctttgcccacctcatcttaaggcctctgcttagatgcaatttctttgggctcttattagcagcatccaaatctgtgctggtttcttctcacgcttactctgcatcataatttttctgtttactcgttaatcccctcccactcctgccagtacctaaagtaaaatctacacgggcttggcacattgtggatgctcaatgaagatttgttaaatgagtgaatgattaaatgaaataagccccagcttggaacccagagctgtaatttccggttgtggtccctgtcccctgcccaggggctgtctaagggctcatctctcccaggagcccctgtatcatctcagtaactagaccagtaccatatccgacttcccctgactttgaaataattttcacctgcaatcaggtgcgcttccctagaacctctctcgctgttctttgcctttctccttcccccgccttgtatctccgtggtcctgccaaaaatcagaagctcattattaaaccagaagcttccttgcattatcccagagactacagacagaaaatatttgcttctatctcaactgaggactgacatagtaaagactccttgagatgttagctgtcaaggaggggaataaaagtttttcatctgcatgagtaattgtttcctgttttatccagagagacaacagatttacatcccagacacattcacactgggccaagagcagctgccattgcagattcgagtcacgtccttttttccttccttctccttcttggagttacaacagaagctggggaggtgagagtgcaggtgagagaggaggggggctctggaacatgtagcctgtgaggagggaaatcaggatggtgcttgggtggaggtgggagctgggccagggtcttggctggtcaggaaggctggtgaagcatgtactggggaggcagaggtcctgctttctttcctctctttccttcacacctacctcaacccactgtcgagtcctatcagctctgaaatagatccttcctccagcgccttctcacctctctctccaccattccagtccatgccgcctcatctcttactgggactttcacaacagcctcccgagtggtcttggcttctgctcgcaaatcctgcagtgccttctctgcggagccacaagctggatctttttaatccgctctcggtttctcacagcccttggaatgaaaccttggcctacagccctgtgtgacttgctgcctgtccttacctcctaacctcatctaatatccccttcccctcctcgtaccggcctttctgtttctcagacactccaggcttgttctgctcttggaccttcacgctgtctttctgtctcctgggaatctgtgccccctctgccagatcatgcagctggctctctctgcccaaataccctcttccgaggggtcttccttggccctgtgtctgacataggtaccctcctccatcactccagcccattacagtgccataacacttttattgccatctagagtaacatcagttggttttgtttatcatctgccaccctgctagaaaggacgtggatgaagcagagaggcacgtgcctgtctcattcgcctctggatctgctgcatccaggactgtgccagcacaaagtgggagcccgataaatatttattgaagaaatgaaaggtgacaaaaggcagaaggagggagaccccaaaaagaggtaaatttggtatcttagcaagtgggtgactaccactgtctgggggaaagctgatacacgaggacttgacaataattacagcagtaacaatcgctactattttgttttgaaatgaattttagtttctgaaattgtccaaagcacttttatcaatagaaacttgttacacatccctccaacagggagaagcagcacaggaagctgccccctcaaacactaaaggctcctggagctattcacagtgctggggaacaaccagaggaggaggaggacagagggagagaatactttttttaaaaatcccaaacaaaaccaaattctatacatgtatatctcgagtgagtaaatgtgtaacactcagcagtctcctacacttgccaggttttgtggcttcatgcagtaatataaaatgtgcttcacaaagctaggagttggcacagaatatagggttctgattcatattttagttttacttttttgtagagatgggatcccactatattgcacaggctggtctcaaactcctgagctcaagcgatcctcctgccttggcctcccacggtgctgagactacaggtgtgagccaccactcccagcctgatttatattttataaagaggcaacgatggagtacacagctgagcaatctcttgcatttctggaccttgagcatcaggaagcttagggagggtgaaaactcagaagaaagctcagagttgagacctttgattttttgcccagagagtccagctaacacactttataacccaaaaggccttacaaatatttcagagcagaggcagcatttttgcactggataaacaaaggtacggtaatttcttcatagtttattttcattacaagtaattcttttcctgaagaaaaatttatatttcagatttatttcccctctcaaaggggaggggagttataatattctgtttccatagcaccattcctcaagatcaaacccaggcaggcatttttacagcacacacttccatatgtcattgctaatcctcgcaaccttgaggaaactgaggtgcaaaggggttgaggaatgtgttcaccatcccaaagccaacgaagtgccagaacccaaatccaagcttggctgtctcatccccaaggacgtactctttatgccgttccttatgacttttcatgcagcaggcgcaaggcagcaagaatttggctcttctgacatttatcaggcacctggtatgtgccaggcctactgtaaaccccaagatgacatggtccatgtctatccattcagcatcagagagactgttatcaggacttgaggcctgagacacagccctgaatcagatgcaggcctctggtgtttgcaaaggatgcgtgagtatgtgtatgtgtatgcgtgcattgtgtgtaggggtgtgtgtatgttgggggttgggggcagaaaatgctccctgaactgttggtattaaggcagatctttgatggagggactggggtgtggagacttgaaccctagtttcgaagtggggacctcgaacactagtatggccagcagacaggctggagttgctgaattgtcagctaggtctttaatccactccccttctctaaatcagggtggaattggactcagggctggttcagggctgaggtttccgggggatgaatgattccagacagtgggaaggggtgatggatgatgaacctggcaagtcacaggactatggacttggctgtatgttgcatgtatgtgtaagatctgagttgagacctttgatttttgcccagaaagtccagctaacatactatataagccagtgagaccagccagtgtctgttcattgcctctgccttgcccctatgcctgcccgcctcctatagcaggtccctatagcataatgaaaatgcgaacaaccttttctctggacactggggaatctagtctggtggataaagatggatggctgttaaacgatcacatcttgggctctgtgtgttcagtgaagcctcatttaccagatctctctgatgagaaaggtgaatggtggggacaaaatacatgctgttatcagaagtctggcgggggccctgtgcagtggcaagcacctgtagtcacagccactcgggaggcagaggtgggaagatcgcttgagcccaggaggttgaggctgcattgagctatgatggcaccattgtactccagcctggttgacagagtgagaccctgtctaaaaaaggaaaagaagtttagggggaaagcttttaggaggtggatgatggttaattttaattccacctaacattttaaactttggtatgtcaaaaggtgagaattgccagtgtcgaggcatggaaaccaaaggaaaactagagggttgagaaggtgggaagggccgcagtgtggcaggcggcagttactgggatggcttctactaaaggaactcatcgtccaccaccttcaggaaggaggctcctggggccctttaagagagcagtttcagtggaggctgcaggcaggttggcagaaacaagattatgagatggtctgtaccaggtatcaggcttgagggttagtgcctctagacttctctgagaagtctagctttgaagggaaggctggagagctagcacaatactcaataataacaagacctaaggcacttactgtgtgccaggcactgttctaagaactcagcacacttcagctcatttaatccttacaactatacaaagtttgtagtcttttcgttataccttttgacaggtgagttacttgctggaattcacgtggctagtaaatactggagctgagatttgaaagcaggcaatctggctccagaatctgtgttttcaacccacatactatattgaccatcatgaaaagatggtggtgagcaggcttgtttctaaggatgggagggtcctcataatatttgtatttacagagaggagggagaggtgggttacttcctctcccaaccccagaaagccaggcatgttggctggcatccctgggacctcagatattcaagcaaccatggccttacaaatcaggcattctatttattagagttgtgcagtgaggtcccctccatttcatccccagaatatctcctagacaagttggatcctgcagggcccgagtataaataagatggtgccctctgttgttatggagtagcttggagctgggccccagatgccctgtgtggattagatgagtgattagtatttggcaatgtagcttgagaggcttgctgagttactggggcatatgtccccagctcacgagtaccagcctgacttctgtcaatcaatcagtgaacagggtttgcagcgtccaccaggtacctgtggtgtagtagaagagagtttgaactttggaatcaaacatgctgaagttcagattccagctcctccactaactacctctgtgatcttggctaagtgaccgtcactttttttttttttttttttgagacaagatctcattctgtctcctaggctggagtgcagtggcatgatcatggctcactgcagcctcaacctcccgaactcaagagatcatcccacttcagcctcctgagtagctgggaccatggggcacctgccatggcatcaagctaattttttatcttttgtaaagatgggatttcgccatgttgcctaggccagtctcaaactcctgggctcaagcgatccacccacctcagcctcccaaagtgctgggattacaggtgtgagccaccgtgcccatcctgatggttgctttcagagccttggttcttcatctctaaaacaaagataggaatactgcctagtttccatggggagcttgtaacacatgcgggcctctctcccctcaccccagtctttggttagacacttactatttgcaaagacccaatttcttcatcataagaaggctgccaccacacttgagggagtgacccatttacaaacaattgcttccttctgggt

SEQ ID NO: 13568 - DNA, 21526 bp, Human; identical to SEQ ID NO: 13567

SEQ ID NO: 13569 - DNA, 23766 bp, Human
aaatagaaacatggggcgttggggagaagaggagatgtgtacctgcctcacctgcctccctgcccagaatgccgactccgactcttgctttccactaaggctggggattaaatgaaaagtgagaatctggaaacccccagagatgatgtttgtcgttggagctgattttatctcattttagtagcatgacctcctcctcaaactcaggatgcaattatggtcaatctcattagtgtgcagtaattgctcagccccaataccagattagcaggaagttctgttattttccttttgaggatgggctcctactgaactgtcctggaatctaccaccattcaggttacaaaagacccagggaactaggccagtccagctcccaaccccaagcagggagcaacttgctcagtccacgttgtgatagctcctcgctgccacaaggtggtgatgttgcatcacacacgcgcatgatgggcgcgcaggcgccaatgctcccaggacctgctgttccattcctaaatgaaagttgttcccaggatctggactcacaagacaaggcagcctattccctgctggggagctcaggggcaagagggcatctcggagggagggcacattctcacctctgaagacaaggagaacatcatcagcacatagaccaatcccagcagtgcaccttaggatggggagggccactgtgagttacagcaaaatgaacgaatgaatgaaccaataaatgtctgagagggaaagtcccaacgaccctcaggaggtacaatcaagagttgcagttattttcgttaggaacgttctaaacacaggggaaaccttccttccttctgctctattgttggagtggggccatcccgggacaccagaaatcaaggaattgagtttggagaagggacttggggaggtcacagtggcaggtgactgccaaatgaggtggcagaagccagcaagcgctggaaaaagtcggcccaaactgttcaccagcaccgccccccataactccccaccggctctggtttcaagactttccgttttctaggtatttccttggccttaaaccattttcctttaaacgaactttttctgtgaagccatccggtttcccccgatagtggcatctcacaaaggacaatccagtatcccaacagcgtgttgcgttccgcgggacgcagatttccttcacaggcaccccccgggttgcgtttttatagccacacccacccgcccccctatctcctgggcactgctaatgagtcctgcatttctctcctttggtctttggataaatgaaccatccgtgcgtgacctttgcgagggcatcttgcataataccagtacaccagcggcgccgtcggtgagtgacctttgggactggtttctctcaccagcgtaactccccgggagatccgagcaagctgatgagtgtatcagtggctcattctttctgttgcaccacggaccctcattctgtaaccgggataccagccagagatggggagcgggaggcgcagggcaggggcgtccctcctctcagcacagcctccccgcgctggatttctatcaatccagtttccacctgcctggaagtcagcagggtcctccccagtcccagatcgccgggcgaggccccagatggacctcaggggcggggagtgggcggagcttaggggccgaggcgaggtgtgggtggggcgggacgccgctgtggaggcggggcctgggcgcggacgggcgcggagcgaggcaccgcaccgccggggcggggagtgggcggggctcgggggcggggcggggtgtgggcggggctcacgggcggggcgggtgagtgggcggggccctcggcgtggtaggcgcgctgcgtaaagaggcctgcagtcccgcggcgcggggcaggttccgggctgcttaggttggcaccggtccgtggtccccgggggcgcagtcgcagcgctcccgccctccaggcgtcagcgagtgcgcggtccagtgcggccggaacctggcgcaactcctagagcggtccttggggagacgcgggtcccagtcctgcggctcctactggggagtgcgctggtcggaaggtgagtgatcccctgtcggggaccgggggacttgggaaggacagttcccggactggacggccagaacgctctcagggatttcagctggccggccatatggccctgtgggtcgtcgcgcccgggccagggaccattctgtacataggatcgtgcttggctctcacggaacgcgcccacacgcagggtcccggtgtcgaatcgtctggtggaatctgccctcaaccctatggagcgggtgctggtatcatagtcatattacaagtaggaatcagcgggcccaaggtcagtctgtaaagggggtaccggggtttaggcccgtgcgctgcccagcgctgccctgaaggcgcggctgaaccactggtttgcgctgcctttgtcaaggacattgtggcactgtggaaaaaatgaaaaatcagcttctctaacctataatctctctgggaaaaaaaaaaatcagcttttttttttttccccgagacggagtctcactctgtcgcccaggctggagtgcagtggcacgatttcggctcactgcaacctccgcctcccgggttcaagcaattctcctgcctcagcctcccgagtacctgggattataggggcgtgccaccacgcctggctaattttttgtatgtttagtagagacgggtttcatgttggtcaggctggtctcaaactcctgacctcgtgatccgcccgcctgggcctcccaaagtgctgggattgcaggcgtgagccactgctcccggccctctttttcttttttcttttttttttagaagagtctcactctgttgcccaggctggagtgcagtggggcaatctcagctcactgcaacctttgccttccaggttcaagcgattctcccccctcagccccttgagtagctgggattacaggcgcctgccaccatgcccggctaatttttgtatttttagtacaggtgggagtttcaccatattggccaggctggtcttgaactcattcttcttcctttctttttcttttttttttttttttgagatggagtttcactcttattgcccaagctggagtgcaatggcacaatctcagctcactgcaacctctgcctcccgggttcaagctattctcctgcctcagtctcccgagtagctgggattacaggtgcgtgccactacacccagctaatttttggtatttttagtagaaatggagtttcaccatattagtcaggctggtctcaaactcctgacctcaggtgatccgcctgcctcggcctcccagagtgctgggattaatgaaccactgcgcccggccaaaaatcagcttctttaacctttaatctctgaaaaaataaatcagtttaacctttaatctccgaagatcacagccaaagaaatacatgaaaaggaacaagtattaaataatatatacttctagctgtgctgtttatagttttgggaaaaaaatggaaataacctaaggtcccagaaataggaaaatgggcacaaaagggtatgcaggcaatggtttagctgccgcatgaatacacactgaatacactgtgagatgttgtctgttagaatgcccagcacggggactgtccacatggaaagaggcacaggaaaaaaagtgaaaacattataaaataacttcttaaaattaaataatgtacacgtcaaaaatatcagagcccacttgacctggtatatacagtttaataaccacatggctcttttttcctgtaggcctgggtaggtgcatagtttctaaaaagggagagaactgtcactgctgtggatggggtgccaagggaagtgcctggggtcaagtgaacagtgacacaactgcaagtcaagagcctgtgttggagtctttccccactatttcaaatagtatagaaaatagagctgagtcactcaaatagagctgagttagtcactcagctcttggacctcagattcttattcttaaccgctagggggatggagacagaagtcacaaactcacatgccaccagccatatgatgtaaacatgtaaactgggccaaggaatacaaaagggagtggtgagctggggacactgaagaatggatgccctgtctagaggagtgaaaatgaagcatttcatacaaacaacatgatttcgggcaatcactttgggaatcaggataaggtgttcccccagtctgcagaaacactggcaacatttacaaaggtaaatcatttcatatcactctattttctttttcttttttgagacagagtcttgctctgttgcccaggctggagtgcaatggcacaatcttgactcactgcaacctccacctcccaggttcaagtgattctcctgcctcagcctcccaagtagctgggactacaggcacatgccaccatacccggataatttttgtattttttagtagagatggtgttttgccacattgaccaggctggtttcaaactcctgacctcaggtgatccccccacctcggccccccaaaatgctgggattacaggtgtgagccaccacaactggcgatcattccatattactctccagcttaagaggctccaagggctttctgtcaggcttagaataaaatcctcacccctaccctaggaggggtcaggtcagacccctcccacctccctgactgcatctaccaccatccactctttttttttttgaaccacagttcagccaaacaggctttcttttttttcttttactttctcttttttcttgaaacagagtctaactctgtcacccagtctggagtggagcaatcctctaatctcagccccctgagtagctgggattacaggcatgcaccaccacacctggctaatttttaaaaatctttggtagagatgggatctcactatgttgcccgggctggtctcaaattcctaggctcaagtgatctcctgcctcagcctctcaaagtgctgggccttctgcttccctgggctttgccaggcctccctatgcattgtgatagccaaagtttgctttctacaaagtcacctccaggcagtgactgtccaccagggcactgtagagcctcccagctaatgatgaagtcactcactctcctctctttttcctttaagataatccctttccagacccgccattttggctcaccctgtaagttacagccccacttctcactgccaagtgtgggtgtcactgctggctcagggagcatggatcctgtaaacttgcctcatcgggaggctttgaggagtgacccccaggaactagacaagtaacttgttcttcacaatcactgccctcccaagaacatccaggatttcagcctcagtgctaagacaaccatgtctctccctgacacatgctcgctgctgagaattctaggaaaagcagagggctgtgcaggcgcccctgcccctaggctaggagagctggcaaatgcctggagacccaaaggcctcatcctcagggcggccaactcttctgttttagtgatatacagactatcttttattgtgatttatagtgcaacttaccggttcaaacaatactacctgtattcataaactttctttttcctttccttcctcactgcccagctttaggttcacccctgtaagtgttgctggtgtcagaataggaacctccctgcgctttgaagggatgaatgtgacctctcccacattctccggtgctgtgatgtaccttaaacacagcaaggtacttggacacaaagcctgtgcctggagcactttcagacagacagtgcatggccctcgctacagactcagtgccattgtagatgtttctgcatggaaaatacataaacacaaatatctgcagttgccaatccaccaccatcttgcagccccaagagagccccgggaatccaggttcctttggtatttctgctccctgcccttggtgcatagcctccatccccaggacgacaagaaggctgactgagccctaacatcatcccacagtccagctgggaagagagccagcgacaaagccagagggagctagctcccacacctcccagccccagctgagttcgcttcttgagggtatttcttggaagccccgcctgtgacttctgctgacacctcactggccatctcaactgcaaggcagcctaggaaatgtagtgcttacctgtacacgtggattcctggaatcaattcagggtctgtccttggggaaccagagtggggatattcagtcactaaagatgcaggttcccagctgtccagtgaagtcaagcgaatggggaaggatttgaagtcacctttgggtgtttggagtgatcagagctgtctgccctcttggggagtgacagtgccccactctgttaagtcccatgcctgcccccaactcagcttcagccacaatgatgtagcctcttttcctttccatccacagggcacctggcctgggtggagcccactcctcagcacccacctcacttcttgcagtattctgcagaccccagccctgtgcctgtgctcctggacagctggagataaggagtgggccctggaagatgctcattcaggccctgctcaagattccagtcctggtggggataagcaccacttttgtgtgtctctgtgctttttgttttgctgtaaagacacactgataggttcacgttgtcgtttggacacaacatgcgcgatgcgtgtcttcacactaagccctagtcacactctctgcattgtttttttatcccattttttcctactgtggtacagaacatctcacataaaattgaccattttaaccactttttttgtttgtttgttttttgtgtttttggacagagtctcgctctgtctcagcctcccgagtagctgggattacaggtgcacaccaccacgcccggctaatttttgtatttttagtagagacggagtttcgccatgttggccaggctggtctcggactcctgacctcaggtaatccacctgcctcagcctcccaaagtgctgggattacaggtgtgagccacggtgcctgacctcattttagccacttttaagggtagaattttctggctgttttcattcatgtactgatagacacttgggttgcttccatgttttagctgttgtggaaaatgctgctttgaacatgggtgggcaagtggttttcaagaccctgctttcagttttttgggttcagagtaacgaatggaattgctgagtcatatgttaattctcatttttctaattgtaatttttgggggcacagcacctctccagcagcggcagcactcgacctttccccagcggtgcacggggttccaacttctccgcatcctcacctacgtgtgttttgttttttggtagtagtagccattctaatgcgtgtgatatgggatctcattgtggttttgatttgcatttccctaatgattagtgatgctaagcatcttttcatggcttactgaccattcatacatctttggagaaaagcctacacaagccttctgcccatttttgcattgagttgtttgctttgttgttgttaagttttatctgagctgtttttttatggtagggagagtgggtttgttggagtctccttgtatctcccagaaggaagccagaatttcagagatggccaggagggggtgaggccaaaggctcccctggggagaactcacgtttttccagagccccattgtgtgccagccaccgcacatagcaactgtctctctctcactcttctgggccatgctgtgactttgttgatgaggaggttgaggcacagaggggtggagggatgtgctgcagggcccacagctacaatgggcagagctggaaattgcaccaagtctgtctgatgcgggggtctcctctgctcctctggcctccgctgcatccctggagaatctctgagacttctggttagagcctgggtctaagccaactcccattattttcaagtgaggggaagggccgacaactgccagtgctggcccaccagagtctggcaccagccgaggagtgcacgcacccattggtggtgtggcggttcactgatcccccagccttctgctcgatctacggggaaaactggggaaggcaggaaggccaaggaggctcaactcctgcttcctaccgtggctcatttcctgggtcctttgctgtatgactgtctggatggaaggttcagagtcctctcaaaaaaggaaaaaagtatgggttttgacatcctgcgtggcttgtcctctgaggcctaaatctccagaagattcctggcctctcttgagaggtctttctctgatgtgtttgcgtgtctgtcaggaagcagcagtgatgcctagatgtggtacattcgacctcacctatgcctctccccaccccctctgggttcgttttgtcttccagattgctggactcgctgaagagagactacgcaggaaagccccagccacccatcaaatcagagagaaggaatccaccttcttacgctatggcaggtaatgattcactattgtggagtaagacttttttttttttgagatgggattttgttgtattgcccaggctggtctcaaactcctgagctcaagtgaccctcccacattgaccttccaggtgggagttagactcttaatcagaaattggatacattgttgtaaaaaatccaagccacgtggaagtgtataaattatctggaattatcttgttttctatgttctcacttgtttcattgttcctttcgactccctccagaatttaggttcctcaaaagtggggccctgcctatcctgtctttgctgtgcctccaggccctgaaattctccctgggctgtagcaggggctcaagtgaatgaaccccaggaggcatcttgggtaaaaattcagtacgattctatctttgcttttgcaactgcttatcatgcacatatacatgaacatgcaatctctcaactttttaatttcacctaacgatataacatggagagcctttcgtgttagaacgcacaggttcaccttactctatacattatggtgtagattcggattttcgcccttggcaccactgacattctgggccagataatcctatgttttggggggtcatcctgtgcaccctgtttagcacctagcaccatccctggcctctgcccaccagatgccagtagcacccctcccccaccggctgtgacaaaccaaaatgtctccaggcattgagaaacgtcccctagcaggcacaacactgccccagttgagaaccattggtgtaggtatttcatttgcatctattctcctgttaagcccctaagtatagttcctttattgaaacaagagtctgagaaagtaaaattaaaatgttaaccatgaatctaacttatggaattcaacctttgtagccagctcaatgccctgaaacccattgcttcaaactgatacgtgtatcttttccttaaagtgtcattatgaaaaatttaaatcaagagtttaacatcttcttaaaggtgaccagggtaaatttaattaagcaaatcaccaggctgcctcccagacgaagtcagtatataagcctggagactctttccaatgaggaaaatactgcttcagaagcccctggtgtgaacgatactgccagtgccaggagggcctgactcttcctagagtcctctttgttatcagcatcaccactgaaagatgggctccatgtggccctgccttcccatgagaccagcgggtctgattcctcatgttttgtttaagtgtcagatttgatggactgggggagatggaagcagaactgtgccacactgaaaggtgcctgtagctgatatctgcaaatgtagggttagcatggaagactaattccagcagttctttattttggtgttagggagctggtctaaaccttcttacagaggataaccaaattaggttgggcttttaaaagatttagtggtggtatttttgaggagatataatttgacccattgtattgtgatgttgagctatgaataactggatttttaaaatgcccattgctttaaaactgccacctattagaaagtttggtatttctggggccaggtgctgtggctcataccagtaatcccagcactctgggaggccaaggtgggcagatcacctgaggtcgggagttcgagaccagcttgaccaacatggagaaacccggtcttaactaaaaatacaaaaaattatccgggcgtggtggcgcatgcctgtaatcccagctactcaggaggctgaggtaggagaattgcttgaacccgggaggcagaggttgcagtgagctgggatcgttgctccagcctgggcaacaagagcgaaactctgtttcaaaaaaaaaaaaaaagaaaaagaaaaaaggaaagaaaagaaagtttggtgtttctggccaagtgcggtggctcatgcctgtaatcccagcactttgggaggccaaggcgggtggatcacttgaggccaggagttcaagaccagcctggccaacatggcaaaatcccatctgtactaaaaatacaaaaaattagctgggcgtagtggcacacatctatcgggggaaattcagccagatattgggcgaaattcacccccaatatttcacgtaggttcttttctatatttcctaagtgtcggccggtctgagaaataaacggacagagtacaaaagagagaaattttaaagctgggtgtccaggggagacatcacatgtcggcaggttccgtgatgcccccaagccgtaaaaccagcaagtttttattagtgattttccaaaggggagggagtgtacaaatagagtgtgggtcacagagatcacatgcttcacaaggtaatagaatatcacaaagcaaatggaggcagggcgagatcacaggaccacgggacggggcgaaattaaaattgctaatgaagttttgggcaccattgtcattgagaacatcttatcaggagccagggtttgagagcagacaaccgatctgaccaaaatttattaggcaggaatttccttgtcttaataagcctgggagcgctacgggagactggggcttatttcatccctacagctggaccataaaagacagctgccgccccgaagcggccatttcagaggcccaccctcagggacgcattctctttctcagggatgttccttgctgagaaaaagaattcagcgatatttctcccatttgcttttgaaagaagagaaatatgtctctgttccgcctggctcaccggcagtgagagtttaaggttatctctcttgttccctgaacattgctgttatcctgttcttttttcaaggtgcccagatttcatattgttcaaacacacatgctctgcaaacaatttgtgcagttaacacaatcatcacagggtcctgaggcaatatacatcctcctcagcttatgaagatgatgggattaagagattaaagtaaagacaagcataggaaatcacatgggtattgattggggaagtgataactgtccatgaaatcttcacaatttacgttcagagattgcagtaaagacaggcataagaaattacaaaagtattaatttggggaactaataaatgtccacgaaatcttcacaatttatattcttctgccatggcctcagccagttgctccattcggggtccctgacttcccacgaaacacacctgtagtcccagctagtcaggagactgaggcatgagaatcacttgaacctgggaggcagaggttgcagtgagctgagatcatgccactgcattccagcctgggtgacagagtgagactgtctaaaaagaagagagagaaagagacagaaagaaaagaaaatttgatatttcttagcttcaattactatgatgcacctgaacattcaattttcatcttagtcttcattgaatttaacagagagaggttgttcttcaagaggaactgtttcttatcctgatttaggtaagaaagtactcattgtctatgcacaccaggaacccaagtctttcaacggatccttgaagaatgtggctgtagatgaactgagcaggcagggctgcaccgtcacagtgtctgatttgtatgccatgaactttgagccgagggccacagacaaagatatcactggtgagtcatgggataaatgctctatttataaaaactatctttatgttttttactttaaaaaatgttgacttccagctgcaaaatggcattatagaagcaagctagcttcactttccaaaaacaaatagatagcactgggattatcaccagcagtatcccagaagtcaaatatgaagatgaaatagttcccaagaccacacataagtgaaacaactccaagcagacggtaagagattggactatcatatccacgacacccctccccacaaactacccagcaccagctgtgtgggaaatttcctcccaagtcacaggttctacactggaaaagagatcaagggggacaatcagcttctcaattttctggggttcccagaaacaggcaggaaggagacctgttcctgcctcaacccacaggaagcatcaggagtgcctaaagggagaaatatccctgacaacagccagagacaaaggagggagatgggaatattgtccccagccctggaaactctgatctgtaacttagccaaaggagatgccaaaccagagtggctgttcagcagcaccacactgtaggaggtacattctgcaggtttcctgggcatgagctgctagccagccttcccacactaccatgctatcccctttggaacctctcatattcaggactggcacactctgaacagtaggttactagagctgaggcaaacgtgggcataaaccactatctagtgccaaaaagcaggtggtgacttagtagaggaaaaaaaaaaaaatttaataagaaagttgcaaagactttctaagcaaatatatgtaataaaaatgaaaacaagtcagacatagaagactgaaataaatagatgtcatccacaagaaacaacagtaaacagggaaccatgacctctccacacagacaaagcaaggaaccagtgactgaacctaacgagacggcactgtttggactctctgaccaagaattcagaatagcacttttaaggaaatgtggtaatcctcaagatcacacagaaaagcagttcagaaatttatcagttaaattttacaaagagattgaaataatttttaaaaaatcaaacagaaatcttggaactagaaatacatttgctgaaaaattcattagaggctctcaacagcagaatggatgaagcagaagaaaaaatcagtgaactcaaaggcaggtgatttgaaaatacacagaggagaaaaaagaaaaaggtatggagatttcttacaaaatatagaaaattacctcaaaagaccaaatctaagaatgattggtgcttaagaggaagctgagcaagagcaaggcatagcaagcttattcaaagaaataataacagaaaaattttccaaaacttcagaaagagataaatatcctggtagaggaaggtcatagaataaacagatttgactcaaataggactaccccaaggcatataattattaaactctcaaaggtcaagaacaaaaagaggatcctaaaagcaaataacatgtaacagagctccagttcatctggcaacagacttctcaacagaaaacatataggccaggaggtagtgggacattttcaaagtgctgaaagaacaaaactgtcaaccaagaatactgtacccagcaaatctagccttcaactctgaaagagagagagtctttcccaaacaaagaaaagctgagaaaatgcaccaccaccagacccaccttacaagaaatgctaaagggaattcaataagaaagaaaaacactaatgtgcaaaaagaaaacatttgaagatgtaaaacccactggtaaaagtaagtacacagaacactctaatactgtaattgtgtacagtccactcattactagtattaagtctaacagacaaatctatcaaaaacaataatcactacgtgacctgttaagagccaaagataagcaatataaaatatgtaaatcaagacacagatactcaaaaatgtggaggtgagcatgaaattaaagcgtagagtttatttttttagacctgtttggcattgaacaagacatccagcctctcttgggtgtcagtttgctctctggtaaattgggaaatacaccagtctcaccagttgttatgaagaaaggtgatgtgtgtagagcacagcacctgctaggtagcaagtgctcaatcagcagccctcccagactgcttctctttccctagctcggacccagggtgcagcttctggtcaggttgcagcaaatgtctttgacttgtctgaggagtccggtatacacagtgctactgggatggttgggatgggctgtggatgcccacctaggagtgagaatgtttggcctcttccccgacaggtactctttctaatcctgaggttttcaattatggagtggaaacccacgaagcctacaagcaaaggtctctggctagcgacatcactgatgagcagaaaaaggttcgggaggctgacctagtgatatttcaggtttgtttttctctaattaatatattgaatcagattcatcttatgtacaaactctttctgaatattgagttttgtgctgcttctggaagtggcatcaatgttttgagcacagttgcacacttactgagcaaatattgtaacctggttacaacacctagttacaacatttcacctagttacaccacttcacctagttacaacacttcacctagttacaacacttcatctagttacaacactactttaaacactgtacgtagatgtaacactactttttttttttttttttttttttttttgagacggagtctcgctctgtcgcccaggctggagtgcagtggcgggatctcggctcactgcaagctccgcctcccgggttcacgccattctcccgcctcagcctcccgagtagctgggactacaggcgcccgccaccacgcccggctagttttttgtatttttagtagagaccgggtttcaccgtgttagccaggatggtctcgatctcctgacctcgtgatccacccgcctcggcctcccaaagtgctgggattacaggcgtgagccaccgcgcccggccgatgtaacactactttaaacactttacctaattgggtaaagatatccacgtagccaatatcactcactccaaatcccgactgccatgtaaataggaatgaaggatatttccattattccagtggtccaagaatcatctgaaacctgccagtcttgttgcttcccttctcttcccgttcctgccctgagacattctggggctgcttgagaaccacatttatctgcacaaatgtttatcagggtaaatcaggccaaatgcatctccttaaatatcctgccttaaatatcctgatcattaagaggaaaatctctggtttctaccctctcagtggttgcttcacccccagcccagccaccttcctgtatttgttcacaaggaggtgatgccactgcagagtgaactggcccagcaaaatgccctccaggagtgctgactcatcaggccacttcccgccactgcaaggaagatgtgcaggcatggctgtggctgtgtaaacctggcagcagagtacgcacatgagctttgagggaattgttgggtgacagaaattcctgtccaactagaaggaaaggggaatctattataagggctctggtcacttgggcctcctggatcccaaggacagagctgtagctgctctcgtccacagattcccatctgctcctttctgcctcttggctctgttctctctcactgcttgccagggactggatcccctagatccagaatttccaaccaagggatctgattggttcagatcatttctgttttccaaccctgcttgaggatgcggagtgggcaggagaacgagagcactgttcgcatgagtccgccatgtgagggcaaggcagggggtgagcggcatgtgaccactttccagacaaaaccacctttccagaatgatgaggttcccaagccttcataaaagcaacctgcatgtgcgggaagagggctgcctcatccctgcccaggcttgcctctgcacaccccttcccgacaccagccctttctttactcagtgaccttgagctgctaatctgaccaaagtgcaggacgtcctttgtcctaattacaggtgggtggactcatagtcctcaggcctaggtgaccatgtggtttaccatctccgtcttaataccatgccagtatgacgggcctgtatcctggggtgcgtggtcccagcagagccacgctgagctctctgctctgcttctcctgtcccccttgggtcggccggccacgtggagcccgctttcctcctcgcacccactccactcccataacccggtggctgggtaggctaagacctggcctttctataatggcctttcttttgtttcacttcatttcactccatttccctactttccctttttttctgatagtttgtccagagggtctgcattataagttattcttttattcaacattaataaaaatttcattcatcactactgcactactaatatcagagcccaccactcactgagcattgattctgttttgggcactgtggtgtgtcttcgaatcctcaccaggatgctgtgagctgtgaactattagtagccctatttgatgaatcaggaaaaaggaggcacagggaggtcaagtaacttgccaatgtcacacagcagcaggtcgtggagcttgggtttcaatgccaagtcctgagtttgttttatatggaaagcacaagagacattggcttccacctttggtaacagatgattgcctatgtttatttcccttcccaggcggtaacactggatgtaatgttagggcatctatgggatagggagatcttagcgctggtctaaggaatacaaacatgactttagttggtgtctaaatccatagatgctcagcaccgaactcagtctgacttccagatgctaacaacacaccccaggcaggcgaaggggcatgcttttccatactcttccttttgactggcttgatcacagactgctgctccaaagctggtgttacgcacagctcctcgtcccctccctgcctgcccagggccagcatcaggggctgtcatcactgggggatgcagagctacctgtaacagcaacaaggaccattgtcaactccgttcccgtctgacacccacactgcacctttcagagctgaccataagggttaccctcacctgcccagctgccagggaagaggagggctgtgggcttcattccgaatcaccagataaactaaactaggaaacctgaggcgagccgcagcctcagtttctctttggtgttgccgcccacagttcccgctgtactggttcagcgtgccagccatcctgaagggctggatggatagggtgctgtgccagggctttgcctttgacatcccaggattctacgattccggtttgctccaggtatgtgctcttggataaggatcactatggatagttggagggaggggacagaggatgcgtcttctatcaagttatatttctagtttccttccttttcttagcaaatatcgattgagcacccactatgtacaaagcaccatgtgctgcacacgggtggacacagcatcgtttctgaaatcatggagctttttgtctggtggggctgcgaacacatccacagcatactacacgcatggcaaacaagggagtgggtcaggtgtcaggtgacgggggacctgggcaaccttatgtgggcaacccggtggccagccctggctccagagagagtatctccctggtgcagagcccagccctggcctggcacaagttcacccccttgagcatcatgtgcctgctgtgagaaaagaccatgcgacacccacgtggcaggatgaggagggcatggaatctggtagatgtgccacatgtggtagctatgaattcttactaaaacaatgatttttaaggctgggtgcagtggctcacgcctgtaatcccagcaatttgggaggccgaggagggtggatcacttgaggccaggagttcaagaccagcctggccgacatggtgaaaccccatctctactaaaaatacaaaaattagccgggcatggtggtaggcgcctgtagtcccagctacttgggaggccgaggcaggagactggtttgaacctgggaggtggaggttgcagtgagccaaaatcgcaccattgcattccagcctgggtgacaaagcgagactctgtctcaaaaaaaaaaaaaaaaaaaaggaacgatttttaaattctaaaagcttcagaaaataaatgcacgtaagggaaacatactgagtaaccaagatgtgtcttggaccatgaatggtgctaccacttactgagcagccctgtgtgctgggaaccttgtcctgtggtcagtgcctcggccgtatccatcacacatggtgtcatggaaaccaggtttccaccagcaacctgggcatgttagagcttctgtgtctgcttggtccattcacttggattgtctcctcctcctcttgggatgtcattgtcacctatggatgggagtgttgcatttgtccatccctggagggtgtccacacgcatgttccctgctggctgtgctgagcccgtgtgctggaggctcagcaacatttctgtcctcttctggagtccacacaaatgcatctgctttctcccttgcagggtaaactagcgctcctttccgtaaccacgggaggcacggccgagatgtacacgaagacaggagtcaatggagattctcgatacttcctgtggccactccaggtagaccagctgcgagtggctcccttgcttgttggcacacgcacacacagacacacacatgcacacatgcatacacacacacacgcacacacatacatgccctcagctccccgaggggtgagatgagatgggatggaagcgtgatgccccacaccattttgactcccctggatacaagaaaattataacattttgccccttttaaatgctttacttgacagatttgaaaagcttgaccaatagggaaaacatgccctaattatagcttttgatatggtttgggcagaagctaagccaaacctgcttagcttggtcagcagaatggccccaaggtggccctgcgtgtgttgtgatacgtgcgggtggaggccatccatatggctctggcagtgcttggtgagggcagcactgcccttggaccctggcaagtggcaccccaggccctgcattctgatggccgcatgctggtctctgctggccatgccaacccccacaggggcaaggggcctatggagccagcacacacccacctcccagtccgcaggcccctcccaggcctgcttccccaggggacctcttggtgcctgcgtgagtgtccctgggcctgaaatgtggccgagtagtggccacctgccaaagggaaggtggtgggcagagcagttccaacgtgctggggtgtcccacgaaggaacccctggtgaggggtggcagagggagggagtggggagcagactccaggtcaggggctccagggaacccagaaacctaggggtcaactgttcttccaggttgtttaagggaggtttgtcgagacagggggagagctcgttcttgaggggtagggagtttgctgggaaaatgcacgcgtcaccccttttctgtgaactctctctaggtgcacgtgccttgcccatgtcctattggtttggtattttttaattttctatttgtcagtgctcttcatatatcagagaaattaatcctattatgtcctttcaaaacacaatgatttttccttctacaggcagtgcacattgactaagttcattccttgcttttgttgttgtttgctattataaataggattttgtcttcaattatatcttctaaaagttcttttgattggtgaaagctattgattgctgaatattggtttttgaccccgaccatttgctgttttctcctcctaatcataattttttcttagttggtttccagtaataaagtcatgttgtctgaagctgggtgcggtggctcacgcctgtaattccagcactctgggaggctgaggcagtggatcacctgaggtcaggagtttgagaccagcctggccaacatggcgaaaccccatctctactaaaacacaaaaattagccgagtgtggtggcggacacctgtagtcccagctacttgggaggctgaggcagcagaatcgcttgaacctgagagacggaggttgcagtgagccaggattgcaccactgcactccagcctgggcaacagaatgagaatccacctcaaaaacaagcaaacaaacaaacaaataaataaaatgatgttgcctgaggaaaaaaatgtggatagtggtgtgtgggcctctcactccccacctgacagggcaggcctggatgagggtgtgggttttaaaggaagtaatgcagaggattgagtgtgacatttttagaaaaaaagtggtcctctttgaaaggaaaaagtacgtgattccagttactgatagtctactgaaggaaatgataatttataaacctgaccttgcttcttcacaggccaactggtctcttatgtgtcattagccaagttcaaattcttcttgcttttaaaaaaatctttttttttttcagtttgcagaagtacatattatggccaaaaaaaaaagagacaatatgaaatataaaaagagaaaatccctttaatccctcccacctcagaaagaatcactttaaatggtttgatttattttcttagggcctatatattttctcacatacataatttttattataggtttattacatttactgctcttttacatgaatggtatatcataaatacggcttaaaatttgtttgttattttcatttaacagatatcttgaacaaacttccatggtatatattatagctagaataacctcattctggaataatctatagtgtgaatgtaccataatttgcccaatcaagcagaactataatgtttggcatctgaatcagttgcaaagattgtaggttaattgcagttataaaaatagagcttggaaattgcaactgccccaagttcttcacggctcttatgcaaggctgtgtcctaaagccatagggaagtttagctttcagttgcctgtaacattaaggttgtttcatgattttttgaaggtttgtttcacaccatttccccccttaaatcatttaactgaatggtatgtaacaggtgtagtttctaatgagttcttttcttcccctgtggctttagcatggcacattacacttctgtggatttaaagtccttgcccctcagatcagctttgctcctgaaattgcatccgaagaagaaagaaaggggatggtggctgcgtggtcccagaggctgcagaccatctggaaggaagagcccatcccctgcacagcccactggcacttcgggcaataactctgtggcacgtgggcatcacgtaagcagcacactaggaggcccaggcgcaggcaaagagaagatggtgctgtcatgaaataaaattacaacatagctacctggggatacttttttctttctgttttttgtttgtttttaattttagctttaaggagcacatggccagtactgtttcaggggaatattgggtggcgctggggtttgggcttctattgatcccatcacccaaacagtgagcatagttcccaatagatagtttttcaacacttcctttcctcccttccttcccgcttttggattcccagcatctattgatcccgtcttttcacccctgtgtacccaatgtttagttcccacttataagttagaacatggggaatttggttttgtttctgtgttgattcacttaggataatgacctccagctgcatccacgttactgcaaaggacaggatttcatgtttttttatggctgcatagtattccatggcgtccgtgtaccacactttctttatccagtccactgttgatgggcacctgggttgattccatgtctttgctactgtaaatagttctgtgatgaacatacaagtgcaggcatcttttcatagaatgattttttttttccttttggtagatacccagtaatgggattgctgggttgaagggtaattctatttttagcaaactagaaatatttaatgaagtacatgaatgagtgtcttcagaattgtacacagtgagatcaaatattttaataatgagcttgttatgttgaattctattctgaccatcactcactgagattttcttttctttctttcttttcttttctttcttttttaaagagacagagtttcactatgttgcccgggctggtctcaaaccccttgcctcaagtaatcttcccaccttgggcctcccaaagtgctgggattgcaggtgtgagccaccacacctggcccagattttctttaatatttgtctaatatctttccatctccctatattcaagcttcatgtaattttattttctggtaattctctgagcatagagctggatttgctagtttttttattttatgactcaacatgacagtttctatttttcatagaaaagttgaatctgggcctgtttcttaattttcttctttgtctttttaaatttacattaggactatgaagttttaattgaacagccattaacatatatggttatatgttgcatgatgtttcaatcagtgatggactgcatgtacgatggtggtcccctaagattataatgccatgttttgtttattaaaatttatttaagatttattttattatttttatagatgaggtctcactctgttgccccagctgggtgcagtggcatgatcatacctcactaggctcaagtgatcctcctgcctcagcatccctagtaactaggactacaggcacatgctaccacgcctggctaattattttaatttttggtagagacaggatctcattatgttgcccaagctggtcttgaactcctggtctcaagcagtccacccacctcagcttccccaagtgctgagattacaggcatgagctgcctgcacctgggctaatacagtaattttactgtaccttttccatgtttagatacagagatacctattattgtgttacagttgcctacagtattcagtacagtaacatctctacaggtttatagccaagggcaataggctctaccataaagcctgggtgtgtagtaggctgtaccatctaggtttgtgtaagtgcattctatgatgtttgcgtgacaacgaaatcaactaattatgaaatcacttaatgatacatttctcagaatgtatctcttttgttaagtgaaacattacaaaatttatttttttgggcacggtggctcactcctgtaatcccagcactttgggaggccaaggcgggcatgccgatcacgaggtcatctcctacaggcagtgcacattgactaagttcattccttgcttttgctgttgtttgctattataaataggattttgtcttcaattatatcttctaaaagttcttttgattggtaaaagctattgattgctgaatat

SEQ ID NO: 13570 - DNA, 38252 bp, Human
tgcgccattgcactccagcctgggcaacaagaccaaaactccgtctcaaaaaaaaaaaattgtgacaccaataacctaaaactcagtgctaccgttttttattagcacaagggtaactggtgttgaaactgtacagacagctatttttatcatttctgagatgaaaccccaatcaacatatcaggaaaaaaggaaatactgacctcaccaaagatttctgaaagtcaaacgatattaaactcaaacattatatatgtctctttccttttatgcaggaattaatgtgatagatttatgttgagagtagaatatgaaaacttttgcatagtctgtatttaggccaaaactgcctttactactcaagaaagtccaatgggccagtgaggacactgcaggtgacagaaatttctatgagtgtaacacctacaagcactgtgctcacaggactgactgttacaccaaaaaggtctcttggaggagaagaaatgcaatatgcaaagaagctgttgtctccaattattcaagccaaggctacaacagtagccacaaatctgccagttatttccaattaaggcagaacgattgacttaaaaagcaatagttgttttttttctccactgagctttcaattagataatgtctataacctttataaagctgcaattatacagccaaaagaaaaaaaattaattgtggtaaaacatacataaaacttaccacttaaaccacttttaggtgtgtagttcagtggcagtaagtacactcacaatgtaatgcaggcatcaccaaaatccatccccaggactttttcatctctccaaactgaaactctgtccccatgaaacaccaactttccattcccccttccaccagccctcaacaacccccattctattttctgtccctataagtttgactcctctaggtaccttattatataagtggaatcacacagtatttgtctttttttgactggcttacctccctcagcatagtgtcctccaggttcatccatgtagtagcaagtgtcagaatttcgttctttgttcaggctaaaaaatgttcccttgcatgcacagacaacattttgcttatccatgtatctgtttttggacacttaaattgcctccacccttttggctattgtgaatagtgccgctgtcaacgtgagtgtaaaaacatttcttcttgtacaccctgttttaaattcttttgggttatatacccagaaaagaaaatgctggatcatataactgatttgttgaggaaccgcagtattgttcatcacatggctgcaccattttacattcccaacagcaatatacaagggcttcaatttctctacatcttcaccaacactaatttctgggggttttgctagtagccatcctaatgggcgtgaagtggtataaacaaaatttagatcccatcatctccgaaaagcaaatacacttcctagtactagtcagtactaaataggtgcacagcgtttagaactttacttgatccaacatagcagcctgcctagagccggagccccgcccactccggagtcccgcctggacgccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcgctcccggcagctacgcgacctgtgaccatggtggctgtgctgggcggccggggcgtgttgcgcctgcggctgcttctctcagcgctgaagcccgggatccacgtcccacgggccggacccgcggccgcgttcgggtaatggcggccacctcgccccggggatccccagcatcggcgcgctcgaggggcggcgggaggggcgcgtgccgacagcaggagttcccggcgcgcgggcacggggcgtgggcgcggcctggctgccctgtcgccctttgtgccgcgagaccccgatcctgggggccagccgcgcttggtgctcgagcccctcgatcgtgcatgcgcctcggtcagcctcagttcaaggagtctggagccgtggaggcttgggctatagagtgcagccccttcagtgtgcagaccagagagacccagggagatacatttgcctgtagtatggactcacccgtgacggagcacggactagaatcccaacgccctcattagtccattgctctgtccagagtccacactaagggcataaggacaataatctcttctttctcttatgtcagaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcaggtaaaacaataacaaaaaaactggattaatttctgaccttctgtcttgaaaatggatactcttggtcccaagagatactgggcagaaatgtggatagagcggcatgaagcttgttttactttattctctacatacatccctacacacatgcaaacacacgtatacaacgaacgtacacagtgcatgtgcgcagttgactgttgatgggctactttcataaagtcagtactagataggtacacagcgtttagaactgtacttgatccaacatagaaacttttagtttgaaaacttgatttagaaggagaaaagagggcaaatctgaccagcttttaaaatttcatattgcaattgactagctcctttaattttagaattattataagatggtcagggctattttgatagatggaaaaacatgttaatggctacagctgtataaattaacagtgaaaatgattattttttccagtttcctgtctgcagaaaggcatcgaaataagttactgtgattgtaccaatatagttctttttttttttgagactgactctcgctcttttgcccatgctggagtgcagtgttgtgatctcgctcactgcaacctctgcctcccaggtttaagcgattctcgtggcctcagcctcccgagtagctgggattacaggtacctgccaccatgcccggctaatttttgtgtttttagtagagatggggtttcaccatgttggccaagctgatctcgaactcttgacctcaaatgatccacctgcctcagcctcccaaagtgctgggattacaggcgtgagccaccgctctcggcctaccagtatagttctgataggttatttaatggttgaggaaggccccatccatctagttgcattgcagatcattcttcctaaaatatctctgaagaaacaggtttttctggattttgtacggccgttttataaatgcagctgcaagttgatatgacatataatctgggaaaacaagcagtggtattagttaatcctgaaatgcagctgtagctcagtgtcagtaggtaaaaggattcgtgtaaaaactttgcttcagaatagccagtgcccaacctacaactgacttttgttccaaaaacttgtttgtaagtctgctgtttggaactttgacccttatttcaaaatccgtaaggtgatttattcctgggtcaggtcaagaaaagccttttctacctgaaattggatattatgtgcagttataaatattaataattcacataacctaacaatcttcctaaaaaatattttccaagttcaaccttgggatgccctgccagagaatcagagactgtccttctgctgacgcttgccaccacgctgtatctggcagtcagagtgtggccccggtgcctgagccctcttaggactctgttcagccatgaggttagagaggaatcatggcctctggagttctaatggccccgtggccacttcctagctctgtgagtgtgggcagattgttcaacctctctgagcctcctgccttgcagcgtttttgtgaggatttgaaacaataaatgtaaaagcctggggatataataaacatgaagtaattagtaggcacaatgggaatatttatataatagtacaatatataagagatgtaaaaataattcatcaagattcatgcaaatttcaagccctgaaggtagcaaatactttattgtagataatggctacttcacaaaacatacacaaaagaaatagctgaacatacaatatgataatagcagtttctttttttttttttttttttttttttttgagacggagtctctctctgtcaccaggctggagtgcagtggcacgatctcggctcactgtaatcttcacctcccaggttccagcgattcccctgcctcagccttctgagtagctgggattacaggtgtgcaccaccatgccgggctaatttttttgtgtgtattttagtagagatggcgttccaccatgttgggcaggatggtcttgatctcctgacctcgtgatcctgacctcgtgatccacccacctgggccgcccaaagtatcgggattacaggtgtgagccaccacacctggccgatcctaagctatcttaactgtagaaatgaatttctcagaggaatagggcagtaatcataataagtaaatggcagagtcagtattgccattgcttggtggcttcattgatgcccctttaataatatttctgtagataaggagcttatagtttagtcagaccttattactacccaattctgtcttttatttttccagaaatggtatgttaagagtagatgtacctgtattcaacacatctgtttccacgtttgtttcttttttacttgagactggcaaataagattaaaccaaaagataaaacaggacctcattttttcaaaagggctgtgtttcagttatcctttgactaagggcagaggtaggagtagagagtatgtagaagaaaaaggagatgggccgggcctgtaatcccagcgcttagggaggctgaggcaggcagatcacgaggtcaggagattgagaccatcctggctaacagggtgaaaccccgtctctactaaaaatacaaaaaaattagccgggcgtggtggcgggtgcctgtagtcccagctacttgggaggctgaggcaggagaatggtgtgaacccgggaggtggaacttgcagtgagccgagatggcgccactgcactccagcctgggcgacagagtgagactccatctcaaaaaataaataaataaaaataaaaataaaaggagatggtggttgatttcattgtattggcactccaccaggagaagagagcgcctccttctggcatctgtcctggcttgccatcatgtccctcctgtgcttcactcagtcatctgtctgataagctgtgggaaggctgatggagcctggtcctggtgcaggggccgtctgtgtgccccactggtatatatcccaggacagtctggctgtcctcgaagagcagctgaggagaggttaatcagaacacctgtacggcacccataattcaggcagcacagacactggcattatgcctgtcctgaggcgttgtcctgtgctaagtgtggtccagttagatgctggatcctaggaggtcttaggccaaggcgggtgagtggcaggaaggagggctcttgagatggaggcttatggacagggctacttagcagttgacacagacatattttaacatcttaaaaaacagtaggatttatccgtgcagatgggcactgttgactatggccctcctgcagcaggccagacaacacaggataccctacagctaaagaacagcctggagatcgagaccttgggaccagtctcatctttgggaatgtcaccaaggctgctgaaggtctgggtaggtcctctgggcctgctgagtgcagacgagtgactccagggtctctgcccctgatgtccaccctcgtttcacgccagcctgcacttgaggacccttggcttccagctcaccggcgtgtgccatgagcctctgtggccattgattgagcaagccgcctagggtttttgtagggtgagccccaggctgggcacaatagcgtattcaagcatgagggcacagttcagatcggcagtctagtaaagaaaattcaaactcatgtcactgttcagaattggaaaaatcgaaataacccaaggagactgagaggcgttctggaggcgactcattcatatacaaagacagttttatcatattaaattcgtgctgttaaatgattttcctctgggggtggatttttaaacatttttcaaattttattttttaattgacataagtgtacctgtttatggggtagatagtgatgtttcgatagatacaaggtgtagtgatcagatcagtgtaattagcatatccatcgtctcaaacatttatcatgtctttgtgttgggaacattcagtatcttccttctagctattttaaactatcgcttattgttagccgtagtcatcctacagcgcgtagaacactaacacttattcctcctgtctagctggaattttgaatcaactaagaaatcttcccatctcccctttccccctgtggggatgtgttttttctcttctagcacctcggtaacctctgccaaagtggctgtgaatggcgttcagctgcattaccagcagactggagagggagatcacgcagtcctgctacttcctgggatgttaggtctgggtactttttaatggaatgtttttgcatgctgtaaaatctatgatgcattcacaatactagatgccaaatactgatgattaattttagtgcttttttgaaatgttttcatatttgctacaatcaaacttaaatgacttagaaaagtaggtaactttctactgctgttcagaattggattttttattcctttagtaaagtacccagtttttcctattgcaagtactctgtgaaatcacagttgcccataatttgggagggtgacaggggtcaaggaaaggggtgtgggaagaaggtaaaggaggaacgtgagtgggtaatcagtcatcctagtttgcttggcgttgggggattttccaggatgtgggactttcagtgctaaaactagagtgaattgatcacttgttgtggttgataatatattccgttaaaataagaggtaagaaaaaaaaaacctcagtttgattctttttagaaatcagagttagattggcatattaccctctctcaatatatgggccataataaagcctactggatctcaatctcattttgcagaactggagttcagatgtagaaagttcaagggaaaaatttgcagtgattccagtacatccgaaatctggttttaagggtgttagtattgttgctttatttttgatttagttaaataatcctaatatttaatctcagtattcctgggggactggatccaggaagccctcagatcccaaaatctgaggatcctcaagtccctgatataaaatagctcaatgtttgcatggaagctacgcatgttctcctgtatactttaagtcatgtctagattacttaccatatctcatgcaatgtaaatgctgtgcaaataattgttattttgtattgtttagggaataatgacaaggaaaaacgtctgtacatgttcagtacagacccaaccacccatttttttcccgaaatatttttgttccgaggttggttgaatccacagatgtagaaccacggataggaaggctgactgtacttatttctttgtgatttgcttctttctaaaagtgaagtgctaaaaaggttccacttgactgagcctcagcggatcgtggcactgttgcacgtgtgtctaaatggtgtttggtacctttgttttccttaacctgatgaacaaggacactgactctcatggctgatggggagctaaagttatctgtaaaaacattgcctatcttagctttccattatttcggtattgcagtcattgtccaggtgctaaaaacttaccaatttaatttttttttttttttttgagagggagtctcactgttgcccaggctggagccagtggcactatcttggttcaccacaacctctacctcccaggttcaagcgattctcctgcctcagcctcctgagtagctgggattacaggtgtgcaccaccatgcctggctaattttgtatttttagtagagacgagatttcaccatgttgtccaggctggtctcaaactgctgacctcaggtgatctactcgccccggcctcccaaaatgctgggattacaggcatgagccacagcacctgtccccaatttaatttttttttatgtaaagtattagcatgattccaatattaaaaaaaatggaccagaggagattctctctcctgtcctatcctcagcacccagttcccctccccacaggcctctcaggtgttacatgctgataactatgtacatgtattccttaaatgtttttttaagttttatattcttggcactggtcttcaaatgtgtacatgtgtgccagggagcaaatgccttcttgtttctgaaattggtcttttagactgttcttttttcccatcttctcacctcctgcccctccttcagggtacttccgtggccagaacccctccaggtcagaggcagaagagaagcctcatgggtcacagcagcagatgtgggctggagatctattcatttggttttggcttgaattttctgaatggtttacttgatcttgggaaagatatatcttgccaggaaaaatgataggccttgacaatgttgaatgatcctgcaccaccttgaaagacattttctaatatggtttgtcaggcaaagtggttagtagtcatttgtggcctgaggtagaagtcctcagaaatcagcagacttcactgataaaatgctgacttgcccctggactgggctctgtgagagtggccttctgcactgtgcacagtaggtgtgaacacaccacacctacagggaccacgtggtgggctgtggactagcggccaagctccctgcaggcccactaatagaattcagcttttagcatgggctgtttcatactgttctgatgaaactgatttggtttctttcctccataccccttctgcatttcagtgtttttgtttagttttcctggtttttaattataactacaaaataaaatctttaggctattcaccttagcttagtaaaaaaaaaaaaaattaaaaatctggaattttagaattctactttgaataacttggaccaaatctcataaatttctttgcagatattatagagatccctctcatgtgtaagtcattgttttaagaagaatagataacccagaagcatatctgtgaattaatttgtatacagtttcattaattctttcctttagaaaaggaagattaagccaaagaggtttcaaaagtgctgaaataatacagaagcaaaggaagacccagggcctctgtctttctcaaaatagccaccagggggaggtcggaggcaggcctgcactccgccgggaaaggaagcgcgcctcctttttttttttttttggtggagggacagagtcgcactttgtcaccagggtagagtgcagtggcgcaatctccgttcactgcaacctctgcttccctggttcaagcgatccgcccgccttggcctcccaaagtgctgggattacaggcgtgagccaccgcgcccggccccttttttttttttttttggagactgagtcttgccctgtgctcaggctggagtgcaatggcgcgatctgggctcactgcaacctccgcctcccgggttcaagcaattctcctgcctcagcctcctgagtagctgggactacaggcgcacaccgccatgcccggctacattttttttttttttttttttttgtattttagtagagatggggtttcaccgtgttgcccaggccggtctcgaactcctgagctcaggcagtccgcccgcctcggcctcccaaagtgctaggattacaggcgcacccggtcagcctgcctcctttcttcgagtggatggattaagtcattgcaaggctgctttcctgattacattctgaccactttgagtagaaactactttgcttttaagattgttattgcttctgttttcactgtaatgtgtttgatagtgaaagcgatcacctgagggtaaccaagtggctgtttttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggtaggtctctgagggaagggccaggggaggaagggtggctgggcctgtcttcatttattttgtttaaattttgttgttatatttttctacaaaataataccatgtgattgctatagaaaaccccaagagttcaaataggtataaagaagaaagtagaaatagcccacagtccagctctctagagacactaccaaatcttggcggctctgctttctggccagtcttattacatcacaaacgcagtttcatattgatggcatcgtgctacacctaacgtttttctaacttactatttttgttgaacaatttttcaaggaaataactttcatgtcaataaatatgcatttatactagttgtatgataggcacatattattccattgtatggatgtactgtatcttatttcaccaattttctttttttttttttgagacagagtgttgctctgtcacccaggctggagtgcggtggcgcaatcttggctcactgcaacctctgcctcccgggttcaaacgattctcctgcctcagcctcctgagtagctgggattacaggcacatgccactatgcccagctaatttttgtatttttagtagagacagggtttcatcgcattagtccggatggtctcgatctcctgacctcatgatccacccaccttggcctcccaaagtgctgggattacaggcatgagccaccacacctggcctatttcaccagttttctaatagtagataattaacttaatttttaagttgcctttttctgctgttataaatagcaggcagtgaacattctgttgctcgtgggcattttcatttttttgccactataaacagtattgttgtggacatcctggactgagctcctggcacacagggagaatttcatacacatttaggagacaatttgctaggtgatggaagttccagatgttcattttgcaggatagtgccacagtagttacaccattttatggtccgggcagcaaatatcttggagtaatattaattctttacctttaattttccagtcattccattcttttttcttggcggcctctctaagatgtaatctttgtccattttccctgccaaacgcatgtccagaccctctctgattcacccgcggactcacacaacctccccatgacgctgttctctgacagcctggctcttgccagttcttcccacagttgctttaccagataccctgcttcactccatccagcagagctcagggtcccctctctgatctacagaactgttctcaaggtccttgctcaggcatgcatatgcacacacgtgcacacgcatacacacgtatgctgtatttgtcatatttaagtacttggtctccattgattctagttccttgagctttttatccaaccagaagatgtagttccctcctaattcaaacccataccgtatgctcaggtttttgtgacaatttccactaaaagtaattaagagaaaacatgatgtcatcaaatggtggactctagggtttttcttttctgactaattgatactccagcctcacacctgtattgattctgataattagtgattcagtttcttttaacagagaggagcaataacccgtgccgtgcattttgtcgtatgatcataggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggtaggttctgcgaaggggagatgccgggacggcagatccttcccctctctccgcatctcatctcttattgtgggatatgttgacaagacacatctctcgtgcttctagttctcaactctcaggtaggaagaataacgagttctcagaaaagtaatgcagtttaaccagtctgagttttaaagctttctgtttccaggagtgaaacttccatggctcaggaaaaggctaagtaaaatcactatttctatttactactactgataatgaacttcagggaaggagggggtggtgtgaagtgttattaataatctcatttaaaatactgtgaggccaggcacagtggctcatgcctgtaatcccagcactttgggagctcaaggcagaaggatcgcttgagcccaggaggtcgaggctgcagtgagccatgattgtgccactgcacttttgcctgggtgacaggagtgagagagagatgggggaggaaagaaaataatgttgagtgtggaaaagaatcactggatacaaatatgaaaccttttattttgattaaaagaatttctgtgctatttgcatgctttaacgttgtccttcaagcctgtctttgaggttttttttttttttttttgagtttgagtttcactcttgttgcctgggctggagtgcagtcgtgcgatctcagctcaccacaacctcttcctcctggattcaagcgattctcctgcctcaccctcccaagtagctgggattacaggcatgtgccaccatgcctggctaattttgtgttttttagtaaagacggggtttctccatgttggtcaggctggtttcgaattcccgacctcaggtgatccacctgccttggcctcccaaagtgctgggattaccagcgtgagcccccacgcccagcctgaggtctttacaggcactggaataggggccagtgaacttcagcctgtgcattacacctagcctgcctcccacttttgtgcagcccacgtaccaatcgaggtggctagtgctgtgagtcacagagaccaagctggggtgtccctttaccacccagcattgctgccccagacctgcactggtggtcactacacaggggtgactgttggcaatgagcaggcacccagccatggaatttcagtcagcaactcaggagttgcttagcctccagcaagctgccccattgagatgaccaggctcttgggaggaaagaagggtgcaccaggatctaggggttgctaggacaagaagtgaaactgacctgcgttaccctactacccccacctgccagcctggcccaccaggaccctcttcctcaggccactagctttttgtccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagctcttacggtgagtctgatgtggttgccagtcctgtctgtgctcctgcttgtccttattttgctcctgcctggtatccatcttgtgcacagtaggccattccgctctgtgaagggtctgtcccctcccgcggcctctaggacaggctgccttgagttcttcctccctctcctgtatccttaaattctctccactgggtcagtcctctcagcctgcaaaagtgggcacaattcttcctccagaaagttgccactcctacctgtggttactatcttcccattctttattctttcccacaaacttatggaaagagccacctgcattccctgcttctagggatcctcctttccttccttctttagtccattctgccccatctccctctctggcccattctagccccctctactgaaactctcctcactgacccctgcccacttgttctttcccataatcactatctcagttcatggcctgcagatgacccggcatccaggcagagtcccagatgcatccctcgagggcccagtcctcctctgccctcttcatttgcccaccttgccctgttcattgaactgtgatgctttctgttgttacataatacccctccagttatcctcacctctcttctttccccacattctcctggtttaggccgctagcttcatatggtagtttgttctccataggagagtttcctttgtaaggcaaaaatctaatcacttaattccactagaggacttaaaatccttcactaaccagcaaagtccgtgcagtttggctggcccctcctgccagcccctccccggacattctcccatctcccctttctcctcatccttccggtgcctctcccacgtgggataaatggccattcctggaacaagcttccccctcatgcctcttcgcctttgcaactgctgctgtgccagcttgcaccagccttcccctcagccacatcctctgccagggcatattcacccctgacacagctccttgggcctccgcgtctgggatggcgtcccggagccctgagacctggcggtgctctccctcctggaccccgccacaccttgcacgtgcctgtgtcacggcccttcaaccccgggcactgtcagcacttactcccttgcctcggtcaccgcagtgggaactcactgtgtgcagttgctctgactttcctttcttgatgaaagcaagagtctctcagtagcgcagcactctttactctctgacgtctcgctacttcccctcctggctactctttctttttcatcccccatcctctcctaacttgtgtcaagatggctgtggcccgccagtgtgctagagaccaagcccccaccacgcacctcctcttggctccttggtcattctgcagcgtttgagaacatgctcatgatgtgtgcgccattggttacacccctcttcttgaagctttctctgtctggaagttcttgccaccgtgttctcccgacttccctcctctctcaggctgttccctggctgacacgtgcctgctcccccatgtgggccacagtgttggggtcctccaggcgtcaccctcagtgctctgctcccctcttaccctcacacctcacacctgagtagcttcactcagctccttgctccacctaactcccaaaccccacatgttcgactgttgtttttttttaagagacaaattctcactgggtgtggtggctcacacctgtaatcccagcactttgggaggctgaggcaggaggatcacttgagcccaggagttcaagaccagcctgggcaacgtagcaagaccccgtgtctacaaaaaaatacaaaacgtagtcaggtgtggtggcatgtgcctgtagtcccagccatttgggaggctgaggtggaggatcacctgagccggggaggttgaggctgccgtgatctgtgattacaccactgcactgtagcttgggtgacagaggcgagaccctgtcccaacaacagcaacaacaacaaccaaaagaaaaaaacagaaagaaaagaaaaagacgagttctcactatgttgccttattcaactttttattcaattttcttatctggttgtctcacacctactttaaattcagtctgtctaatactgaattcatgatcttctctctaggcctgtcccttctgctaaatttcttgtcattataaataatactctttctccctgaaaataatattttaattactatttattgagtgcctgccgtgagctaaagtctttaacaacgtgatatccatgtaaggtctctgattctcagcctgcttgtcaagtgaaaaacgggggctcacaaaagtgaggaaaccttccagaccacatcccccacactgcggcctgcagctcactgcactcttctcttctgctgggctctgagtggccccatcttgccctccccctctctccctcccaccaggctcccgccagcctcgttggtcccgtctgggctgattctgtgcctctccaaccggtccaggtccttgcctcctaccagtctgccttccatgatgctctgatagcaattcagcaatatgtgaatctcatggtgtcttactttaagccttccaggactccccacaactttcctgataaagttcaggctccttcactttgctcacggaatgagtggcccggcctctgcctctccaggtcccctccccccactttcccctcccaaccaccagtgtccagccatccgagaccacctgggtccctgcagcaggtggcgggctcctgcctccttgtgtgggcccttcccgctcccttcccactccttcacttgtttgctgacttctcttctcccagaatggcccaagcattccatcttctaggaagccctcaccgccgccaccccgtgtccactgcccgtgtgagcacacaggccactctgctacagatggacggctggttcttgtacccgtctcctggggtgtaggagcaacagtatctctctagggtctaagtccatgagtgaaattgctgagtgttgtgggcaggtagactacattacaagtgacagattattttccagcaaaataaatttacacttccaccagcaatagatgagattcttaacttttagctcttcaacaaaaacttgaaattctcagacttcttaattcactagccaatcaaatgggtgtaagatattatcttattggggtcttaatttgcatttcgtattactaataagattgaaaatctgtgtttatccaccatttgagtttcttctgtattatatccatgtatttttattggtgaaaagttttttgttatgtaataattgatacacacaatacagtatgtttgggtatacagtatgaaatgtaacaacaaaacgaccccgccgctgtccacccaactcagcaccagaacagtttcaatgttatcccagtgttactctaatcctagtcagtaaccccttttagggtaactgtgttgcaagcacctcttcacagtgggtggcttttgcctttttctttatgggcagaactacttaatgtaaggaaatgccacagtgttttgtttttctttcctttttctttttcttttctttccttttttttttttttttttgagacagggtctccactattgcccaggctggagtgcagtggcaccatctcagctcactgcagcctgcttgctcaacatcaaactatccttctgcctcagcctcccaagtagctggcactacaggcgtgtgccaccgcacctggctaattttttttttttttttttttgagacggagtctcgctctgtcacccaggctgcgcagtggcgtgatctcggctcactgcaaactccgcctcctgtgttcacgccattctcctgcctcaacctcccgagtagctgggaatacaggcgcctgccaccacgcccggctatttttttgtatttttagtagagacggggtttcaccgtgttatccaggatggtctcgatctcctgacctcgtgatccgcctgcctcggcctcccaaagtgctgggattacaggcatgaaccaccgcgcctggccaatttttgtattttttgtagagacggggttccgccacattgcccaggctggtcttgaactcctggacttaagtaatccacccacctcaaccttccgaagtgctgggattacaggtgtgagccaccatgccgcccggcctcacaatgttttattttctcattggtttggctggttttgtttgattttagatccaccaacatgtttgcccatttgtttactcacctgttctttcttctcaaatgttccttctaaaagcatttatcttctcttcttcctgaagttatttttagaagttatttaagggcagcctgttaatggtcaactcagtttttaccaacaagtgtcttttctttcatccaccttttctgtaagtctgtttagctgagtgtggaaatggaagtggaaaatcattgtctcccccattctgcagtcttctgccttccatccttgctgttgagaagtttcctgtccgtctacgtggttcctgcttcggagtgatgtgtcttaactctctggctgtttttcagattttctccttacctttgatatattgctgttttaatatattctgtccaaatgcagatttcattttacttgtcctgtttggaatacattgcgtttttgtttatggattctttgattcattctgaaaaactctcccacccattatttcttcaaataggcatctcgttcattcttattctcttcttctgagacgagcggacttttgtaaacctcgtctttccatcttccttatctcttctgcatcgtcgtgtctctctgcgtggtgttctgcataatttcttaagatttgtcttccaattttctagtttttttattaactttataaaaatcctgtttgttttgtgacctttggttaggagctaatatttactcactcttaatctgaaaataaacaaagcagtgagcataaatcgagagcgctttccttccgggaagatttgcatttgttgctcttgggaaccacaggatcataccaggttggggccatttttagctcagcttgatccaggagtctcaggttgggccccggcctgcctgcgaacactgcgtctccacccagagcaggcctgcctttggagctggcttacttcctttgctgtattttcagggttctgtttctcatgtgcagacacactcatacacactcacaccccggtttccattaaccactgcaacttcagcaatgccacagaattctgttttgtgaaagatctagttattcccctgcaagaaggcctttcagagggtatggtctgccatacggccaaaagtagaagcatgtgcagggacgttttgctagccatcttcacactgtcttgcttgcttctctctcccttaccctccgcccccaaatgttttcttcttcctacatcttctccccacctcttcaggctgtctccacgtacctcattcaagtcttttcattcttgtgcagagcagttcatcctcttcagcctttatcttcagctcacacggggcctacctctgaatatttaagccagtcagcagaagcaaaggcaggcaccaggcactgtcctgtaatgggggatccgccctcctcagaaggcagttgtgattgtaaatagcagtttttcctccatttggtgatttgaattcactaagcacacagtgagtgcctgccaggtgcctgacgttgtccgggactctgtagagattgttgctcatgtgagttcatgccattagtgttatatttcttccatgtgtaacgtgtagctctcaggaagcaatatttaatatgctcaagagcattagaatctttacttatcacagtgtatttaaagaaatatagaaaacattggcctaaggaattgcatttgttgattcatgttaatggttgtttttagctattcttccctactagtgaatcatctataatacagtttgaagtttggtacttagccttttacacccatatttcttcggtagcagaaattagaatgaataatttgtgtgcatttttcaatgtccatacaaatgcaatgcagaaaaaaactcctcttttgcaaacattgtcgctcttcctcaggtgaccctgttagggtcatattttcttttatcttgtatctttaaaggaaagcggtaagtgcagctctaatttcatccacttggtaagcattgatttgtgggcctgtattgtgggaggcactagtgtaggccctggggtacagtggggagcaaagcaaagtcccttacactgcacacaggtcctagtgggaggcaggcactcagccctgggtccagaaggcaccgcaaagcagcaaccagggctaagccgagcagagggagggagggaggcattccaggcagacgagacagtgagcgcatgggctcagaagtggctcttgctcagaatacttaaagacaatactttagtatgaaattaaacctttcttcgcctacacttctgtttttcaggcatccgagatgtttccaaatggagtgagagaacaagaaagcctctagaagccctctatgggtatgactactttgccagaacctgtgaaaagtgggtggatggcataagacagtttaaacatctcccagatggtaggttactgggcttgaagggctctctgcctgttatagagggtgctcgagttcctccccagtgttctggaattgctcagtgattcatgaatctgcccatcgccctcacacgctcatgtgtgagcagaacagagaatactagttcttgtgtactgtgccagttcttgggcagtcaatctggcttaacggagaggtaggactgcgtgtccaaaggttcacattgttgagtctttaatagcagactgctcttttttccttctaatccttggtgtgtgtgcgatgacaaaataattatccagaagccttaaaccgtttctattttctaattccagaatgagtaattcgaaaataaataggccacaatgtgtacaatattttttcctttttacacatttagatgtgtctccccacgaggacactgttaatctttaatctcaacggaattaatatgaggaagaaaatattctgttttttccatcttcagaactaagtgatatgactgtaaccatgaacaatgcacaaatgtctcctattcttttttttttagatggagtctcactctgtcaccaggctggaatgcaatggcatgatctcagctcactgcaatctctgtctcctgggttcaagcgattgctctgcctcagcctcccaagtagctgggaccacaggcgtgcaccaccacacaggcacattttttttgtattttagtagagacagggtttcaccatgttggccaggatggccttgatctcctgacctcgtgatccgcccgccttggccctcccaattgctgggattacaggcctgagacaccatgcccagcctcctattctttatctgaaaaattaacaagatttccagttaaagtaagaattgacatctttaagagaaattctgaattatagtttattttcatacagctgtttatgtttataatctcatttttttttaattactgagaaaatagagtagctaagatctaatcttggagtgcattgttacaaaatggttgtgattgaaggaccaatttgatccattaggtaatcatttcctgcatgaatcatctgccaaaactttcacaatgaaaaggacatttggaaatgttactcttctggtttgagttgaaaacagcaaatatatcaaatgtatgccttataatgtttctgttcagatgcagcatccacccatggagacaggccctggaaatctctgctcttaaaacaaaaaaatgccatgaaacgatgtttgagacagttctccattaaagagggcacatttgtaaaatgtaaacttggatgttttgttgaagagagtagtgaaaagacaggaagatttaaaggtggaaatagggttaaatcagcaattcaaaaatacgttcatgatacagaggctgtagcagtgtataaactgtctcacagcgaggcccttcgtgatgcgtcccccttctgtgctgactcatttggtaggagccctcttttccgactgtcctctcaggtttatggatgcttggtatagtgtagggattcattgcattgcacggctctggagtgcgatggccctgagtgtgagttctgcctgtgtccccggcttgctgttagaatggatctgggcaggtaacttagcttcttgaagcttcggtttcctatctgtgacctcgaaaagctgttgttgtggggattaaatgaggtattatctattcagctttggtgcaggatcaaagacagagtaagtgtctagtgaaaggttggtattactgttattacagaagtccttaatgaacaaacatttttatatgctgaatgagttaaaacatgtaactactgtgtttaacagatgtgaaattgtttaaacagttgctggcaccaagtgagcactcaggcatgttgactttgatcatcacgtgatgatgcagctggccggtgtgtgtcatctcgggacaggagagggaagtgtcagagacctggagaagtatttccctagtcagcaggtccgcttctcacttagcaggcagtgacttcccactgaagaggagggaaaggcctggggcccgtgcagggcgggggagcactgccccgtcggggcagctcccagccttctcagagctgcagtgccttcctcttgacacacacggagagggaatggagaaggaaagagctagcttagggatgccaggaaccgcagacgcaactctctttttagccccacaacagccccggggaactgtgattgttcctgtttgtggctgaagctcccagtggttaaggagccaccacagcctcacagaggcaggaaactgcagtacagggactagggcccaggctgtccatcattgcctcaggaaagttctcataaatgggggtaagtccttacagtctctccaaagtatgttagtcaggagtgtcacagatgcatcagcgataaggagaagctgctttaccgtgcgcaagttgtataattaattccttgtgaggttcatatgctttgagggctggccggggcccctacactcatctgaaacgtgatttccagggaaaagctctacaggtgtcaagcacctaccactgttttcacggtgggaaccgccactgtggaatatagtggtggggtgtttatttgattttcctactattttatgcgaatttaaatcaggctgcttatttactagtagaactcagaaacaggcaaacaaacaagaaacagagagaaacagaaaagggaacccaaagaatgttagagctggaaggaatcccaggcacggtcaaatccaaaacacagtttttacggatagggaaactgagggccaaggaggggcagggctcgccgagtttcgcctcctctgaccgcgtagaatggttgcactaaagcagattcctcgtgctgtgtatccgtcaggtaacatctgccggcacctgctgccccgggtccagtgccccgccttgattgtgcacggtgagaaggatcctctggtcccacggtttcatgccgacttcattcataagcacgtgaaaggctcacggtaagtcctgtcaccgccttcacactccccccgagagcctcggagtcaatgggcaaagctactggaaggaaaataaccaagaggagttggagttttagagtgcacagccccccttttgccaatgccagtcagtagcaccgctttatttagggtaccacggaagagagaagccctgaactgtgggtgactgataaccagaaggaaaggcatgttcagatagacagctcttactttcatgagtggcaaacatgctcataggtgctaagccctgtcacttggtaatagtttagatttatttccatcagtattaaccgaaacagtttcacacaatttgggaattttcagtttagttttttatcattataaaagcactgaccacccaatttaaaaaaatctgttaaaccaaatttctgatgtctgctgacagccagccctactcagcacagttaatggtagtgttccctgtccctaaagcccccaggccagcagggaaagcaggcacagaaacagctccactgctcccttctcgctctgttctatgatgtatttaacaacagatttctcagagaatttttaaaggaggaaaaaaagtttcttttctataataaaatacaattaccataaacctttataattactatatccataatggataatgctatatccatttagcattttttaagttaacaggcatctctttattccacacattcctcctataccacttcaaccatgaatcaaaaatacacatgagcctgtataacaaataattcatttggtaagagcatagagtcagtgaagagcaaaggtgggagttaggcaggattatactgcgggtggacaaagaggtttaatgagggagttggtttttttttggagtcggagtctcgcactgtcacctgggctggagtgcagtggcacgatctcggctaactgcaacctccgcctcccaggttcaagcgattctcccacctcagtctcccaaataggtgggattacaggtgtgcgccaccacgcccagctaattttttgtattttcagtagagacgggtttcacaatgttagccaggctagtctcaaactcctgacctcgtgatccgcctgccttggcctcccaaagtgctgggattacaggcatgagccaccactcccagcttggagtttttaaattgatttagtaggggctgggcacagtggctcacacctgtaattgcagcactttgggaggctgaggcaggcggttcacttgaggccaggagttcaagaccagcctagccaacatggcgaaaccccatctgtactaaaaatacaaaaattagccgggcatggtggcgggtgcctgtaaccccagctactcaggaagctgagtcaggagaatcgcttgaacctgggaggcggaggttgcagtgagccaagattatgccactacactccagctgggtgacagagtgagactccgtctcagaaataaataaataagtataaatttatttagtagcgaataaaaggtattttcaaactagactttataaaattataatactaagttatggtcatggtacaaaattccagtagtatactttcttattaatccttgcaaaagttttttttgtttgttttttttttgaggcacagtttcactcttgttgcccaagctgaagtgcaatggcgcgatctcggctcactgcaacctctgcctcctgggttcaagtgattctcctgcctcagcctcctgagtagctgggattacaggcacccgccaccacgcccagctaatttttgcatttttagtagagacggggtttcactgtgttagccaggatggtctcgatctcttgaccttgtgatccacccaccttggcctcccaaagtgctgggattacaggcatgaaccaccatgcccggcctgcaaaagttttttatacaatctcagtttttgtgcttttgattgtatacgtttgcagtgtacaaagtgatatctccatatagcacttaatattttaaaaggtattttatatatagtatctagttatagtttatgacatatttatgaaaaatattatccattttacagatgagaaatcatggctgagagatgttaagcaatctttcaaggttgtatagctagtaaataattaatcttagatttttctcctaatatggtgcttttccaccatagcacagctgccacttatctcttaatatgtatgatggtaacatgcctagaataagataccaggtgacctggttaattgtcttccagcttcagaaatgacaggttttgcacagtgacacacatagtaaatgtgttatgtgcccttaaagagccaggttcaattaaagtcagtctacaagaaagtttaatttaggaattaaagtttaatttaggcccatctcctagcaacacagtacatcagtataggagaaaaacacccttacaggctcacacctgtaatcccagcactttgggaggccgaggtgggcagatcacttgaggtcaggagttcaagaccagcctggccatcatggtgaaacctcgtctctactagaaatacaaaaattagccagacatggtcgtgggcacccgtaatcccagctactcaagatgctgaggcagagaatcacttgaacctgggaggcagaggttgcagcgagccaagatcacgccactgcactccagcccgggcaacaagagccgaaaccctctctgaaaaacaaacaaacaaacaaaaaaacacttaaaggcacagactatcccttcccagatttttaccaagaaatacagattatgtgtgaagcaaacaccaaactgcctttcttgcctcagaaggaggctgaacaaagggtggagttgctcagcaggtctgcttccagcttatgttaatttgtctctttctctcttctctctttgtggtagaagaaaaataagaatcgcttatttttattttaagcaaagaggccttagagatcattcaagctcagtgattttaaaatgtgtttttagtcggttgaagcccttccgctaacaagcacttgtgctgcagtctgagatacgaaacacactatgagagctgctcagacgacagcagtgatggggagcaggctttgcctttctgcctcccgtgtccacatttcctcctataagtacagcggtcgtaatagattaggacctactcatatgacttcatttcaaatcaattacctctttaaacactctacccaaaggaggtcacactctgagatgctgggggtcaggatctaagcatatcaatatgaggggtgcaattcagcccatcacagtgcttctgaggaggtgctccgatctcaggagccagaggcccggttctgggtttcagactcgactgcaaacgatgagtccctcgcctctcgcctgcggcccttctccacccctcagctcctgcctttgcctgcctgggtgtgtgcccaccccttaggccaggactcaggcggctcctcagcgaggcttcctcgcctctgcatgcgcctccagttgctcgctcacctatctgaggtcatgtggctccttataccttttttcttcctctttttttgtttttgagacagagtctcgctgttgcccaggctggagtgcagtggcgcgatcttggctcactgcaggctctgcctcctgggttcctgccattctcctgcctcagcctcccgagtagctgggactacaggcgcccaccaccacgcccggctaattttttgtatttttagtggagacggggtttcacggcgttagccaggatggtctcaatctcctgacctcgtgatgcacccgcctcggcctcccaaagtgctgggattacaggcataagccactgcacttggccttcttcttttttttttttttttttgtttttttttttaagagacagggcttgcactgtcatccaggctggagtgcagtggtgtgatcacggctcattgcagccttgaactcctggactcaagtgatcctcccacctcagcctcccaagtagctcagacataggcacgtaccaccactcctagctaattttttgtgtatgtattttgtgtagagaaagggccttgccgtgttgtccaggctggtcttgaactcctgggctcaagcaatcctcctgccttggcctcccaaagtgccgggattacaggtgtgagccactgcacccagcctctttattcatatctctaacagctgctaacgtgaatgcaattcttcccatgttgaacactccaccgcctatcccaggatgtggtctagagcatctgaacatgctcagtgcatgttgaaagagagagagggagagcaagaggtgcacagagggccatgtctctgtggatgggctggggtcaccagtgcaggaccagccgcgtgttctgagcccaggcctgagggccagagccggtgggaaagtccatgtggcacagagttggcatcttaagttcgtgtcaactaaaggggagggagaggggttaagagcaccagcaggggactcagacctcggttggagtgctggtttgggtttgaatgctggtgtgggttggagtgctggtgtgggttgcagtgctggtttgggttggagtgctggtttgggtttgagttctggtgtgggtcggagtgctggtttgggtcgagtgctggttcagggtggagtgctggttcggggtggagtgctggttcggggtggagtgctggttcgggtccgagtgctggttcgggtggagtgctggttcggggtggagtgctggtgtgggttggagtgctggttcgggtccgagtgctggttcggggtggagtgctggttcggggtggagtgctggttcggggtggagtgctggtgtgggttggagtgctggttcggggtggagtgctggttcgggtccgagtgctggttcgggtggagtgctggttcagggtggagcgctggttcggggtggagtgctggtttgggtttgaatgctgattcggggtggagtgctggttcggggtggagtgctggttcagggtggagtgctggttccggttggagtgctggtgtgggttggagtgctggtgtgggtcggagtgctggtttgggtcggagtgctggtttgggtcgagtgctggttcgggttggagtgctggttcggggtggagtgctggtttgggtcggagtgctggtttgggtcgagtgctggttcaggttggagtgctggttccagctggagtgctggtttgggtcgagtgctggtttgggtcgagtgctggttcaggttggagtgctggttccggctagagtgctggtttgggtcgagtgctggtttgggtcgagtgctggttcaggttggagtgctggttccggctggagtgctggtttgggtcggagtgctggtttgggtcgagtgctggtttgggttggagtgctggttcgggttggagtgctggttccagctggagtgctggtttgggtcggagtgctggtttgggtcgagtgctggttcggggtggagtgctggttcgggtccgagtgctggttcgggtggagtgctggttcgggttggagtgctggttcggggtggagtgctgatgtgggttggagtgctggttccggttggagtgctggttcgggtcggagtgctggttcgggttggagtgctggttcggggtggagtgctggttcggggtggagtgctggttcggggtggagtgctggtgtgggttggagtgctggttctggttggagtgctgattcgggtcggagtgctggttcgggtcggagtgctggttcgggtcgagtgctggttcgggttggagtgctggttcgggtcagagtgctggttcggggtggagtgctggtgtgggttggagtgctggttccagttgagtgctgatttgggtcggagtgctggtttgggttgagtgctggtttgggtcggagtgctggtttgggtcggagtgctggttcgggttggagtgctggttccagctggagtgctggtttggggtggagtgctggtttgggtcggagtgctggtttgggtcgagtgctggtttgggtcggagtgctggttcggggtggagtgctggtttgggttcggggtggagtgctggttcagggtggagtgctggttcgggtcggagtgctggttcggggtggagtgctggtgtggtttggagtgctggttccagttgagtgctgatttgggtcggagtgctggtttgggttgagtgctggtttgggtcggagtgctggtttgggtcagagtgctggtttgggtcgagtgctggtttgggtcggagtgctggttcgggttggagtgctggttccggctggagtgctggtttgggtcggagtgctggtttgggtcggagtgctggtttgggcgagtgctggttcgggttggagtgctcctttggtcaccatgtgctggatgtaatatttctgtactactgttacctcttgtgtgaaatgagcatgacaatacctatcatctcaagatagtttttgaggaatgaatgaggaggtatttgtacatttggacttaaatttaagacttaacacacccagcctgggcaacatgctgaaacctcgtctctacaaaaagcaagaaattagccaggtatggtggtatgcacctgtagtccaagctactcaggaggctgaggtaggagaatcaccagagcctaggaggtggaggctgcagtgagccatgatcatgccacagcgctccagcctgggtgtaggaatgagaccccatctcaaaaataaataaataaataaaaaatactcaacagacagtagctgccacttttgaggatggaatgctggcatggatacaggtgaatagggcccccagaggacattggggcatagcttgaaattaggtcaggcaagttgccatctgttccaactttcagcaccattattatttgtgttatttttaaattttttaagagaaggtctcgctctgttgcccaggctggagtgcagtggcccgatcatagctcctggcagcctcaacctccttacttcaaaggatgctcccgcctcagcctcctgaatagctaagacaacaccattattagtgtaggtatatgggcatatttgggttctccaaaaaaaaagaaccaacaagacgtatatgtgtgtatgtatatataggtagaaaaaagagattcattttagggaattggttcatggagtatggaagctgacaagtcccaaggtctgcagagtgagttggccagctggagacccaggagagctaaaggtgtgattccagtctaagtctgaaggcctgacagccaggagaggagatggtgtggttctagtgtgaaagccaggaggcttgagacccaggaagagccaatgtttcagcctgagtccaaaggtaggaaaaagccaatatcgcagactgaaggccaaggaattccctgttctcagccttcttgttctactcaggcttttagcagattggacaagacccaccacactggggagggcctctgcctttattcagtcagtggattcaaatgctaacccatccagaaacaccctcatgaacacactcagaaataatgtttgaccaaatatctgggcaccctgtagcccagtcaagttgacacaaagtgtacagtcacagggtgaagggctgatggatgccatctctacagaggtctgggccttgtgttgggttcaccagagggtgtgctggcaggctggcagcgagggatcaggcctgggatgtctgtgcagtgggctagttactctcctctgtctggaccacagaagggaaggaagggcctctttctgcagcttccttggctgtttgggtctggccaccagtggtaagatggccctagtcctcccaggcaggccagtgggagccttaccactaggtggagtgaaatgaattggcttaggtggaaaagattcacaccagtgataatggttcattttcagctccatagaaaagtgaagccaggttctggtggggaggtagacgctgcaggcagccagggctgcagcttccgttctggactgcctccagcctggacgcagtggtttgccagctcctctgctactgccccaggtgacagttccccaccactggcatcccagccctcctcttcccaggtgctgctttcagctcctcccagctgctgctcaggtggaagggaaaaccatcagctccacacgctgcttgtgggctcgttacaggatttactgcacacagaattagccagtgcttatcaagttgagtcttttgtattaatatttcaaaaacagtgtggtctgaacctttccagacaaatcttacatgcaagattatattaaaacctctcttaagagaagaaacctccagttggaggtgttgtgttagccaacaaatgtagattaattgtgctcccctgagtcagtcattgtttaatatgctgcacagattaacaccttcaggaattctgcacattgtaaagtgcaatacaaatatactaataaaataacagcagacatttattaagcttaccacgtacccgcagaccctatgctgcatacgttgaatctactatctcattcatcctcagaatgattctatggggtagattctattactgtccgcattttccagatgaggaattgtgactcagggagatggatgtagcctgtcagtatggactctgtgctggttagacaaaactgtcctggccccgtaaagccagtgttttcctcccacgatgatgcctccagtttacatccaaatgtcacaggaagaaagctttcctgcagtccagggcccgactaggtccccacagtcacagcagatttggaaaggctttgtcctccacacaccacttaaaagcaccaacccaagcagcccgagggtcctctagcagcccacttcaagccgccacactgcccagaaagtagcctccggggcagttttgcttctaatgcttgtgtctaatgcttgagacatggttgcttttgagaaatggagctgctcagtgagctgtcgcccccaccatccccaaatgcctggtcagccctaaccagaggagagcctggccagccagggcagcccccaacttcatcagcagcaaggagcttgtggtttgaccattacctttttgtttgtttgtttgtttgttgtgagatagagccttgctctattgcccgggctggagtgcagtggcgggatctcggctcactgcaacctccgcctactgggttcaagtgattctgcctcagcctcccgagtagctgggattataggcgcgcatcaccacgccggctaatttttgtgtttttggtagagatggagtttcaccacattgaccaggctggtctcgaactcctgacctcaagtgatccacctgcctcggcctcccaaaatgctgggattacaggcgtgagccaccgtgcccagtctagtacctttttcttaggtggggctttctagaagaagcagaatgaaaaaggaaaatatttagtttctgaataaaaaggggctattggcaaccaggtttggatggcgtcagaaggaatgcctgaagaagtgatatgccatgttgctgcccagtttcacactggaagagatcctgtgcaaagatccagcggcctgctttgggttccagtaaacacaaaagtacgtactggcactctgcggattacagactcactgacaacttcatggattcatagatcaagttttgttacattgatccaaggtgaaggcacgccacagcaggttacttgtggccttgttactgtctgtaactccttgagttacagatgaaagttcagctaaagatgaaaagggctccaggcggggcaggaaaggtagcatcgtgaggccagcatctcacctatggcattttgacctaaaagagctgtatcaacagaggtaaagtgacccatacatttaccttggggttagacagcttctagttccttggactatctggaaccatgtctctttctgaaggtgccacatgcagtgaggaacctgccctggcagaggaactcgtgttcatcctctgaggccccttcgtttccaactgagccatgtgcttagcagttgggggtttcctactaatttttcggagaatgttattgtttgaaaagtgctctccacagagcatgtgattagatctttttgttacttgggtgagaatctagagctcctgtcttgccttgacagctaatattcatgcccatctattgtggtcctgtttccaaagaggaacacacaacagagtttctgtgcagtgaaacctgtgtcagacctaaaggaggcaagggctgctgaggagcttgaaatgacccttaaaagatatcaaggagaagagttgtcttcatactctcttctatctgtctgtccatctgtctattcatccattcatccatccagcattcagagcaggtctcccatattttaatgaagggaacctcatttttatttccccaagatctagagattaggaagagtgcagacagtgctgaacggctaaaaagaaacgattcacagcgaggttctccttccttccttatgggaaaccaacaaatcatagccagataggctggactgtctacagagaaagacttcacatgtggcaggctggggattccctgcctcccagtccagcttagtgcagattaggggatgcaatttagcctatacgtgaccttctatgacctcgcagcatccttggcaattcgttctttcctgtttcctgaaaacaaaggccttgagtgtccctgcaagccctgttccttgtgtaggcaactgggatcctatctctggggtgggtgcaactcatccttcttttctgaatagtgttaaagttgaatttagaatgtcgtgattgttagtaatagcattactaatgttccaaggccctcggaaaggtcccaacaatatgtcttcctttcaagttgattctcttggtaccccattcccacccccaatgtggtggctgagttggaagaggcccagcatcttccaagcacagctccctgccccacagttcctccctcgcacctactgaggttctgagctgtcagccccccagtattgaaactcaaaaaattagggaacatgataacgcattctgccctaatattgtccttttaatgtctaattatcattgtagacaaagtggcttgaacttaggctttcatcctagaagctttaccacttttactgtttctatacttttgtagctaataagtcaaatgtagaacaaagagaaggctgcatttgttcaggaaactgtaaatctgtcccatttgatcacaatcctgttgaaaggaagaagccttacgaggacagtgtgtttgctacaatgctgagccgtgacagctgcagcagcggctcctggagcacagggctgctggcatgggctcaccaccctcacagccatttgtctggcggcttgtattcagatgtatttgttcagtaatccaaaaatggaagggtgatttggaaccttgagcagcaggctggggatggctgtgaattctgctttgcacttgcccactacatcaacacgccaagaaactcacctgccccatcccagtgcattctgaacatttcttatttttatcttcttaccaaccttctctcttaaaatcagcttcattaaaatggatttttctagagtaaccaccagatcacctcccccactctcagtccgttttccagtcaaaccatttgttacttgattcagttccaaatataatgtgtgtctgctactgttaagtcattgccttatagtcaacctcaagggtagtcataaactccaagagtttcacgtgtctgactatattcttaggagattgatgggttacatttttctcctcgatagtggtcatgggggaaatgtgttaatttttcactttagatgtttgtgaaatgttggggagagtgaggggtttgttcttaagtggtgggccattgacccaaagtatttttaattccttttttaggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacacagaccacaaggttttctacacatgcttttttattagtatagataccttcacagacaatactgtaatttttagaggagttccacatcattacatcaacagtgtgaatttctaacagaggcaaaactgagcaccatagtttacaagtagaaagaccatgcttgaggacaacagaagttcactaaggatgcacgattgatctgagaagtttttaagcctcgtcctcgccctcctcctcctcgaactccccttgttcgtcggccgtggcgtcctggtactgctggtactcggacaccaggtcgttcatgttgctctcggcctcggtgaactccatctcgtccatgccctcgcccgtgtaccagtgcaggaaggccttgcgccggaacatggccgtgaactgctcggagatgcgcttgaacagctcctggatggccgtgctgttgccgatgaaggtggccgacatcttcaggccgcggggcgggatgtcgcacacggccgtcttcacgttgttggggatccactccacgaagtagctgctgttcttgttctgcacgttgagcatctgctcgtccacctccttcatggacatgcggccccggaagatggcagccaccgtcaggtagcggccgtggcgcgggtcgcaggcggccatcatgttcttggagtcgaacatctgctgggtgagctcgggcaccgtgagcgcccggtactgctggctgccccggctggtcaggggcgcgaagccgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtgggggtggtcagcttcagggtgcggaagcagatgtcatacagggcctcgttatcaatggagtaggtttcatctgtgttttccaccagctggtggaccgagagggtggcgttgtagggctccaccaccgtgtctgacaccttgggtgagggcatgacgctgaaggtgttcatgatgcggtctgggtactcttcccggatcttgctgatgagcagggtgcccatcccggaccccgtgccgccccccagagagtgggtcagctggaagccctggagacagtcacagctctctgactccttcctcaccacatccaggaccgagtcgaccagctcggctccctctgtgtagtggcccttggcccagttattcccggctccactctggcctgccagagggaaagtgaacattagacactaaaacataaggaatttcaaaatctgtcattttgactatggaggagaaggtaggactggtcttagactggcagattcttctcttttgaatactcttcttttacctga

SEQ ID NO: 13571 - DNA, 15019 bp, Human
ctttaaaaaaatagagatgtctggctgggcgcggtggctcacacctgtaattccagcactttgggaggccgaggcaggcggatcacgaggtcaggagctccagaccatcccggctaacacggcgaaaccccatctctactaaaaatacaaaaaaattagccaggcgtggtggcgggcgcctgtagtcccagctactcgggaggctgaggcaggagaatggcgtaaacccaggaggcggagcttgcagtgagccgagatcatgccactggcactccagcctgggcaacagagcaagactccgtctcaaaaaaaaaaaaaaaaagagatgtctgttttttcccctcctttcttacatagatgctaacatactgtgtacactatcctataccttgctgatctggaaatttctccatccagtacttaacgatgtttctcattctttttaatagctgtggggtatgctattgtgtgcatgtgtcatattttactcagccagtcccctgatgatgggcgtttgggttgttcatagttttgccattataaataacactacagtgaataatcttgtgcacatgttgtttcatagttgtgacatttcatagttaggacaatattttcagagtcgattcccagcagtgggaatcctgggtcaaagagcaaatgcatgtgtaattttgttggatatcgtcaacttctctgtgacagttggaccattttgtactcccaccagaagcttataagatcacctgcttctctatagctttgccaacagagcaaattgtcaaactttgggatttttgccaatccagtaggtgagaattgtatctcagtgtgatgtctgattatgaacaggtcatattttctgaggttttaattaactggtctcccccgccctttgaacagtgcccaatttaatcagtcacacacaaaaatgtaaattattagttcaagcttttctccaggtacttaattcttcctcttggagggaagatcagatttccttcagagctaccaggtgcaaggaggagaatattcagccccaccatgtcaccttccccaccagaaatgaggcagatacacagaaaaggttaggtttccagatgaactggtgggagccctggcccagaacctggccacagagctgctgttttcttgctaaccagactaacctggctccagccagctctttcagaacccttttgataccttatttgaaagtatctgctgtctctgatccaggttacaaatgacttatttctaacagtggtctctagatgagatccttcgttgttgttgtttttttctttctttctttctctcagcatggagcttttggagagtgtctttattctgagtgaaagaaaaggaagaggatgaaaaagcaagaacagtttaaaggagctccttctctcatggaccacttccatccacccactccccaaatcacaagatgcacatttggtttacatcagtgaattcagtgatttgtgcagatgtgaattaacccaatcccatgacttgtctaagtgaaagtgcctacatggaataaactgaaaaggggtgctggatggaagagatggttagttttagaacataaatctttgtcaagattaagacaggcccaggttttgctgaagaatggaatctggaccagcgttagaggacctgtatgtctagtgaagaaaaaccagaagaaagtgagatatacttcgtttcttccaaaactttgtcaaataaggttaaccctttaatctcaagagagagggaggaaatagtcttatttttaaactaccatgaaatttgagatttattaatattagtactggggtcatcttacagtattgtgttaaattggctctggagttagcccgggcttgtaactggcaattgacagtgtggtttctataggaaatagtgatcccaaaccaggtacaatctatgattctagattgcttatagtatggagtattcctttccaactttgtttttctctttctcataggattctaacattttcagagaaccttttggaaagaacaagcctacttcaataaatgaaggagaataaagaaaattcaagcccttcagtaacttcagcaaacctggaccacacaaagccatgttggtactgggataagaaagacttggctcatacaccctcacaacttgaaggacttgatccagccaccgaggcccggtaccgccgagagggcgctcggttcatctttgatgtgggcacacgtttggggctgtatcctgactctccttggaatctgttacagataggctccccactcaccaccaagaaataattagattctgtagacaaaatatatagtaatttctctgtaccagagcagttcttaaatatctgtttgaatgttgtttctggtgggggtttttctctttctgatttgtcattttaaaggtgtagacttagccactgaggaggtggccagccaggaggatatgaggcacccattaggatcacagttgaggctgggcacagtggctcatgcctgtaatcccagcactttgggaggcctagacaggagcatcccttgaaatctggagttcgagaccaacctgggctgcagtgagccaagatcacaccactgcactctagcctgggtgacagagatgctgtctcaaaaaaaaaaagatcatagttgaagtgtttctaaagggtgttaaaagtataaaacttcagcttgctaattcttgtaccagaattctgacaccctgagattcccatctcattactttgccactaatattgtttactttaccattgattttgttgttgttgtttgtctttttgtttttctacatttaactaagagtataacctgtaaaagttattggttagagtccttaaccagaacaacagacactatgataccctggcaactggaataatttattttcatcgcttctatatgtttcattccttcaagcaattcccaagatatgtaagtgtttgaattttattgtaattctctgtcatatgttattatttccacacagtttggtggactaattataagctctatttttctcatattttccagaaagtatttatttttatatggtatatactgcatataaacaaaatcaagtttgaactttttttattccaattagccatgttcaaatcttttcacttaggccaatatggaccatagtcatattgcgctttgtatgaaagtttactcccgtggtacctttcccagcataaatttgggcttataattgagactcaacaaagaccaagaaagcaaaatggaacagaagttgtctatgccatatcactcattcttcggttactcctcaagacgtgcattgtgtcttactctctgtgggagatagagtagctttcagtccaggataagtggtatgacatgcacagaacacgtgatggaaagtgaggccatcagaagatactgataaaagagttgtggcattcaaggaggagacaacttacatcttggagagagcagggaaagtgctaggaagaaggtgccagcattaaggtaagccttaaacgtacatagggcatagccatgccgtgatgggctaggtcagtggtccaacagaagctagcataagcagaggcagggggaaccatgtgacacattgtcagcccagccaggagcttgatttggcaggaaggaaatgatgagaccctgggtggataggtagactgggtcagaccacgataagcctcgaatgccagacttcagaaatttggcttcagtgggtgaacaatgcagtaattaaaaggtttcgtgaaaatgacagacttaacattaaagtcattgtgttgatttgttagctaagattttagttagatttatatacatgccttcctcactggttgtgaagttcttgaagaaggagaccatgttggaatcagttttgtacccccggcagagtgtctgacatctagtgtgatcaggattatgtgaggagagtggcatgtaggaaggattggagtgggcaaagagaagctgaagacagagcagttcagaccccagtgatatagggactgagctaaggttgaggcaactggagggacagtttcttcatccattcaggctgctataacaatatgccttagacccaataatttacacacaacagaaacttaactcttcacagttgtagagactgggaggtgtaagatcaaggtgctggcagattctgtgtctggtaagggtttgttcctcataaaagggctccttgccgcatcctcaaatggtggaagggaggaacaagccccttgggcctcttttataagggcagtaatcccattcagaatcatttcccaaaggcctcacttcttcataccgccaccttgggaattaggtctcaagctatgaattaggacataaacattcagaccatagcagaaagaaaaggaagcatgggcagtgctgagatggattccacaggactgtgctagaaggaaaaggaagcatgggcagtgctgctgagatggattccgcgggactgtgtttagttgtgctctttctttttccacggcaaagcttgctgtttagggagttaatttcagattggaatatgagaagaaaatttatttatgtgactcttttcctttttggcattttctttgtttacatgactttttttttaagaaagttaaattttaaataatttatgaagctagagtttgggggatttatatgtataaaatttccttcaagcttctagagtatcggagtatttgtgaatgataaaaagaaaggtaggggaatgaggaagaccagtttattacgaaggccaaaatttattgtatctatttctgtgtgacctttgataacaaaaatcaagaacttttgtttcccttttaggtgacaggagcctgttgcctctttctggctgggaaagtagaagaaacaccaaaaaaatgtaaagatatcatcaaaacagctcgtagtttattaaatgatgtacaatttggccagtttggagatgacccaaaggtaagaatgataataacttcctgccttctggtcttgattccttatggtagtattgtacagttccacatgttgacagtgcctgtagcccttgtgtctgccagtctcttgagttcctaagagggccttctgtagaagttacttgatgcttttgtaagaaaggagggaagatcgtgtagcctacacttactcagtgcttccttatgtgcccagcagtattctaagtactttggggcagtggcacatttcatggatatgagcaaaaatcctcttaattgccattaggactctgcttcttaagtgcagtggtgatggcagggttacaactccagctagcttctgggtcaaacaaaagtatgtatgctgtatgtacacatacacatgcctacatatgccatgtgtcttttgcttctaaagaatgttggaaggtatcaacatttgcagcatttttatgcacccagagcttgatactggtcacaccagccatcctatcttttccatacagctcacgccagtgtcagcaagtggtgctcaaataattgtacatattttgttgtgtttttaaaataccacttttagggacccatggcagtgttcctccactcccattcgcatcaagttccccttgttgcaacctcagtaacacctgttaattatccttcataacatttatcacagtttgcaattaaatagattttcaaaaatactttaggccaagccgggcagattgcttgagcccaggaattcaagaccagcctagccaacatagcgaaaccccatctctactatataagaataaactggccaggcgtggtggctcacgcctgtaatcccagcactttgggaggctgaggcgggcggatcacgaggtcaggagatcgagaccatcctggctaacatggtgaaaccccgtctctactaaaaatacaaaaaattaaccgggcgtggtggtgggtgcctgtagtcccagctactcgggaggttgaggcaggagaatggcatgaacccgggaggcggagcttgcagtgagccgagatggcaccactaccctccagcctgggcgacggagcaaaactccatctcaaaaaaaaataaataaactaatattactttaaaaaaaaaaaacctttattattttttgctgggcatggtggcacgcacctgtagtcccatctacttgggaggctgaggcaggagaattgcttaagcctgggaggcagaggttgcagtgagccaagattgcgctactgcactccagccaggacgagaaagcaagactccacctcaagaaaaaaaaaaaatgctttttttttttttagagcagttttatgttcacagcaaaaatgagtggaaagtacagagatttcccatataccccccacccaacacatgcacagcttcccccattttcagcatccccccgaccaaagtggtacatttgctatgactgatgagcctgcattgacacatcacccagagtccaaactttacattagggttcattctcagtgttgtacattctgtgggtttggacatacgtatagtaacatgtagccaccattatagtatcatgtagtctattttcatagccttaaaaattctctgtgctccacctgtttgtctccttctccccgctaacctctggcaaccactgatatttttactgtctctatagtttcaccatttccagaatgtcatcgaattggaatcatataggatgtagctttttcagattggtctctttcacttagtggtgtgcatttagatagtagtatccattagatgatttttatcaaattatcacacacataactccctccccttctcagctgtaagatgcatgaaagcaaagactatctgttttgtctaatgcctcattcagtggcaggacagagtaggcattcagcaagtactcgtggaataaatgtcaaactaatggtctgaggaaatttctaaatcacagttaaagctaaagcgatgaagttcagccccattcatggtgttgtttttcctaactagcttgtattgtctcacaatagttatctttttctctgccaagcattatgtatgtatatacaaaatgtatagtcattctcctcattgctttgaggagttaacaagggcccagaacacttttatacatattgtggttgtgattaacactagtattttctaagtattgccaatgtgggtaactcttttgaacttaattataaatccattaatctgtttataaacatttgaacctattaggaactcatattaactataaccaaaaatgcagttttatagaaataatttcaccatcagataatgttttcaatgtgcatgggtatttgatttttactgagtagtggggccctgtgtcctaacgtgataagtctgattgtaggaacatgctgtggttcagtcacacccccgtcacaggggcaggtgaaccttgtggctggcaagctgtgcttaaggataaggcatcacacagatctgggaccacagcagggcatggactcgtggcagctgctggtttgtgccatcccagggtgccttggagaagccccctttacttttagcctttacccactgtaccatgaagtcaggaaaccaagccccagtccaggaacagtgaaagtagaagttctgaagctcctgtgccccagaaaatgggaaaagaggggtcaccataccaattaggtctgaatgggggagggggctttgcaacctgccccctgcctctctatctcgcgcagtcttccctggtcggagtcggggccaaaggaaaacacctggagctgggagcagtgaagacattggggaagatgttttcctctgcagacaggagggcaattctttagtggaggcagtataagtatttaggaaaaataagatcatgagtcccatggaacattttttgccttaattagctttattttaattgtgtggcttttctctgtaatattcgtttcagcctttgtgttgggcactagacatgaggcacgaggcagaacagacatggtctctgctctcatggactctgcagttgagtggcaggataaattttaatcaaatgagtatataactatttgatgatgagttgtggtgtacgctgtaaaaggtcatttaaggtgctgtgatagcattccacccagggacccaggcaagtcccccggataaataggggctgagggaaggcgttcctgaggaatgatgtttgctcaaagacctataatgaccccattaattgaatatttggaagacagagggagggcaggccctgggctatcctgtaacagtatgtgggctacagcctgcaagccaattggtacacttggtaaaaagaattgtttctaaatttagaggaagtgttgaagcttctgggaagcaggtggtgacaatgacattcaaagaaaaaaattgttttgttttgttttttgagatggagtctcactcttgttactcaggctggagtgcagtggcacagtctcagctcactgcagcctctgccgcccaggctcgagcgattctcctgcctcagcttcccaagtaggggactacaggcgcctgccaccatgattggctaatttttatatttttggtagaggtggggtttcagcatgttggccaggctggtcttgaactcctgacctcaagtgatctgcccgcctcggcctcccaaagtgctgggattacaggcatgagccaccatgtccagcccagttttttttacactgtgtgaaagtttctaagattttaaaaaactttcatgagaaaatgcttgggaaactaagattgaaaaaccttagtcttgccatgtaatttggaataataattatagaatcatctctgtatcctataaaataataccatgcttctaaatgaaagccagtgacctgtgggtctctgcacctgttgatgagatttacagtcctctacaacgccctgtctttgatgccaaacaaggaattctctcaaattgtcctccccgcacacagtgtcttggttgtggtttatgttgtctttaagcagtaggtacagtcggctgtacaggggctgagttcaagacattagttagagagtatcatcaaagaggacattccattaacgatagcaacagtaaaatatccaaggttaaaccttgtggaaacctcgttagtggggtggaaaggactttaaaacaactaaaggactgaaaagatattaataaatttttggaaggaaacttcaatatggttaaaaatctccattctccctaattattctataaatcctctgagtttccaatgagaatattaatagcatgtatgttttctgtaatgatactaagtaaaatggttactaaaatttgagtgagggggacatgcagaacccagaaactgtttgaaaaagagaagtaatactggagctattgtatcccacccaaatccctttgatcctggtccaggagtagacaggcagatcagtgaacagaaaagatagtgtgtgtgtaggcagacatacacacgtagtttaggaggtgatttaggtagcattttaaataaaattggaaatgatcatttattcagtaagtgttgttgggatgatttatttcaaataaatgaaagatttaaacacaaaattgatttgcccccatttgcacgtaatacactatatgtgtacatgagtatatatacacacacatacacacacactggtacaatttatctctgagttttcatgaggctggctatcataaactctttcttgcttaaaatgttttcaatgaaaattcctaaaagattgcatttttaaaatttgaggtcttgaaagaaattacaatttagtcaaattatcaataacgtaaagatctgttttgtaaagggagactcatgtatgtattgaaaataataatatttttaaggatcttttgttttcagtatttttttttacattacacctctgctttgtcttcctgtttgagatcttttcagaatttatcagtgtctctgagcatgttaaaagtctgagtgggagagaaaggaaggaaaggcagttgctaaaatataacttgaagagagaataaatagacaggaaagctcacttttgtaatgctgcttgagacctgcaattgtaattactgtcctaacatttgtgattgatttttaggaggaagtaatggttctggagagaatcttactgcagaccatcaagtttgatttacaggtagaacatccataccagttcctactaaaatatgcaaagcaactcaaaggtaagaagaaagttttcagaagaattttttcattctgaaatcaagtctttataatttgatgacactcaaattacgcttctcaaaagcggaaaacaaagtttgatgtgtgaaataccaagggcatggcttgctcagtcaattcagcattgcagctgctaatgctgtttccttttatgtataaacaggctctgtcatccagttgccaagtgatgggagaggcaggaaaatgaggcagaattttttaaatggactaataaacttagccttggagccaggttttccatacatggtggttcagcgtaggtcatgaggaggaagaaggggtaggatgtggacccacatcattcatccttgtttcccacgcaaaagctctttgctgtgtatttgagtggtgctgaacacgtggtaggtttttaataaatacttgatgctgcctgtgaatttttctattgctattaatttacctttttgtccccatttctaggtgataaaaacaaaattcaaaagttggttcaaatggcatggacatttgtaaatgacaggtatacatgttcaaatgttgattaattacagtattttaaaataggcagagactttatggaccatttcatctaaacccctcattttgtgtcagaagaaactgacttgccctggcttgaggagccagttaatggcaaagctggggctgacgtccaggtcatctgcttcccggcagagggtttccttctgccctgccgtgtcatggtgttgtgaggtgctgaaattttatcaccagtctgaaacataaatccaaaacaatacactggagaattttgaaaactaattacttagagcccatttggttttgcaaaaatatacttcctggtatagttttagagccttaacactcttttgagaggccagggatctaatgaggggccgtggtgggaaacagaatgcctgtgaatggagttgctgccagccccatcccactgcagtcagtgaagcttctcttacatttgacttcctccataagatttcatttgaagaaacagttgagtggctaggatttcaacagtttaaataacataagtcattttcattggtgtagcaatttttggatgtgctagaattcttctgattctttaaggaatagagaaattactaactatggttaaagtaacttagttgggtacctttagaagagtaaagacgagtttatttatttatagtactttaattaaatttaggggagaataagcaaattaatggttagttatggcatctccatgcactggtttaatcataaatattagatcatattatctaacctttttttttcttgttgaactagtctctgcaccaccttgtcactgcagtgggaaccagagatcatagcagtagcagtgatgtatctcgcaggacgtttgtgcaaatttgaaatacaagaatggacctccaaacccatgtataggagatggtgggagcagtttgttcaagatgtcccggtcgacgttttggaaggtaccaggcatgctaagcgttctcgtgagggtgttccatgttgagatgattcttccatgtgtaccctgagtcccaagaatggattttcccagatagacatatgtgagcaatatttcagaagcatcattaattaaattatctaatagtttccactttgtccaaacacatacttttggtaaactaaaaatacacaccagtgttgcacacaacgaagatggggtgagttgtaaatgtgattcatgcttaggtcctcgtaggggtatcataactgattctttatccaggtaaaattttatttaaaataccaatttgtgtaaaatgtaattgttggctatcatttagacatctgccaccaaatcctggatctttactcacaaggaaaacaacagatgcctcatcacaccccccatcagctgcaacagcccccatctcttcagcctacaccacaagtgccgcaagtacagcagtcacagccgtctcaaagctccgaaccatcccagccccagcagaaggacccccagcaaccagcccagcagcagcagccagcccaacagcccaagaaaccctctccgcagcccagttctccccgacaggttaagcgagccgtggtgagtgggctaaagcaggccctgggtagagcaggctttccaggtggcggcaacacctgagcactgttcccatttctaagcgagcacagggaacaccggaagcagggggtgttcgccgaaactcgcagtccgactgcttgtcggtggggagcctgaaaacaaaggtgctccaaggacaggctgcctctgagaaccaggagggggctctctgcccggctccagccctgctgcctgtttcatccctgccagggttctgaagcctgtcggtgtcgttgccgtgtcctagcagtgtcgttgtgcatgctgcttctgtgcagctgcctgaccccaaacagtggaccgtttcctgcacccaagtggtcctgaaacttagtgtttactcagaactcaccattcaggaaagctagtcattctgtcttatttggtaaatggaaagaggaagggagcagaaatgatgatctggtaggtgccgtggtttgccctgaaagttcaggctagaaataatttttgtccgaggctgttcacagtgactgccgtcgctgattctggtggtacctggataatccatttttttctcatcatactcaggatcccagttaacaattgtgtattttcttttgtaacaggttgtttctcccaaagaagagaacaaagcagcaggtaatttcctgttctgatgtttttttagttttatgtgtttatatgcaaaactttaaattcttagccaacattgtttcttttcagatctaaattggccttaaatcttaactttagagctcatacaaaacttttccatcagcattgtctttctgttcatcacctgatcatagattctaaaattgtgctcttacgaagctatcagtacagaaaacattactggcaataaaaatgtactcagtaacatatataaaagtataattatggctgtaggagaactgttgctgcaattttatttttagagactatttacccccatcacagcagcaggagtcctctcccaagcaccaagccacagcagatgcgggggggcagtagggggtggtgtgctgcccggacagcaccagcccggcccagcccagctgcccttgcaggcaaggcctctttgaaacacacttgggttgaggtgctgtcacatgtctagaacccaaagttagttcatgtcaatattggaaataaacagaaggagtgagcaaaattggaacaattacaaaacagaaagttagaaatgttttgtcacagggtcagtccacctatcatactgaactctttgaaggcacagaccctattgactcatttgtctttctttgttacttggttcttagttccagtagttcctggttcttagaaccatgttctcggttcttagttccattcattaaactgctgtgaaatcttccagttatgatagagctactttttttttttttccagtatatttgagggaatgatgagttcagtacaggtgaattttttttttttttttgagacagagtttcactcttgttgcccaggctggagtgcagcggtgcaatcttaactcaccacaacctccgcctcctgggttcaagcaattctcctgcctcagcctcccgagtagctgggattacaggcatgcaccaccaggcctggctaattttgtatttttagtagagacagggtttctccatgttggtcaggcaggtgtcaaactcccgacctcaggtgatctgctcgccccagcctcccaaagtgctgcgattacaggcatgagccaccgtgcccagcctacaggtgaattttttaattagcttcaaattgaccgacattaaatgttagacacaagaacgggctacactccatgccacatgaaatgcaattgagttgacgtgcaggtctgtcagaggcaggaaacaaactatatatgaccttgaaggaagagttgcatttgagcagcgagagcagagggggaggatggagcaataagttggaagtacgcaagtgagcaaaggaattgagaatcaggggaaatggagaggagtctttctggaatgtgatgaattgaaaggcaatagcttctgataggatctaaaatgtgggttaggaccagatcacagagtttacctggaggactgtgagtttggcagaggcaagggaagccattggagatttagcaggggaatggcagagtctaaattcatttgagaaggagtcccctggcagcagtaaatagggcaagtggttaggaatggggagaatcttgctggcactcatgggaaacatggtggcctcagcatgctggctgcggggcaggaagggcagatccggaggaagctttatagaggaactcagctgcactgtgccatgccgaaggctactggctgcagagggctgcaagcactcgaaatgtgactgggtcaaattctgaagcactgacaatgcaaaatacacagagatttccaagaaaggagaacgtaagacatctcattagtaaagctttatattggttacatgttgaaataaaattttcgatctatcgggttaaataaatttttatcctttttccttttatttccagagtcttgctctgttaatgcaggctggagtgctcctttttcttgttaaagtggttcctggcacacttgtaatcccagcactttgggaggccaaggcatgctttgagc

SEQ ID NO: 13572 - DNA, 80357 bp, Human
agccaccacgcctggcttgttttgtattttatttatgtatttgcttttttagacggagtctcactctgtcgcccaggctggagtgcagtggcgcaatctcggctcactgcaacctccgcctcccgggttcaagcaattctctgcctcagcctcccgagtagctgggattacaggtgcctgccaccacacccggctcatttttctattttcagtagagatggggtttcaccatcttggccaggctagtcttgaactcctgacctggggatccacccgccttggcctcccaaagtgctgggattacaggcatcagccactgtgcccagccgttttgtatttttttagtagagacggggtttcccccatgttggccaggctggtctcgaactcctggactcaagtgatctgcctgcctcggccgcccaacgtgctgggattgcaggtgtgagccaccgcgaccggccgctttctctttctttcgagacaaggtcttgctttgtcacccaggctagagtgcagtggtgctatcatagctcactgagcctagaactcctggtctcaagatacctccgccttattctcctgaatagctgggtttacaggcatgtgccaccgtgcccggcttttttttttttttttttttttttttgagtctcttgctctgtcgcccaggctgcagtgcaggtggtgcaatctcggctcactgcaagctccgcctccagggttcacgccattctcctgcctcagcccccggagtagctggaactatagcgcccgccactacgcccggctaattttttttgtatttttagtagagatggggtttcaccgtgttagccaggatggtctcgatttcctgacctcgtgatctgcccgccttggcctcccaaagtgctgggattacaggcgtgagccaccacgcccggagtttttttttttttttttttaagagggaagtggggtttctctatgttgcccaggctggtcttgaatttctggcctcaagcgatcctcttgcctcggccttccaaagtgctgggattacaggtgtgagccaccacacctggccaattcagtcttaaaccaattttctgaggcttcgttttggcaaggctacttatctgttttaaaaataaacgatgtattttagtaaaagaaaaaaaatggaggaaaaaacagggttttgatctcatggaataattatgaggctaatctaatgagcttcataaaatactatacccatacatagtatgcttgttattttattgttttgtcagggtccagagaactaggccactgtgttgcttaggcaccgtgtctgcacatagttcattccggtgtacattcattcatctttacactagaatgttagtttcaagaactcagtcacctcgtctacactgtcctttaatccccaatacctgcgacagttcctggggcaaaaacaaatgcttgttgaattaaaaagaaaaactgggccgggcgtggtggctcacgcctgtaatcccagcacttcgggaggccgaggcaggcggatcacctgaggtcaggagttcgagaccagcctaacatggtgaaaccccgtctctactaaaaatacaaaaacattagccgggtgtagtggtgggtgcctgtaatcccagctacttgggaggctgaggcaggagaatcgcttgaagccgggaggcggaggttgcagtgagccgagatcacgccattgcaccccaacctgggtaacagagcgacactctgtctcaaaaaaaaaaaaaaattcctgtagaagctcccaagcccaattaaagctcaaggctatcgtccacgtagtgggttccaaatcgctaagttcccaggccagcagggagagcgagccgagcgaaggtcgcctgtgtcaaaggcggggatttgcacagtatttacatggaagcggaggaaaggctgcttagcaaccgggctgaggggacgggctgcactgcgcacgcgtacatgggcggggcatcttgcgcatgcgcaggcgacagctcatggcgttcagggcctgacggttgctagggtgacagggacacaacatggcggcgggatctctaacgctctccttcgagggaccaccacggagatcctagtgcgggaccccgcctcagggaagtggaaagcagggggacaaccttcctgcttctttcttttccgtccagtgtcggcaaggggttgtcaccggcttccgcatccaagatgaagagtgagtggggccggggaaaggggcagggactggagagcgagtggcgggggagggagggactgggggagcttgaggagcttgaggggcctgtggggccgggcgtcgtcgccttctgccgtggctcgacaggcccgggaggctccgcatgtgggccccgaatccccctcggctgtgagaagccggtgcccctgggggaagcttgaggggttggggctaggttgggaactttggggtctcggagagccgactcgagttcccgctcaggcatattttggtgcaggtgcgtggttcttacattggagtttagggagttgactgtgattcattttattttattttaaatgctggcttgaacctgacactcttttcctgaacattcggcagaaaacgggggagcgcttacagcgtggctccctgccttttcatgatactggtttagtgaccaattgagaggaaagctgggctgtgtgctttattttattttttgggtcaagcagtagtgttttataggaaccactttttaatagtagttttgaagcaaccttttagttaaaagctgttacttcaaagttgggaaatgaggtagtcattctagaaaatgtaacgggtaaaaaattttctttagtgggatttgtggattattgacaatccaagtgcaaccagctagaatgatgtttttaaaattattattactgtacagatataattgtttatggttgtgaaccagaggtgcagtaaaaattcagacctttgctgtgaaaatattatgttaggagtagttataatgttaaatttgcattgtatcctaattgtcaatggtgtacattgcataacatttaaaataattaatctcattcaccctttacaaggcatttttatttttattttattttgttggatattgtttaatgtttacctttttcattaatgcactacaaagctgtagttagaatccaaggtctacaaaagactttacacttttacttacagtgcagactatgatactgcacatattttgtactatattcatttttttcttcccatctgtttgttttgaaaattttcagatgtacaggaaagttgcaagagcagtacattgaatatttataaacccgtccttcacttagctgcaccattttgccttatttttgtgtgctcgctttcgctctggtgttttctctctcccatttatgtatttattttcactggacctttcaagagttagttgtagactactaataattcaccacttctttcagcagttatctgccaagaacaaggacattctcctacatcatcacagtacaaataacacatttagaaaatttaacaatgatacaatactctgatacacagtccatatttcagtttttccatttatcccaataacatgtgttatagttgtttatattttttctatccaatcaagaatcaccaattgtattctgttgtcatatctctttggtctcttttaatatggtgtccctgccttttgtgtctttcatgacaatgatattttcatttttatttggctgtcctctgtaggccaaatgacatttttaaagaatccagcccagtgttttgcagaatatcgctcaatttggatttgtctgattttcgcctcatgattagcttcagcttaaatgtttttaccaggaatatgtgagaggcaacgttgtgtctctgtcagtgtggcccttccagagtgcctgatgtcagttcgttgcagttttgctgaagttagatttgatcatttggtttatttatctaccttctttttctcttagactctttttttttttggacagggtctctctgtgtcaccctggctggagtgcagtggtgcaatcttggctcactgcaacctctgcctcccgggttcaagtgattctcctacctcagcctcccaagtagctgagattacaggtgtgcaccaccacgcccagctaacttgtattttttggtagagacggggtttcaacatgttggccaggctggtctcaaactcctgacgtcaagcgatccacccgcctcagcctcccaaagtgttggaattacagacgcgagccactgtgcctggccttcctcttagactcttcataccccactacctagaggcatcactttcagtaatttactctctatatatatattatatataaatatataaatgtgtatttctccctttttaaaagactaatgttagcactgcatgtgtatacctatatagaaatatgtacatatgctgcctgggcgcagtggctcacacctgtaatgccaacactttgggaggccgaggcgggcagatcacgagttcaggagatcaataccatcccagctaacacggtgaaaccccggctctactaaaaatacaaaaaattagccaggcgtggtggtgggcacctgtagtcccagctactcgggaggctgaggcaggagaatggcgtggacctgggaggcagagcttgcagtgagctgagatcgggccactgtactgcagcctgggcaacaaagcaagagactccgtctcaaaaaaaaagaaaataaatatgtatatatgcgtatatatatataaaatttacatttgtgggccgggtgcagtggctcacgcctgtaatcccagcactttgagaggctgaggtgggtggatcacttgaggtcaggagttcgagaccagcctggtcaacatggtgaaaccccgtctctactaaaaatacaaaaattagtcaggcgtggtggcaggtgcctgtaatcccagctacttgggaggctgaggcaggggaatcgcttgaacctgggaggggggcgttgcagtgagctgagatcgcactactgcactccagcctgggcaacagagcaaaaaaaaaaaaaaaagtatatgtgtgtatacatataaaatttacatttatggggcgggtgcagtggctcacgcctgtaatcccagcacttcgggacgccgaggttggctgatcacttgaggtcaggagttcgagaccagcctggccaatgtggtgaaaccccatctcaaccaaaaaatacaagaaaaaaaaaatcaaaacaaaacaaaatacacaaaaaatgtacatttatgatttacttcttgtaaacttttgtttttaaagtatatttagtattgtttggtatgttcttttagatggtcattttggtagttttcggttacttggtttagtggtgacatctttattctccctttcttccttctaccttaaaatgtactctaagaattattgtaaccttttatccccctggtttacatcctgatcattaaataaatgatttaaaaatagttaacaatggagagaatattccagaactggaaatcacagagacagagttatagaagtagaatgatcaggaaaagtgagtaatggtgaaattggatccatagcttggggtcagagtggggctgggaatgctagattattacaggggtctgtcaggattttctaggtatatttttgtacttgttttctaggtgatgccctgtgtttaggggtgtgttattctgtggagtattcctgtccttctttttatttggcatcgtttgcaacagtagagagcaaagagtgacacagtgcagttgataagagcgtgggctttggaaccgggtgggcatggcagcttcaggcatgttactttttcttatactgcttttcttcattgttccggttatctattgctgcgtaacagatcacttcaattttgtggcttaaaggaacaacagtccttcttgtggttcttcaggttgcctggattcaactaggcaggtcttactggaagtctctcatgcactcagatggtggctggagctgaagtcatcttaaaagtttgttttttattttgagatggagtctcactctgttggccaggctggaatgagtacagtggcacaatcttggctcactgcaacctctgcctcctgggttcaagcgattctcctgtctcagcctcctgagtagctgggattttaggcgcaccaccacacctggctaatttttatattttgagtagagacggggtttcaccatgttgttcaggctggtcaagaactcctgacctcaggtgatccacctgccttggccttccaaaatgctgagattacaggtgtgagccagtgtgcccagcccacattcatctttaaacagggatgataataccaatcacatagcattgtttcaaagattaagtgaaatcatctatataaagctcatagcacagtgtctgatacatgataaattgtgaatgaattattatttgctatttcagcagatggaaggcagggatataaaaagggaaagaatgaaaacatcagtcagatcctgacttggaaaagtttccccttatctagtctagttaaagtaccactcttttttcctgtctgaactttcttttttgtttgagatagagtctgttgcccaggctggagtgctgtggtgtagccacagctcacgacagcctccatctcctgggctcaggcaatcctcccacctcagcctcctgagtagttaggaccacaggcatgtgcctcctcgcccagctaatttttttttttttttggtggagatggggttttgctgtgttgcccagcccaggctttttttttttttttttttttttgagatagagttttgccctgttgcctaggctggagtccaatggcgcgatctcggctcactgcaacctccacctcccgggttcaagtgattcttctgcctcagcttcccaaatagctgggattacaggtgcctgccaacatacctggctaagttttgtatttttagtagagatcgggtttcaccatgctggccaggctggtctcgaactcctgacctcaggcaatctgcccgccttggcctcccaaagtgctgggattatatgcatgagccactgtgcccggctccccggcttaagtttttaattgtttactagagatgggggtctccctatattgcccaggccggtcttgaactcctggattataggcatgagccactgtgcctggtcctgtctcaactttttaatgaattattcaaaacatacctataaaaagagaaaagtggccaggcatggtggctcatgtctgtaaacccagcacttcgagaggctgaggcaagagattgcttaaatccaggagtctgagaccagcctgggcaacatgacgagactctgtctctactaaatttaaaaattggccaagcatggcagtgcatgcctgtggtctcaggtactcgggaggctgagggaggagcattgcttgaacccaggagtttgaggctgtagtgagctgggatcacaccactgctctccagcctggatgtcaaaggaagaccctgtttcaaaaaaataaaacaaaaacccagagaagttacactctgaagacggtaacagtttgctattgtatcagagagaatttttctttttttttttgtaggtagtctcactctgttgcccaggctggagtgcagtggtatgatcttggctcgctgcaacctctgcctccagggttcaagcaattctcatgcatcagcctcccgagtagctgggatttataggtgcaaaccaccacacctggttaatttttgtagttttagtaaagatggggtttcaccatgttggccaggttggtctcgaactcctgacctcaggtgatctgcccgcctcggcctcccaaagtgctgggattacaggcgtgagccactgcgtccggcccagagagaatttttaaaagtatctgttgtaattacaatgaggtttaaactgtctttttttttttccgccatggaaagagtcaagtaatttgtctttcttaaatgctggtgtgtccgcagttggtgggttcttggtctcactgacttcaagaactaaacctcagaccctcacggtgagtgttacagttcttaaaagcagtgtgtctggagtttgttccttctgaagttcagatgtgttgagagtttcttccttctggtgggttcgtggtctcactggcttcaggagtgaagctgcagaccttcgcggtgagtgttatcgctctgaaggcggcgcatctggacttgttcattcctcctggtgggttcgtggtcttgctggcctcaggagagaagctacagacctttgcagtgagtgttgcagctcataaaagcagcctggacccaaagagtgagtagcagcaagatttattttaaagggtgaaagaacaaagcttccacattgtggaaggggactggagcatgttgccactgctggcttgggcagcctgcttttattctcttatctggcaccacccacatcctgctgattggtccattttacagagagccaattggtctgttttacagagagctgattggtccgttttgacagggtgctgattggtgcgtttacaatccctgagctagacacaaaagttctccaagtccccgtgagatcagctagacacagagcactgattggtgcatttgcaaaccttgagctagatacagggtgctgattggtgtgtttacaaactttgagctagatacagagtgctgattggtgtatttacaaaccgtgagctagatacagggtgctgattggtgtgtttacaaactttgagctagacacagagtactgattggtgtatttacaatcccttagctagacataaaggttctgcaagtccccaccagattagctagatacagagtgctgattggtgcatttacaaaccttgagctagacacagagtgctgattggtgtatttacaatcccttagttagacataaaggttctctaagtccccactagactcaggagcccagctggcttcacctagtggatcccacaccagggctgcaggtggagctgcccgccagtcccacaccatgtgcctgcacccctcagcccttgggcagttgatgggactgggcaccctggagcagggggcggtgctcctcggggaggcttgggctgcgcaggagcccacagcgggggttgggaggctcaggcatggcgggatgcaggtctgaagccctgcctcgtgggtagcagctgaggcccagaaagaatttgagcacaggcagggccggtgggccggcactgcagggtatccggtgcaccctcagcagctgctggcccgggtgctaaacccgtcactgcccggggccagcagcaccagctggccgcacctagtgcggggcccgctgagcccacacccacccagaactcatgctggcccgcaagcaccacgtgcagccccggttcccgcctgcacctctccctccacacctcgcggtgcctcttcctccacacctccccgcaagctgagggagccggctctggccccggccagcccagggaggggctcccacagtgcagcggcgagctgaagggctcctcaagcgtggccagagtgggcaccgaggccgaggaggtgccgagagccagcgagggcttcaagggctgccagcacgctatcacctctcactagtattttcatggaatcaaaaaaggtacctcaaataatccttttcatctccttctgtgagcatcaatttttgtttttattttatttgtttatttatttgttattgttattattatttttgagacggagtcttgcagtgtggaccaggctggagtgcagtgacgtaatcttggctcactgtgagctccgcctcctgggttcatgccattctcctgcctcagcctccagagtagctgggactacaggcgcccgccaccacaccctgctaatttttttatacttttagtagagatggggtttcaccgtgttagccaggatggtcttgatctcctgacctcgtgatctgcccaccttggcctcccaaagtgctggtattacaggcgtgagtcaccgtgcccagcctatttattattattttttgagacagagtctcgctgtgttgcccaggctggagtgcagtggtgtgatttcagctcactgcaacctctgcctcctgggttcaaggtattctcccacctcagcctcccaagtagatgggactacaagtgtctgccaccacgcctgggtaatttttgtatttttagtagagacagggtttcaccatattggccaggcttgtctcgatctcctgaccttgtgatccacctgcctcagcctcccaaagtgctgggattacaggtgtgagccattttattttacttatttattattattatttttttagagatgagggtctcaccatgttgcctagactggtctcaaaatcctgggatctggtggtcctcctgtctcggcctcccaatatgttggaattacagctgtgcctggccactttctgtttttataagtagatgcattatctagcaactgtttctcttgaaataaaaacaaaatgaggtaaacttaatactggctttgtgataaatccaaaccatagaaggttttgagttagcctcaggaccttcccctatttgccacagtaaatcctggttaacattgtcttagatggacattcatacattttctatgcatatttttgtgtatatacacacaagttttatatattggtgtgtgtgtatatacatataaatatatggttgttccttacccaaaatcaaatgggattacattaaatatgttgtattgtagcttgtaggatgatgcatctatgaagatgcttgaacatagttttttttttgtaatagatcttgctattttttttttttttttttgagacgtactctcagtctgttgcccaggctggagtgcagtggcgtgattttggctcactgtactctccaccttctgggttcaagcgattctcctgcctcagccttccaggtagctgagattacaggcaggcaccaccacgcctggctaatttttgtatttttagtagagactcggtttcaccatattggccaggctggtcttgaactcctgacctcaggtgatcgacccgtcttggtctcccaaagtgctgggattacaggcatgagccactatgcctagccaggtgttgctatgttgaccaggctggtcatgaactcctgatctgaagtgatcctcccatcttgcactcccaaagtgttaggattacagatgtgagccatcacgcccagtccagaacatagatctttgaataattcttcaagtttattaacagtggacttactgggttaataggtgtaatttcaattttaaaattttaagaatttttgaatagttttgtgttcttttctgttttcacaatgtttagtaattcaggtcataattttcctcactatatcaaataattaattgtgtacagctcctcttcactgaagcttcctgaccttgttttagtaatttggtttgaactgtttaatctctcgaagagaatggaaattagtaagaagctgaaatcttcttcctcgcatactctagttgtagtcagcaattaacctcccccaattcttttcctccctctactggtgaagccccatagctctgatgcctgtcacccaccctgattaagaactttataaacagcacatgaataaaaatgtttggacttgaacgtgacaagttttgcatttcacaaaaagtgaatttgaccttcattttcacttgttaaataaggcttaaattccacttcaacaaacaagccttggtttaataaatgtgcatagaatcttaatacagaggtattcatttatctcccttgttctccctttttcatccagctctgttattttaacccctttgtccttgagtctgtttttctttttgttttggtgcttgtttactctattcccaataatgtggggcatgacgttcatttacagtatcatagctctgttcccttcagagctttgtatcatgctttgtctgcatttcagtgtttcttgtttaattttgaaggcctatgaaaatacgccagatcttgttggagagaacaggaacttttcccaggaattttttcatagaggtggtttcttttttaatccctgcctcttatccttgttttataccccatactttctgcctactagaagagccatgagggaaacaagtgacccctttatctaccaacagacacctccagtgcggcaagttccatttattgctggttgtgatggtttcgagccagcctgggacattggcacacactgaatttgtgtgctgaaaccactttacagttcacagttgacctattttttttaaagcaagtctgcttaatttatctgtgatgaaacacaaattggaattgattgtgtaaattccctcttctcttaaatctgaattccttagtccacagcttgactttgagtgattgacctccaatccctcctttgattttcttttttttttctttttgagacaaggtctctcgctgtctgtcactcaggctggagtacagtggcaccatcatggctcactgcagccttgacttcccgggctcagaggattctcctatctcagcctcccaagtggccggggctacaggcacgcatcacgatgcctggctaattttttttttttttttttttgagacggagtctcgctctatcaccctggctggagtgcagtggcgctatctcggctcactgccagctccgcctcccgggttcatgccattttcctgcctcagcctcccgagtagctgggactacacgtgcccaccaccacgcctggctaattttttgtatttttagtagagacggggtttcaccatgttagccaggatggtgttgatctcctgaccttgtgatccgcccgccttggcctcccaaagtgctgggattacaggcatgagccaccgcacccggcctcacctggctaatttttttgtatttttggtagagacaagatttcaccatgttacccaggctggtctcaaactcctgggatcaggtgatccgcctgcctaagcctcccagagtgctgggattacaggcatgagccaccacacctggccccttcccgtgatctttatgactgtcttcctttaaaaggatattgtagttttaagacagttcattttaagttcatgtttttcgtggcacttagccaacactttcactgatttcttaaaattcttgaaatgttcacctttacacacatttaaagtaatgtgtattcattgcgaacattgagtaatgtagataattataatgaagaaaatttaaatcaccttcagtcccactcagatacattaaaaaaattacatatttatattcagtctttttcttttttttcttttcttttccttttttttttttttttttttttttgtgatggagtttcgctcttgttgcccaggctggagtgcaatggtgctatgatcttggctcaccgcaacctccgcctcctgggttcaagtgattctcctgcctcagcctcccgagtagctgggattacaggcatgcaccaccacacctggctaattttgtatttttagtagagacagggtttctccatgttggtcatgctggtctcgaactcctgacctcaggtgatccgcctgcctcagcctcccaaagtgctgggattacaggcgtgagccaccgcacccagctgtattcagtctttctctgtgcatgtgttgtgtgtatgatcattatcatcctttttttcacttaacatgaaattatggctgaacattttcccatgtcatgaaatattatttgaaagcatcgttatcaatggttacataatatttcagtctgtggctatttcatagtttgttagaacatttccttgatactggatatttaagtttctggcattcttacttttgtgacactgtgaataccatctttgtttatgaagttttttgtttgttcatttgttttttgtttttgagatggaatctagctctgtcacccaggctggagtgcagtggcacaatctccgctcactgcaacctccgcctcccaggttcaagcgattcttatgcctcagccttgctagcagctgggattgcaggtgtgcgccaccctcctggcgaatttttgtatttttagtagagatggggtttcattatgttggccaggctggtttggaacccttgacctcaggtgatctgcccacctcagcctcacaaagtgctgggattacaggcatgagctaccacacccagcctcaatgtggctgttaatgtacagattcactcatatacaaattgaatggttttaatactaaaataatatttaattccccaagctttttttttttcctgttggtttttgtttctctaagtgtaatggcacaagagagaacagattgtggactttctatttaagaggtttatggctttatgaggagaaggtgcatagtggagcatgagcagttctgtaacaggaggacaaggtgcacacagaaggaagaaagacatctgcttgaaagcttcccaggccggtcctggaagattggaatccagagcaccatgtatttggtattacacactatgtactccataattagttgtttttttgttttgttttgttttgttttgttttttgagatggagtcttgctctgttgcccaggctagagtgcagtggtgctatctcggctcactgcaagctccacctcctgggttcacgccattctcctgcctcagcctcctgagtagctgggactacagctgtctgccaccatgcccggctaatttttcacatttttagtagagatggggtttcaccgtgttagccaggatggtctcgatctcctgaccttgtgatccacccgcctcagcctcccaaagtgctaggattacaggcatgagccaccgcacccggcctatgtactccataatttgaccattgatattttctaaacaaaaatgttccatttcctccctccctcttttataaggaaaggacctaaaattaggggtatagggacatactgtaaattctcaagactagggattacgtcttaatgatatttgtgtctacagtgcatggcacagtgtgtggtatatagctggtgctaagaagtctttattattattattgttagtttttttttttttgagacagagttttgctctgttgcccaggcttcagtacagtggcgtgatctcggctcactgcaacctccgcctcccaggttcagacagttcttctgtctcagcctcccaagtagctgggattacaggcacaggccaccatgcctggaaaattttttgtatttttagtagagatggggtttcaccatgttggccaggctggtctcaaactcccgatctgaggtgatctgcccaccttggcctcccaaagtgctgggattacaggtgtgagccaccgcacttggctgcaagcagacctttctaaggagagaagtcccaggcctgctgtgtgagctcttctgcacaatgaagacactgatcttcttgtagagaaatttctgggctttccagtttaattcatttaagagaaggggtaaattttggtggtgttttagcaagcaacagctatcccttgactagtatgaacagggcctggtaggtcagtatgagggtctgcttgagggcagaagatgtttaggctgttgaattttcccacaaagtttcaagtttggaggctcctcaagaaacttgtcaaaattacttaatgaggttttaaactgtacaaattagtggtcagggccagggcctgtattttggtccatttcttttgcagaagcttcttggagatgcaccaaagaatctttattgcctggttttaggatttaatggaatttaattaggtttccagttgtagagaggctctgggacttagttaagctatagttgtcaagcaagttatggcttccggttttttgtcagaagggatatggtaccgtgctctgtcctgaagcctcagcggggctcactcctgccttacattagccagtttctcccagaaggcaagtgagaacaataaagctagcagaatagttctgaaaccctgccttgctgggagctagattagttcctcttttattcagggaaaacttggataaaagggattctaatagcatagtttgaagatcttcggtttggggatctagagcggtgctgggggatgttaactggtgttctctggttgtatctcacacccctctcatataccccacctccatttggagactcatctcatatgcagggaaaggcattgaggaattctgcaaacacattttgccgtatttaactctgtatttcctaaatttatttgcttatggaaccctcttttgtggaatacccattagggttcagggatcctcgtgttttgtagtactcagtttggaaaatgctagtctggagattcagcatcctcaggttgtttttcctggaagtggtaatggagagcagcccttcctggtgcagtaggccacctttcttttgctcataacacagaccagttgtgacacttggctctgtctcaggctgtgacttttaatataccgatttacttatacacaaattgaatggttaatgttccattccccaagccttttttgttcatttttactattttttttgtttgtttgtttctctcttttttttttgagactgagttttgctcttgttgcccaggctggagtgcagtggcgtgatctcggctcaccgcaacctcctcctcttgggttcaagcgattcgcctgcctcagccttcctgagtagctgggattagaggcatgcaccaccacacccggctaattttgtatttttagtagagatggggtttttccatgttggtcaggctggtcttgaactcccgacctcagatgatctgcccacctcggccttccaaagtgctgggattataggcgtgagccaccatacctagtcttttttttttttttctctaagtgtaatgcattttatctcctgcttcttgtaagtttccaggaccaagtaatactcaaacccttcccagagggttttcatttcgaacaaggaagccacctgggaaatagggtggagacctgttttgagaaaccagaagaggatgtctcgttctaaccatggagaaaaagaatctagtctccttgttaggaagactgttgaagaagtgttctttatcctttagttcttattaagagaattgttttagtttcaattgtaaggaccagtaaatctccttacacctcacagtatggagacatattattataactgttgacaaagaaggagcttgagggctgggtgcagtggctcacgcctataatcccagcactttgggagggtgaggcgggtgggaagctgaggcgggtggattacctgaggttaggagttcgagaccagcctggccaacatggtgaaaccccatctctactaaaaatacaaaaattagcttggtatggtggcacacacctgtaatcccagctacttgggaggctgaggcacgagaatctcttgaacttggaagatggaggttgtagtgagccgagatcacttgggcaacacagtgagactctgtctcaaaataaaataaaataaaataaaaataaaaaacaggagcttaaaaataggaaaacccgagagcaggagggaattggccctcttaggaactagaatagtattgaaagcagattgttttgcaccttagcagtagggatttgtagacgtgcatattctgccattaatgagatttctcagtctgtgtttctttgtgattttccctgtatatacttttactgtgtatcatttctgttccttatactctctgcttattcctaactctgttttttttttctgattttattttggagtataacataatacagaaaactgcacaaattggccaagcgcagtggctcgtgcctgtaatcccagcactttgggaggccaagacgggcggatcacttgtgctgaggagtttgagaccagcctgggcaacatggtgaaatcctgtctctacaaaaaatacaaaacaattagctgggcatggtggcgggtgcctgtagtcccagctactcagaaggctgaggtgggatgatcgcttgagcctaggaggtggaggttgcagtgagccgaggttgcaccactgctctccagcctgggcaacggagtgagaccctgtctcaaaacaaaacaaaacaaaacaaagctgcacttacatttaagtatacaagttggtgaagtgaacatgccaatgaaacctgcttccagatcaagaagcagagtgttactggtatcatgggtgtccccttcagcccattctggtcacttcaccccacaagggtaaccactttctgatttccaacaccacagagttgtctgttttaatggagttattgaaatatacatactataacgttcactcatttaaagtatactgctcagtgattttaagtatattttctgagttgtgtaactataactataatctaatgttaaaatattttcatcatccccaaaagaaacctgtaccccaaaagaaataaggagtggttactcctttatcccacattccaccagccctaggcaattacaaatctatttcctgcctctatagatttgcttattctggacatttcatataagtgggatcacataatatgtggcattttgtgcctgatttctttcacttagcataatgtcctcaaggctcatccatgctgtagcatgtatcagtacttcattccttttcatggctgagtaatattccattgtatggatagaccacattttgtttatccgttcatctcctgatggacatttggatgctttccacctttcagatattatgaataatgctactgtgaacattcacttacaggtttttgtttggacatacgtttttgtttctcttaggcatatatgtaggagtggaattgctgggtcatatggtaactctgtttaacatctcaggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtaatcccagctactcgggaggctgaggcaggagaatggcgtgaacccgggaagcggagagcttgcagtgagccgagattgcgccactgcagtccgcagtccggcctgggcgacagagcaagactccgtctcaaaaaaaaaaaaaaaaaaaaaaatctcaaagaactggctaaactgtttttcatagtgtctgcaccattttccattcctgccagcaatgtatgagggtcccaatttctccacatcctcaccaacacttgttattatctatgtttttgattctagtgagtgtgaagtggtatctcatcatagttttaacttgcttttccctaatgactgatgatgttgagcatcatttcatagcttattggtcatttttatgtcttctttggagaaatatctgtcaaatcttttgatcaccttttagttggattgtctttgtattgagttataagacttatttatatattctagatataagtttcttatcagatatatagcgctgccatgctcagctaatttttatatttttagtacgatggggtttcatcatcttggtcaggctggcctggtcttgaactcctgacctcgtgatctgcccgtctcggcctcccaaagtgctgggattacaggcatgtgccactgtgcctggccaagttttgtatttgtagtagagatggagtttcgccatgttggccaggctggtctcgaactcctgacctcaggtaatctgcctgcttcggcttcccaaagtgctgggatgacaggcgtgagccaccacgcccactgaaccctcataaatccatcaccgaatttcagcagtgatcagcattttaccattttccccaccaccatcttttctgggggaggagtatttagtttttgttattttgaaataaaacagtgaaaatcatgctcttatttcaaaaaacaacattgtggaaaatatctaacttagaaaatgagacacctgtaacctcagacagagccagtattaattctgtgtgtgtgtatagtttttaaggacattattattattattattattattattattattatttttgagacggagtctcactttgttgcccaggctggagtggagtggcgcaatctcagcttactgcaacctccacttccctggttgaagtgattctcctgcgtcagcctctcaaatagttgggactacaggcacctgccacccattattttaaatatttacagtatattccgttatacaggtaaaccatattaatccagtttcctatgggggccatttgggttatcagctttactgtattgattaatggtgcaatcattaatcttcctgtcatatgtacttgagcaagttatttttttttcttttagacagggtctccctctgtcgcccaggctagcgtatagtagtgcgatccctactcactgcagcctcaaactcctgggctcaagtggttctcccacttcagcctcctgagtagctgggatgacaggcgtgtgccattgagtctggctaattattttttgtagagacggggtctatgttgcccaacttggccttgaactcctgggctcaagtgatcctcaccttggcctcccaaagtgctgggattacaggcgtgagccactgcgcccggccggaggatgcacatctttttttttttttttttttttttttttgagacggagtctcgctctgtcgcccaggctggagtgcagtggcgcgatctcggctcactgcaggctccgcctcctgggttcacgccattctcctgcctcagcctcccgagtagctgggactacaggcacccgccaccacgcccggctaattttttgtatttttagtagagacggggtttcaccgtgttagccaggatggtctcgatcttctgacctcgtgatccgcccgcctcggcctcccaaagtgctgggattacaggcgtgagccaccgcgcccggcccggatgcacatcttaaagatttaatagctgctgccaaattgccctccaaagagactatgccagtttataatttcagcagtagtgaatgggaatgtacaggggtattgtattttattttattttttgagacagagttttgctcttgtcccccaagctggagtgcagtggtgcgatcttggctcactgcaacctctgccttccgggtttgagcaattcttctacctcagcctcccaagtagctgggattacaggtgcgcaccatcacatccagctaatttttgtatttttagtagagacgtggtttcaccatgttgtccagactggtctcgaactcctggcctcaagtgatccaccgacctgggtctcccaaagtgctgggattacaggtgtgagccggccagggatattttaaagtaaattccaattattgtatcattttcacctggaaatacttctgtatttcttgctaacagataaggacattttttgtgttttgacataaccgttatcacttctgaaaaatgagtacctttttaccgatggtttgttcaaatcagaattcagacaaggcatttgaaatgtgcatgtggaaaggaatactgaagaggatgcccaccttcagcgctgcagttttgaaaacctgtgaattgggtgcagtggctcatgctagccacttgggaggctgaggtagaagtttaggcttgagcccaggagtttgaggccagcctgggcaacatagcaagaccccatctgctttgtgcaggtgcaggtttggggcctgaagtgaaggcctcttttactctaggcttgtttctgccacaatctaagtgatgtttaaagatttctggtctgtttgcttctggtcagttccacacccaaggttctcttctagatctagttctcaagcctgcattttctttttttttttttttttttgagatggcatctcactctgtagcccaggctggagtgcagtagtgtgatcttggctcactgcaacttccacctcctgggttcgagggattctcctgccccaccctcccaagtggccgggactacaggtgcatgccaccacgcctggctaattttttgtatttttagtagagacagggttttggcatgttggccaggctggtctggaactcctgacctcaggtgggtgatctgcctgcctcggcctcctaaagtgcagggattacaggcgtgagccaccgcgcctggccccaagcctgccttatttctttgtggcctcgctcatatgcctctgggtctcaatttgtaggagcttccttgaagctttctgaaacaaatgcccagagattgtaacagccttcctgtgatctctgccgcaaagatgagccatttgttcaatggagaaggctcacagaccgttctctgccaatgttgttgcagtcttactctcctattatttgggctgtagaaacttttacaactggtgagacttttgctctctagattttacttattccttccatttctgcttgaaaagtggtatagccattcttgcctgtacttatctttgtcttgaaatagcttgttaaggcagtcagtagtaattagcgtactccatcattctgactcttcccaccactttccttaggccagcaggctcagcggacactgggtccatgaaaggcagcagtgagtgcaggcattcctttaagtgggcgatatttcatcatgatatgccaggctctctagcattttgccacctgaccaataagccaaactaacatattttagacttttgttcacagcagcaccccacatcaaggtgctcatttgttgtcagtcagggtttggtcaggaaaatggaaactaccctaggtatcaagcaggaaggcatttaacatagtgatctagaggcttccaaaaccattatcagggctggggtgatgtggtggcagcacacccagggaaagttgctgttagctttcagaaaattaggaagtgcaagaattgtaggaaactgttgcggatcagctgggccctctataggaccagggaaggtcaatttcaggagggtccttagaggctgctgctgcaatatgacatcagcccagagcctaagctcatgcccatgcccacccctgctggaagaatcccacgtctgctgctcctctatcttctgaatcttgtagggtagctgagcctctcctcactggccaggatccaggtaaggtggttcctgctatacaagggagggcacagactggaaggaaatgatgctttgttccagcttcccctaaagttgaggggaccactaaatcttacaaagataggagaaacaattctcagtatattgctgtttaaattatcttatagattaaaagtttgctgtctggaagtgaatacaagtgtatgcataaataacattttatttttgtaatcatttttatttatagactataaagcaattggcaaaataggagagggaacgttttctgaagttatgaagatgcaaagcctgagagatggaaactactatgcatgtaaacaaatgaagcagcgctttgaaaggtaggctacagagatgcacttgggaccaaacacagatccaagtttcagtcaataacggcaacttaatattaggggggagctttattaatttaataatatgtaagatacaatcagatttctttgggcagtgagggttatatgctaatgttatgtttatcatactggagtttactcatatccaggcttactgtaatatcagtgatgaatgaccacaaaaaagtttaagtttcaaaagtgtgtctcaccttaaacagtctgtatgttcctaaaagttataaatgtgttggatttcttttttttttaattaaaaaaaacagcaaaaaaatgatatatcaaccaatggaacaggatagagagctcggaagtgaaccctttatgatccatttgattttatgatccattgatttttttttttttttttttggagacagagtctcactctgtctcccaggctggagtgcagtggcacaatcttgactcattgcaacctccgccaccccagttcaagcgattctcgtgacttagcctcctagtagctgcaactgcaggcatgtgccaccaagcccggctaattattattttttttaagtatagatcaggtttcaccacgttggccaggctggtcttgaactccttggcctcaagtgatccgcccgccttggccttccaaagtgctgggattacaggtgtgagccactgtgcctagcccattgattttgtttgtttttgtgttttgttttgtttgagacagggtctcactctgtcatccaggctggagtgcaatggctcgatcttggctcactgcagcctccacctcccaggcttaagtgatcttcccacctcagtctcctgagtagctgggaccacaggagcacaccacacgcctggctaatttttgtattttttatagagacggggcttcaccacgttgcccgtgctggtcttgaactcctgacctcaaggtatctgcctgccttagcctcacaaagggctgggattacaggcatgagccactgtgcctggctgtgtgttggacttctataaatgcaaccttagtctaaatgtattagaggtccttgcaatttaactaactgtgaataaattaatatattaatattatattaatataacataagtgacaggcatgagccaccatgcccaacctgagccatcacgctcagcctgagccactacacccagccttcattttttaattaattagttaacttttaaaatggagatgggatttcactgtgttgcccaagctgaccatgaactcccgggctcaagtgatccttctgcctcagcctcccaaagtgctggaattataggtgtgagccaccacacctggccaagaacagtaatttcatcctcatgacatctggatagggtagttatccttgtttcatatatgaggataggtgcttagagatgtgaggtaatttgacattttttctagattactgggtgggcagagccagatgtgaacccagattctgctaaggcaaatccttgttcttcactgcccaatgcatatggtagtttacctaccactaggaagactgaagccaccaggtgttctgctccttctcttctagcacttcttcctctctatgcattctgcattctctgtgtttctttatctttccccgactccatctttacttgtaaaccactgatgagagaggatttgatgcacagtatactgattatcccgtatctaaagagcagacagctgggtgctgtggctcacacctgaaattccagctacttgggaggctgaggcaggaggattgctagagcacaggagttcaagatcagcctgggcaacatagcaagaccccatctctacaaaaattaaaaaaaaaacacaaaaaaacagacttccttaaacagccacctttgacccaaagttgccagtacaggattttgaacagtagggtgtgatgcttttttttttcttttttttttttttttttgagtcagggtctcattctgttgcccaggctagagtgcagtggtgtgatctcagctcactacaacctctgcttccagggctcaagcgattatccagcctcagcctcatgagtaacagggactacaggtgcaagccaccaaatgcctagataatttttgtaatttttttttttttttgagacagagtctcgcattgtcacctaggctggagagcagtggcgtgatcttggctcactgcaacctctgcctcccaggttcaagcaattctcctgcctcagcctcccgagtatctgggactacaggcgtgcgtcacagcactcggctaatttttgtatttttagtagagatggggtttcaccatgttggccaggctggtctcagactcctgacctcaagtgatctgcccaccttggcctcccaaagtgcagggattacaggtgtgagccaccatgcccagcctaatttttgtatttttgtagagacagggtctcgccatattgcggctggtctcgaactcctgagctcaaagcgatccacttgccttggcctcccaaagtgctaggattacagtcctgggtccagcctctatcagataagtttagaatgttctaaggagcagttctctagcgggtgaagaacgctcagtttattgaagttctttctcatgcctcctcagcccctgggaagattgtgtggttacgtaacggacatggtttcccggtgatgaagcacatcctgggtctgccatctgccagattcctcacacaccaaaagtgcctggtccaccagaatcttggcttccttgtcatagtgcttgacgactaagcaaaggaatgaacagaaagctaacaaggtgggacacatggcaaatgtgcagtggatgctggccttccttactgtatgcagaatcattcgttgtatttcagaaacaatttatgttctttgcctttaacttcaaaagcagttgattagaacacatcccacaggttggcccagcatggtggctcatgccttgtaatcccagcacgttggaaggcctaggtgggagaattgcttgagcccaggagtttgagaccagcccaggcaacaaagagaaactctgcctccatgaaaaaattttaaaaatcagccgggcgcggtagtgtgtgcctgtggtcccatctacttgggaggctgaagtgggaggatctcttgaatccaggaaggtgatgctgcaatgagttgtgcttgtgccactgaactccagcctgggtgacagagtgagaccctgtctcactctgccttctttgacaaggaagccgaaattccgctggaccaggcacttttggtatgcgagggatttggcagaaagcagatccaggatgtacctcaccaccaggaaaccatgtccgttaggtaaccgcacacacgcaaaaatccgtttctgcttgcttatcattgtgtaagtgaatccccagagtcaccttgcacagttgtgtgggtggtgtgaggaatgtgaagcattagtagcagaaagtcatactgagtcacttgggcagcatgaggttggtatttggagcctctgacccctaccccctccagtattacttctgctcctttcctatgctttaattcaaatagaaacggatggcttttgcagtaatcttagttaatatgaagttaaagaaaggtaaaaaaatacacataatggattagtactgtggcagggagggcactttcactcctgagcattgtttgccttttgagtcactcaaggacttagttagggataaggaagttagttacttgcctgaggcctcaacagaactgagtcgttttgtatcttttctggtatatcctcagaattttcctccaccaatacttgccaaaagtacacaattaagaataggctctctttgggcacagtgggtctcacacctataatcccagcactttgggaggccaaggtgggcagatcagttgagcctggaagttaaagaccagcctgggcaacatggcaaaacccccgctctaccaaaaaaagaaataaaaaagttagctgggcatagtggtggtgcctgtagtcctagctactcaggagggtgaagtggggggattgcttgagtcctggaggttgcggttgaggttgcagtgagccatgattgtgccactgcactccagcctgggtgacagagcaagaccctgtctcaaacaacaacaacaacaacaacaacaacggttctcttgctatgcttttagtctatatttttcctatagaaatagaagaaatggagtgagtctcttaaaaaaaatccctagtcttggtatttgtaggatctccctttgtgccccgaggcagtgacattggcacaagtctgctaaacccggggttcagtgtagggttaccagctctgactctaaaggtcggaaccagcagctcctccattttagttcatgcaatcttggacaattccctaatttctccgtgcctctgtttctttctttatacaatggggataaccacagtatctaccccataagattgttgtgagggtcaaattaaataatgcagatgaagcacttagtgcagtgctggcacaccgtaataaagcaacttgctatgtaaatcagtttttccataacagataatacaagttagcagagcttgaagactattttggagatggacgtgagataataatagtaagattaccgcagttgttcactacatatctggtgtcatgaacagtactaggtgaattatatgcatgtgtcattgaatcctcactgcggccctgggaggaagatccattgttacatctttcagactagggaattgaaattcggagagatcaagttccccacctggcccgttgctacccaacctacacgtcgtggagctgactctgagcccaggtctgtataggtcctgagctggtgatcttcccaccgttcttcccagctgcagatgctgatgccaacgtcaggtctacatgtggtacatggtttttctcaagtcacacctctaagcagtcctcaaattacttttacaaaaacaaaaagtctgctgtgtaaggttataaatagaaacaaaggcaaggaatttattagtctctctaaaagcctttttttttttttttacttaaaagtataatatgaaaaacctcaagcatatacaaaatgaacagcagccctaggtatccagcagccagaatcaacatccctgctatttttatttaatctatacctccacccagtgtccttcctctacttgggctgctataacaaattatactgtattctgtctggcttaaacagcagacatttatttcttacagttctggagggtgataagtgcaagattaagatgctggcagacaggtctggtatctggcgagggcttgctttaggatttgcaggtggccctcttcttgctttgtcctcaaatgacagatagcagagagagagagagaggtcgcatgttctctagagtctttctggcatttcttcttagagccactaatgccatgtgctctaattacctctcaaaagccccacctcctcatatcatcccattgggggtttagggtttcaacgtatgaattttagaggacacaaacatgcaatctataacgttatacagttttttaaagtcaaaatttgtatatcttgaagtgcacattgtttatctgtacaattttggcaaatggatattctcgtgtaatcaagatgtagaacattactataaccctagaaagttcttcttgttccttttcagtttcccactgccatcccaggcaatcactagtatgtgctcttgtgtccacctcctttaactcagcatcatgtctttgagattcatcattactgttgttcagtagtttatctctttttttttttttttgagacggagtcttgctctgttgcccagcctggagtgcagtggcacaatctcagctcactgcaacctctgcctcccaggttcaagcagttctcctgcctcagcctcccaagtagctgggactacaggcctgtgccaccacacccagctaattgttatatttttagtagtgacggggtttcactggacaggctcgtcttgaactcctgacctcaggtgatccacccgcttcagcctcccaaagtgctgggattataggtgtgagcaactgcacctggccagtttatgcctctttaatgctgagcaacattcattacaatctgtgagtacaacacaatttctttatccattttcctgttaatggactttttgatagtttccagttttgggctaccatgaataaagctgcttatgaaattcgacttcttaggctgggtgtggtggcttgcttctgtaatcccagcactttgggaggctgaggcgtgaggattgcttgagcccaggaatttgagaccaggctggatgacatatagcctggtctgtatgtcgtatgaagaaagacttttagtatctttttttttcctctacaaaaaaaaaaaaaaaaaaagaccagggcatagtggctcactcctgtagtcctagctacttgagaggctgtgatgggagcgttgctgagcctaggaagttgaggctgcaatgagccatgatcacaccactgcactccagcctaggtgacagagcaagaccctgtctcagaaaaacaacaaaagaaatacagaaattctactggtgcatatttcattttttctttttctttttttttttttttgagacggagtttcgctcttgttgcccaggctggagggcactggcatgatctcagctcaccacaacctccgcctcctgggttcaagtgattctcctgcctcagcctccagagtagctgggattacaggcatgcaccatcacacccggctaattttttgtatgttttcattttttcttaggcagttacctagaaacagaatcactgggtcaaagggtaggtatatgtttaactttataagaaactgacaagccttttctcaaagtgattgtaactttttatttttttatttaatttaattaattaatttatttatttgagacagagtgtcgctctatcacccaggctggctatctcggctcaatgcaagctctgactcctgggttcacgccattctcttgcctcagcctcttgagtagctgggactacaggcgcccgccaccacgcccggctaattttttttttgtattttttagtagagatggggtttcaccatgttagccaggatggtctccatctcctgaccttgtgatccgcccacttcagcctcccaaagtgttgggattacaggcgtgagccaccacgcccggcctgtagctttttatattaccaccggcaaagaatgaaagttccagttgctccatattcccaccggcatttgatgttgttattcttttaagtttaagccattctgatgattgtgtggaattatctcatggtagttttagtttctacttccccgatgactaatgataaacacttgatcatgtacttattggccattcatgtatcttcatttatgaattgcctgtccaagtttttgtccctttaaaaatttagaccttaagaaacaagccatcctaagggagaaaaaaagaaaaaataattttaaaaattaggctgtttgcctttttattgaatttaggagttctttatatattctgtatagaagtcttttattaaatgtgttttgcaggtagtttctccaagtctgtggtttgcctatccattttctttatggcatctttccatgtgctgaagttttttaatgtcagtgaagtccaatttatggagttcttttgtggttattgttttttgttttctgtcttagaagaaatttttgtctacttctaggttgtgaatgtattctcctgtattttctcctgaaaaccttatcattttaactttttacatttaggtctgtgatccatcttttttttttttttttttttgagatggagtctcgctctgtcacccaggctggactgcagtggcgctatctctgctcactgcaagctccgcctcccaggttcactccattctcctgcctcagcctcccgagtagctgggaccgcaggcgcccaccaccacgcccggctaattttttgtatttttaatagagacggggtttcaccgtgttagccaggatggtctcgatctcctgacctcacagtccacccacctcggcctcccaaagtgctgggattacaggcgtgagccgccgtgcccggccaatccatcttaaattaatttttgtgaatggtgagcggtagggatcaagcatcagttttttcccccaaatgaatatccagttgttccagcatcatttgttaaaaaaagactttccttgccttcagtggattattttgtcaaaagctaattgactgtaaaagtataggtctgttttggactctctattctgtttcattgctctctttgactgtcattatgccaataccatactgttttgattaatgtagctcaacagtaagttttgaagtcagatactaaaagtctttcttcttctttttttttttttttgagacagagtctctttctgtcatgcaggctggagtgcagtggtgtcatctcggctcactgcaacctctgcctcctggtttcaagcaattctcctgcctcagcctcctgagtagctgggattacaggcacccaccaccatgcctggctaatttttgtatctttagttgagacagggtttcaccatgttggccaggctggtttcaaactcttgacctcaggtgatccgcctgcctcgtcctcccaaagtgctgggattacaggcgtgagttaccgtgcccggcctcttcatctttttaaagacagttttgcctactgtaggtcctctgtacatccacatacattttagaatcagctcaattttttttttctgtgaggattctaggaatatagctcatcaattctattaaaaaataaaaccagccgggcacagtttctcacgcctgtaatcccagcactttaggaggctgaaagtgggctgatcacttgagcccaggagttcaagaccagcctgaacaacatggtgaaaccccatctcgattgaaaataacaaaaattagccaagtgtagtgtcacacacctgtagtcgcagctgcttgggaggctgaggtgggaggattgcttgagcctgggaggtggaggcttcagtgagccaagatcatgcagctgcactccaacctgggtgacagagtgagaacctgtctcaaaaaaaaaaaaaaaatgcaggtacggtggctcacacctgtaatcccagcactttgggaggccgaggcgggcagatcatgaggtcaggaggtcaagaccatcctggctaaaaccatgaaaccccatctctactaaaaatacagaaaattagccgggtgtggtggcaggcgcctatagtcccagctactcaggaggctgaggcaggagaatggagtgaacccaggaggtggagcttgcagtgagtggagattgggccactgcactccagcctgggcgacagagtgagactctgtctcaaaaaagaaaaacaaaacaaaaaaaaactattgagattatgaataggattgtattgagtctatcgttcaatttgggagagaatgcatatcttagcaatattgaactttgcaattcataaacatggtataaccgtctctccatttatttcagtttgctttagtttcagctatgttttgtttttgtttttgagacggagttttgctcttgttgcccaggctggagtgcaatggcatgatctcagctcactgcaacctctgccttccgggttcacaggttctagagattctcctgcctcagcctgccaagtagctgggattacaggcacgtgtcaccatgcccagctaatttttgtatgtttagtagaagacagggttttgtcatgttggccaggctggtctcgaactcctgacttcaggtgatccgcccaccttggcctcgcaaagtgctcagattacaggtgtgagccaccttgcctggacggtttcagctgttttgtagtttcactgaaaaggtcttacgtgtcttttgttaaatttatatctaagtgttttatgttttataacattattataaaaggatattttaaacatttatttcccattgttagccataagtatgtagaaatgcaattaatttttgtttactttgtattttgagaaatttctcaggattcacttattttttttttttttttgttctagtatgttttggttgctttcttaggattttttacttaaagaaatatgtcacctgcaaatagagacagttttactcttctttcccaatgttgatgacttttttttttgagacggagttttgctctgttgcccatgctggagtgcagtggcgcgatctcagctcactgcaacctccacctcccgggttcaagtgattctcctgcctcagcctcccaagtagctgggactacaggcacccgccaccacgcctggcgaatttttgtattttaagtagagacagggtttaaccgtattggccaggctggtctcgaactcctgactttgtgatctgcccaccttggcctcccagagtgctgggattacaggcgtgagccactgtgcccggcccatgactttttttctagcctttcccattagttcagatttccagtacaatattgaatgcaagtagcggggaagtgttcagcatttcaacattagaagcatgatgtttgctgtatatgtcttttatcaaattgacagagttccctttcatgaatagcttgctgagaatttttgtcctgaattggtatcgaattctgtcaaatgactttttggtattattattttttcctttttcttgtattgtggtggataacattcattcatttttgaataataactcaaccttgcattcccagtatagctgggattccccacttagtcataacatatgatcagttttacatgttcctggatttgatagtattttgtcaagtatttttgtatttgtactcataagggatacttttttttttttcgtgatggagtcttgctgtgttgcacaggctggagtgtggtggcgtgatctcggctcactgcaacctccgcctcaagcaattctgcttcaggctcccaagtagctgggattacaggcgcgtgccaccatgcctggctaatttttgtatttttagtagagatggggttttgccatgttggccaggctgtcttgaactcctgacctcaggcaattcgccagacttggcctcccaaagcactaggattacaggcgtgagctaccatgcttggcctatacttttcttattatataaaagtctttgttagggagttaggcgtggcgtctcatacctttaatcccagcacattgggaggctgaggtgggaggatggcttaagcccaggagtttgaggccagcctggacaagatgagaccttgtttctacaaataaaaaacagctgggcatggtggcaggcacctgtggtcccagccacttgggaggctgaggtaggaggatggcttaagatcaggaggtcaaggctgcagtaagcagtgattacactactgcactccagcctgggccacagagtgagaccctgtctcaaaaaaagaaaaagaaaaaagtctttattaggttttgcggctgggtgcagtggctcacacctgtattcccagcactttgagaggctgaggtgggtggatcacttgaggccaggagtttgagattagcctggccaacatggcaaaactctgtttctaccaaaactacaaaaattaggtgggcgtggtagtgcatgcctgtaatcccagttactcaggaggctgaggcacaagtatggcttgaaccctggaggcagagtttgcagtgagccgaggttgcgctcgtgcactccagcctgggcaacagagcgagaatctgtcttaaaaaaaaaagtttttgttaggttttggtataaaggttttcaggtctaacagaacaagttgggaagtgttcattcctccattttttgctgaaaaagtttgtgtaagagtatttcttttttaaatgtttgaaataattcaccagtgaaattgtctggtctaggagttttccttgtggggaaggtccctcccacaatgatgtttattataacatcattcgtagtgataaaaagatgggatcacgacgaagtggtggaacaaggaatgacctcaaggcacatctgtatcaaggaatattaaagaaaaaaaccagaactatgccaaataatttggaaggatttccatatgattttttaaaagctttattgaaggatgatttccttttgtttcttttgagatggagtctcgctctgtcatccaggctggaatgcagtggtgcagtcttggctagctgcaacctctgcctcctgagttcaagcaattctcctgcctcagcctcctgagtagtggggattgcaggcacctgccaccattaatttttgtatttttagtagagatggggtttcatcatgttggccaggctggtctcaaactcctgacctcaggttatccacccgtctcggcctcccaaagtgttgggattataggcgtgagccactgtgcccagcctgaagtataattttcctttcataaaattcagctattgtaagtgagtttcaggacatttatacggctgtgcaactgtcaccacaattccgttttagaacactttcatcatctgttgggaggtttttgataacaactaataagaataaaatagggctattttattaaatagggctgtttcaatttccagttttattttgtgtcagatttggtaactgtgttttttgaggaatttgtttaccctaaattgtcatatttattggcatacagttatttgtaatactctcattattattatttaattttttttttttgagatggagtcttgctcttgcccaggctggagtgcaatggcacaatctcgcctcactgcaacctctgcctcccaggtccaactgattctcctgccttagcctcctgaggagctggaattacaggcaccctgccaccacgcttggctaatttttgtatttttagtggagacagagtttcactgtgttggccaggctggtctcgaactcctgacctcgtgatccacccaccttggcctcccaaagtgctgggattacaggcgtgagcccctgtacccggccaagggggacatttagataattgattttaaccctttcttcctttagtatttacacataagtatctttctaaatcctgttttagctgcatctcataaatttctatatgttgtgctttatttggtttgaaatgttttctaatttcccttgtgatttcttctttactgtttaatttccaaatatttgagacttttctagataacttactgtactgatttctaatttaatccattgtggtctgagaacatgttgtgtaaagttttcagtcttgaaatgtattgagacttaccttatggtccagcacattatctatatggatgaatgtttcatatatacttgaaaagaatattttatatacagttgttgaatatactgttctgtaaatgtcttttaggacaggtagttaataatgctgttaagatcttctgtatctttactgatttttttgaaagattgttcaatcaattatgggagtaaggtgttaaaatcttcatctctttctttagtattgtcaacttttcctttatgtatattaaaattttctcatttaggccaggcacagtggctcacgcctgtaatcccagtatctttgggaggctgaggcaggtggatcacttgagatcaggagtttgaaaccagcctggccaacatggtgaaaccttgtctctactgaaaatataagaatcagccaggcatggtggcaggtgcctataatcccagctacttgggaggctgaggcaggagaatcacttgaacccaggagatggagattgcagtgagccaagatcactccactgcactctagcctggtcaacagagcaagactccgtctcacaaaaaaaaaaaaaaaaaaagctggttgtggtggctcatcactttgggaggccaaggcgggtggatcacctcaggttgggggtcgagaccagcctggccactgtgatgaaacctcatctctactaaaaatacaaaaatagcctgggatagtggtgggcacctgtaatcccagctactcaggaggctgaggcaggacaatagcttgcacctgggaggtggaggttgcagtgagcctagatcgtgccactgcactccagcctgaatgacagagcaagattttgtctcaaaaaaaaaaaaaaattctcttatttgacacatacacatttacaattgtcattgcttcctaatgtattgactctttttttatcatcatgaaatcataagtagtagtaatccttattttgcagtctattttgtctaatattaatataaccatttcttcctcccctttactttgaggactttcttcatatagattgtattggttagataaacttattttccataaaattcatccaataaaatgaaatgttgaaatttcatagttgatctttaaataatttttttttttttttgagacggagtctcacactgtcgcccaggctggagtgcagtggcgtgatttcggcttactgcaagctccacctcccaggtttacgccattctcctgcctcagcctccagagtagctgggactacaggcacccgccaccatcccggctaattttttgtattttttagtagagacggggtttcactgtgttagccaggatggtctcgatctcctgacctcatgatccacccgcctcggcctcccaaagtgctgggattacaggcatgagccaccgtgcccagccgatctttacattttttttaaaagtctgagtcctggtgatcataatttgttccatttgtagattccacttatggtaaatgtcatctggttcttttcggagcaaaggctgcctacattcctcttacattcagttctgtggtattttgtttccaacagaacaataaacaaaaacaaactgaatgtcacctgacaacaaaattcaacgcaactccaaggcaaagaaaagtagtttacttccaggtttttttagattttttttttttcatgattttaaaagaggggacagagttgatttgaattttattaagcactgttatttgaacagttgctagatcctgatatctagcaatatccaggaaaatgtgcctttctaaatatttgtcttagctcattatttctcagtgaatgcctgtggagacatgaaagaatcctatctacaataagcaaaatatgttttggggtgtgataactggttttcctattacagaggagaagaatggatatttgtgtaaatagcatagctgtttggctgcccggttctaaaaactaagtttttcagatcgggtgttcaaaaattggaactactgctagcttgttagcttcttgctctttccacctgaagcaggatttctctatctcaacactgttggcattttggcctggaattttttttttttttctgttctgtgcattgtagaatattgaatgatttgtattcattggtaaatagctgctgtcctgacccttctgagtctcgcctagcccccttgttcagcactccctagttctggccactttgaggacccagctccagcatggtgggctgtgtcttttctgattggttgtggacctggggtgcgagttgctaacactttcaataccaacttggatgtgagggaggaaatacaggatacaaatgaaaatgggggctagaacttttagtccaaaaatattcttaggctcttcaggctattctgttttcaggctcttcttaaatatcaggcttctatttgttggctaacatgagagtgacttaaaatattcagacatatttatttatttattttttgagatggagtctcactctgttgcccaggctggagtgcaatggcacaatcttggcttactgcagcctccacctcctgggttcaagcgattctcctgcctctgcctcccaagtggctgggattacaggcacgtgccactgcgcccggctgatttttgtatttttagtagagacggggtttcaccatgttggccaggctggtctggaactcctgacctcaggtgatccacctgccttggcctcccaaagtgctgggattacaggcatgagcgaccacgcctggcctcagccatattgattttaaactatacctatactactactgggtactcttcaaataaccaaacaaatgttgaactttccaatatatgttaaaagtttatagaacagaatttgccagttgaaaaaatagtcccacaattagttccttttggagcccctgagatgaaaatttctggtgaattgaattattcaattaggtgtgaccccatgggcctaccgtggtgaagtggcattctcaaaagaggtctgtctagagggcagtgatagctagcctcaggccttgggcctgattgcactgttttggcatgatttgtattggcagagcagtcttcataaagaagagcctgcaataaggcacacctgccaagagaatgcttgtcaccaagtgaatgaaatggaaaagagggccgggcgtggtagctcacacctgtaatgcccgcactttgggaggccaaggtgggtggatcacctgaggtcaggagtttgagaccagcctggccaacatggtgaactccatctctactaaaaataaaaaaattagccaggcatggtggcgggtgcctataatcccacctacttgggaggctgaggcaggagaatcgcttgaacccgggaggcagaggttgcagtgagccaagatcacaccattgcactccagcctgggcaacaagagagaaactccgtttcaaaaaaacaaaaaatcaaaaagagtatagcatcattaaagataagaaagaggccgggcacagtggctcacgcttgtaatcacagtactttgggtggctgaggcgggccgatcatttgagcctgggagtttgagagggcatagtgggatgcacctgtggtcccagctactcaggaggctaaggtgggaggatcacctgagcctggaaggttgaggcttcagtgagacatgattgcaccattgcactccagcctggatgacagtgaggctttgtctcaaaaacaaaaaaaaaaaggaggggtgggtcttttcttggaactttgaaatgctcattttcagatagtgtatctataaactgaagactaaatcttaattattaatcttattaattaatcataagttttaatgtctacttttatgtttgttaatatgtaaaataaactaccaagtattctttcaggatcttagatgggaaaaattttaacgtatgttctagctataagaaccttgattttttaatgcagcaatgaggtatgcttaacttcagtttctaatgggagaaataaaacctgattaacttgcttgaaatatttgtgagttttaaaattgtgatcctggataataagtaactctaattttgaagttgacctaaactgtgaatgagctatccatttttacctacacgatagtattgagcaagtcaacaacctacgagagatccaagcactgaggcgcctgaatccgcacccaaacattcttatgttgcatgaagtggttttgtaagtatatttggagcttgaaaagttatctaaatttgatgaaaataatctctttttaagaaagaaaaccatggtagacattttgaatatttactttgtagctcagagagtaaccatttttacttcatcttacatcacatttttatttggaaaaatgtgcatctgattcttttttttattattattttttgagaaggagtctctctctctgtcatgcaggctggagtgcagcggcgtgatcttggctcacaacaaactccgcctccctggttcaagccatctcctgcctcagcctcccgagtagctgggatcacaggcacccacaaccacgcccagctaatttttgtatttttagtagagatggggtttcaccatgttggccaggttggtttcaaactcctgacctcaggttatccacccaccttggtctcccaaaatgctgggattacaggcatgagccactgtgcccggccagcatctgattcttaattaatgtggaaatgccttcatttaggtgactccacatcataaaagcatccgtcatgcaaacagttcatctcctggagctcagttaggctgctaaggtcttgagtgtgaattttgacctactgggaaagcactgtttgtgttatttcagggattgtacattctcattctgtccctgccagttgccatttctgaacagtctcctgtagtctttcttactgtaattgataacatttctggggatttttcatttctgttctaattatagaatagtttccataaggcttatctatcattcaaaaaggcagagcacagcttgtccctcggtgcctgcctgagcctgggaagccttcttcctgacagctctgtgctgtgcttacagacctcactgaaccagggagtcaggctacagggttttgggaccttctttgctgtgggctagaatggcactgacactctgagagggtgcacctcagtgtagaagcttcgctgtggctccggagggagcctggcctgtaagatcggccaaggaactccagttaaacttcactgccagttaaagtctggtagattttaatcagagaatgaaacagttttaaactcaaaatgaaatgtcttgttataactgtgtgggttcctgtcctgtagcgttcttagaagtcaatttgggccaggtccagagagtgcagtttgtatgtaatagtctcaacactgcatgcacgtcgtgcacttcccacgcactttacaaagtactctgtccagaatctcacatggacctcggaacaaccgagacctcttccagccagattggaggcacccagagtagggtctgggatgatacaggctcttgctcaggactctgggaaccctttaagggcctgcttgaactcagaagttggtggctcagccagcagtctctgtccctattctgtgtcagcgttgatatcacacacttgtgatgtgactcgtttttctctttttcccctgactggtttttggtttttactctcccattgtgatttatcccaattacatggaaggaatttagctaaattaaaattaaatttgcagtcatggagcacgaattaatttttctttctttctttttttttttttttttttgagacagggtctcactctgttgcccaggctggagtacagtggtacgatctcggctcactgcaacctccgcctcccgggtttaagctattctcctccttcagcctcccgagcagctgggactacaggcacacgccaccacacccagcttttgtatttttagtagagatggggtttcaccatgttggccaggctggtctcaaactcctaacctgaagtgatcgaccacctcgggctcccaaagtgttgggattacaggcgtgagccaccacgcctggcctcttttattgttttgcttacccaactccccaacctttttcttctttctgctgataattaattatgtattttcaagacatatctgttttcaacttctagaattttgttcaaagttgggttttgctagtatttttagttaattttatctgaaatactgatttaaaatcaaaacctttactgtttcagcaattacactgtagtatttgatgtgggagtacctaatgtttactagaaatgtttacaaatgaattaaatattggattatattttctgattaaggccagaaaatttattttaaaaacttgctttcttcttcagtgacagaaaatctggttctcttgcactaatatgtgaacttatggacatgaatatttatgagctaatacgaggtacgtagaataatttgaaagctaacctaagatcctcttttaaggcttgtaattcatatatgcttagttattctcaacatcattagtcaccatagtgctgtagttatatataatacacagtacagggtcacttcattcaccaggaggcatttttctgactgctcatctactcagaacatggctgcaaacaagaaaggaagccccaggccctctgggtgcccatgtgatctgggggagagtggcgggaggcagcaggggcagctctgctgcagagcgcctgcagccagccccgccgtgggcatgtgtgtgcaggcccgctggctcaggggcctctctgctccccagatctgctgttgctcgacattctgttccatgcctcttaaggcagagctttccctccaaaatactgccctgcatgtgagggaagctcctaccattttccaggatgctcgttcatttccttttttctgaacaataaagcactgtttaagagagcatgtttgcctgaggtgacctcagtcagggctggtttgagatacttatagaggttgcctgaggggaacaggagaaaaggagaggctggcccacactgagccaattgttcctgggggtctgactaatggttgtgttagatgtcagaacaaatgaaccttgtatatctcactaagaaagcaacatagcaagtgttacattttacaaatcacattatacctagaggacagataaaaaacaactgtcctactgtcacatgagtgactacttatgacttggaaaagaattttagtgacagcatcatagatgatttagatggtgtattatcttacaatttgagccaaactgaagatgatgtgctatggaaaatttttagattgataaactatttttgtgatggaagaagacactgatgttgaagatatatatgaagagttcaaataaaattgtttttatgaagttggatagtggaaaaagcattatatcaatatttattttatatgtgacttaaaatatgtgtgtgatagtaaattactaacaaaacaaatagcataagtagccaagtttttctacatccataaaagttgatgtatataaagctgggtgcagtggctcatgcctataatcctagcactttaggagggacgccagtgcgggtggatcagttgaggtcaggagttcaagaccagcctgactaacaaggtgaaaccctgtctctactaaaaaatacacacaaaaaaattagccgggcatggtggtgtatgcctgtagtcccacctactcaggaagctgaggcaggaaaatcgattgaacctaggaggcgggggttgcagtgagctgagattgttccactgcactccagcctgggcgacagagcgagactctgtctcaaaaaataaaaataaaggccaggggctgggcgcggtggctcacgcctgtaatctcagcactttgggaggctgaggcaggcggatcacgaggtcaggagattgagaccatcctggctaacacagtgaaacctcgtctctattaaaaatacaaaaaaattagccgggcgtggtggcgggcgcctgtagtcccagctactcgggaggctgaggcaggagaatggtgtaacaggaggtggagcttgcagcgagccaagatcatgccactgcactccagcctgggtgacagagcgagactccgtctcaaaaaaaataataaaaaataaaaaaggccgggcgtggtggcttatgcctgtaatcccagcactttgggaggctgaggcaggtggatcacttgaggtcatgagttcaagaccaacctggccaatatggcaaaaccttgtctctgctaaaaatacaaaacaaattagccgggcgtggtggcatgtgtctgtagtccaaactacttgggaggctgaggcaggagaatcgcttgaacctgggaggcagaagttgcagtgagctgagatcgtgccactgcactccagcctggacatcgcagtgagactccatctcaacagaaaataaaaaaaaaataaaagtcaacaagaagggagaatttttggcaagttgctgtgtgtttagacgcttgagaaagctttgtttagaatatatatatatatatatatatatatatatatatatatattttttttttttttttttttttttttttttttttgagacgtggcgcgatctcagctcactgcaacctctgcctcccaggttcaagagattctactgcctcagcctcccaagtagctgggactacaggcatgtgctaccacacttggctaatttttttttttttttgtaggcagagtctcgctctgttgccaggctggagtgcaatggtgcaatcagctcactgcaacctctgcctcccaggtgcaagcgattctcctgcttgtgcctcctgagtagctgggactgcaggtgcatgccaccacgcccagctatttttttgtatttttagtactgacagggtttcaccatgttggccaggatggccttgatctcttgacgtcgtgatctgcctgtctcggcctcccaaagtgctaggattacaggcatgagccaccgcgcccagccaattgttttgtatttttagtagagacggggtttcaccttgttagccaggatggtctcaatctccttgacctcgtgatccgcctttctcggcctcccaaagtgctgggattataggagtgagccactgcgcccagccttagaatatatgtatttttaggatacatttatatttattttcagtagtagaggaattgtataattgaagaaattgaatctatttctttcaatatctgtctacagcgattgtagaaaacagacctcgcagtagacctccattcattatataaatattgtcttccataggccaggcagtgtgttcagtgcaccaactctgagatgctgtgagcaacatggagcatcctaggttcagagatgttaaaatgtaaggagaatggccaacagtgcttgtagggtagtaaatattgaaatatgcatcctgattttagagttggtaaaatttgaaaaaaaagcctgtcctagaattgatgaaatataatgataatgataatagctaacagttcatgaatggtacccatatggccaggcactgttcttaatactttataggaattaactcattttaaccttccaacaaccctgtcaggcagatacggttattttttatttttttaagatggagtctcactctgtcgccaggctggagtgcagtggtgtgatttctgctcactgcaacttccgcctcctgggttcaagcagttctcctgcctcagcctcccaagtaggtgggactacaggagcacgccaccatgcccagctaagtttttttttttttttttttgagatggagttttgctctttttgcccaggctggagtgcaatggcatgatctcggctcaccacaacctccgcctcccgggttcaagcgattctcctgccttagcctcccaagtagctgggattacaggcatgcgccaccaccccagctaattttgtatttttagtagagatggggtttttccatgttggtcaggctggtcttgaactcccgacctcaggtgatccgcccaccttggcctcccaaagtgctgggattacaggcgtgagccaccgcgcctggctaagttttgtatttttagtagagacaggtttcaccatgttggccaggatggtctcgatctcttgacctcgtgatctgcccgccttggcctctcaaagtgctgggattacaagcgtgagccactgtacctggcccagatactgttattatcctcatttgaaacatgaggacattgaggcatggggagataagttgcttgtccaaggttatatacctagtaagtggtagaactggggctgaacctagataacctgatcctagagtgcatgttcttaaccaccacccataccgcctcatgacaaccctgtgtggttggcactatttattattcccattttacagatgaggaaattgagtcttgaaggattaagtaataatccaaaattaagctgttaataaatggcagaactgggatttgaactcaagcctgactctgaaatcctaagcattaagctctgttgctgccctgggtctctatttctgggcccagctcagtgccttaaatgaacagaggcacctaattatttacggttattgatgatgatgcttctttagtgaaaactgaatcaatcactaaggctttagataccagaatggcaatttttgtgacttaaattgctgctctcaggttattagaatattgaggagcactattaaagactaaagaataagataataatgaaataagggaacgatcacatagccattattgaattgtctactttacagcagtgtgcaaggtctggcaagaactgggaagataaagaagcagcatgtcagatgcatgttttttatattgaaagagtatatagtctttttttttttttttcttgagatggagtctcactctgttgcccaggctggagtgcaatggcacgatctcagctcactgcatcctccgtctcctgggttcaagcgattctcctgccttagcctcccgagtagctgggattacaggtgcccaccaccacgtccggctaattttttgtccttttagtagagacggggtttcactatgttggccaggctgtctcaaactcctgacctcgtgatctgcccgcctcagcctcccaaagtgctgggattataggcgtgagccaccgcgcccagcctgaaagagtatatagtgtagtgtccacataaactatatgaaagtgatatcataagagaaaaggaattgctggggtagatttctttttgttgaacaggtgtcagatgaggcagagatggtgtgggctgggaaaataaggctttcctggaggagtggtagaattggacaggtgcgggagaggatgtcccatttgcagtgacatgccatgggctattccagaggcagggacatggtggggaacacagcagacacagttcccacccatgtggagctcacacttgatgaggagagacaggaaacaaatgaagaaattatcaagaatatcagtcaaaatgatcaagaattccagatagggataagtgctgtcagtgaataaaacaggccaatgtgttagagagtgatgaggatagagtacttcaggcagagggacagccagtgcaaaggccctgaggccaccgtgagggaagaggcccatgtggctggaggacatgaaggagagttgcaggaaacggagtaggcaggcatcgatgaggctggtagggcgagggtaagaattttcgttactctaagttcaatgggaagccattattgggctttaaagcaagggagaggtggttttcaattggtgtttagaccagtgtttccaaaacgatcacagaagaccagttgttttatttctaatatattgcagaccagaatttttgtaaaatatagtaaaaatgaattaccagaaaagtgatcacgtgcttagatgtcacagcatgtcaaattgctataagtggttctaaacaggtattcttttttttttttttttgagacagagtctcactctgttggcaggctggagtgcagtggcgtgatctctgctcactgcgacctctgcctcccggattcaagcaattctcctgcctcaggctcccaagtagctgggactacaggtgcgtgccaccacgccctgctaatttttgtatttttagtagagacggggtttcaccatgttggccaggatggtctcgatctcttgacctcgtgatccgcccacctcagcctcccaaagtgctgggattacaggcgtgagccactgcgcccagccctaaacagttattcttaatttatgtcatctcctcttagaccagtaacagtccctgaaccatcatcagctcatggactgtgctttgagtagcatctttttagaaggaattctccagttgctgtttaaagaataaatgtgctgtaggtggatgtgttggttctcccttttagttgcaaataacagcctcccctattctctgattaactcaagaggggttactctgtgatatggatagattgccagaattgttgggaggactgaagaagcagactctgggcttggcctataggaagttgcttctcacaactctgctctccatgatcaggctgctggccctgccgctgacaacgctctgcagaataaagctgctgcagctaccaggcctggaatcatgcctcttctgccaggatcaggaggcagccgtgatccatgccgtcagaatagatgccttccctcctctcatctgcccccatacctgggccagaagcatctttcccaagtgttcccatttaggcagagcctaagtcacatctggaacactcagctgcaaggcagcatgaagaatgtcatttggacgttcaggcctggcatgctagatgggggtttgggataggacctgagcaagccaatctgcgggtgtgccatgaaggcaagagtggtgtgggagcctggggaagggatggcgaaggccctttgcccaccactgtctctggatgaatgtctctgaattctttggcgtgagttagtaattggggtgaatagagcatggctacccgccagcgatcctagtttgtgtatttgggcgcgtgtgcttatggctctgggctcatgccatctgcagtaggaaagcctgtcttggaatttatgaaggaaaaaccgtaaaggaggtttagtttccctcatactctgactatagaggcagctactcttttacaaaattgtatctgattctgctctttttttttttttttaactgtttcaagttaaattcatagggccaggtgcagtggctcacgtgtgtagtcccaacactttgggaggccaaggcgggaggattatttgagcacaggagtttgagactagcctaagactctgtctgtacaaaaaaacaattttttttttttgagacggagtctcgctctgttgcccaggctggagtgcagtggcgatctcagctcactgcaagctccgcctcccgggttcacgccattctcctgcctcagcctcccgagtagctgggactacagacacccgccaccactaaattagcctggctaatttttttttgtatttttagtagagacggggtttcaccgtgttagccaggatggtctcaatctcctgacctcgtgatccgcctgcctcagcctcccaaagtgctgggattacaggtgtaagccaccgtgcccagcccaaaaaattaaaaaaaaaagcatccgggtgtggtggcacacgcctgtagacccaactactcaggaggctgaggtgggaggatggcttgagcccaggaggtcgaggctgcaatgagctgattgtaccactgcactccagcctgggcaacagagtgagaccctgtctcaaaaaaaaaaaataataataactcatttgccttaatgaatggctagttcgtagttctctccaccctcgctggaggggcgtgtgctggggatgccgtcattctgcaggctacagtggcagctgtattccttcagttagtgctgagtcacagtgaatgccttggtttatcactgtgttcacttaagtttttaaaattattagtatcatatatgacattccttcttaatgagaatatttggtaaaaattaacttgtaaaaattaccttggtcaggatagctagagcagatgagggaaatgcttttggggcctgctggaattcactaaggggcatataagaaacttctgagtaactcgttaattgtactctattttacttgtttcaaactgtttgaaaacaagaatctgatgggaaccagatagtcttgggcccggaaagtttgttctggagaagcttatggagagtggctaggcagtgctttcctttgcaagggtgtggtctccagcacttcagactactgggcccacactgttgctctgatacctcatgccagcagtaacacccccaactactggcccgggaccaggacggctccctacccctagggctgtgaatagggagtttccaggaggagacccagggaggcaaggaagggtgggcacctgaagaggactcttacctgggactgaaggcatctgagaagcacagattcctggcccgcatgcccgtttgtggctccattaggtctaggttcaggccttgaaatctgctttttttttaaattttattttattgttttttgagacagagtctcactgtgtcacccaggctggagtacagtggcacgatctcagctcactgcaagctccgcctcccaggttcacaccattctcctgcctcagcctcccaagtagctgggattgaaggcgcctgccgccacgcctggctaattttttgtatttttatagagacggggcttcaccgtgttagccaggatggtctcgatctccggacctcgtgatccgcctgcctcagcctcccaaagtgctgggattacaggctttttaatcagctttttaaaagacttctaggtgattatgaagattggatagattagacttttcctaaaagattccacgtttcccaagttcaagttcagatgactctaatgacaattttatgatacgagtaagatttaaatgtgtggacatggctgggaagggcgttcctggaatggaacatcatgaatataggtactaagcaggcgagctttgggagcaaccagagaagagtccatgagggaattcacctgagcattcgataaacaagaagggggtggtggggcatggttctcgaagcgaggacccaagactagtagctgcacctggggctctagttaggcgactgtggggccccattgcagaccttctgaatcagacatgtgggtggagatggggagggacagtatgtgtcttagcaacccactcgtgggagtctgagaacccttttggtggagaggaattggttgaagggggtcttgagtgccggggtaagtcgggggcagtgagactgggtttgatcacaggacccaggagcacctgatgagatgaaattccagcagcttcattctgctgcgtgtgtgaaggcaaatggaaagttgctttctttttatctgttatagatattaatttaataagattccagaattatcagcttgggaaagctgataaaggtcttacttttgattcttttgattttaattctggaaaattgatgataaatcatgtgaaacaataaaaagatgatagtatgacacaaaaaagttaattgcggccaggcgcagtggctcaagcctgtaatcccagcacttcgggaggccgaggcgggcggatctcgaggtcaggagttcaagaccagcctggtcaacatagtgaaaccccgtctctactgaaaatacaaaaaaattatcagggtgtagtggtggcgggtgcctgtaattccaactactcgagaggctgaggcaggagaattgcttgaacctgggaggtggaggttgcagtgggcggagatcgtaccaatgcattccagcctgggcgacagtgctacacttcgtcccaaaaaaaaaaagaaaaagctaattgcacctagacattttacaatttaaattactttctattatttatatattcttgttaagtagagaaaaagaataattttaatttttcaaaagaaattgtaaacttaggaccaaaagtgtcaaatggtatatgtgctcatggagggaggaagtggatttccaaactgttaggtgaacatggtcattgtgcagatttaaaacttaataacttaaaacacacactttgaaaattaaaatcaagtaaaattgacatcttctggaacaggggtaaactgtgatgctgggcatgtggtatgacgtcttcaagcacggtagaaagctgcgggcaccaaggcacagccagcccaggtgctgagtacagggcagctgcaggggactgtgccagccacgctaaacggcctctcctgtgaaagaagacatgtggactgtgactgaaagcagttgaactgcttcttgaactgtgatctgtccccctttaaagtggacatctccacataaacaggaaagcctagtggaacactgggttgacgagtgactcctaacattttcataatcagtgtaggctgaaggacagcgtcctggaaggcctccgaggccggctgaggctgtcagaccatgctacttgtgtgacgattgctcagtgctgttcccactgaaaccatagcacatgcgctctgaatgttcacagagctgacgcacgtgctaattgccccgatttcatccttacacattgtatgtatggatcaaaataacactctctgggtcccattagtaggtacaattactacatttccactaaaaaggaaaaaaattatcaacaattctgtcattcttcagtaacgtttattgtttattaattttttaattggcagtttcccaaacctgcttcacctgtttcaaaactcagaaaaaccacgtgtgctagagcagcagcagagtcactatgcagctgatagagctgactcgcccggggcttccaaaacaggcccttgcggtgtctccaccatgtttatagattttgttaaatttgcaaaaataagatatttcaaccacaaagttaagactgccatctcttctattttaacctctcctatgtcatatttcccctcttagcgtaaccgtgaaatagccgtggacatgtctggaatcttgttaagggttggctgggatacatttatatgctttgcagtctcttccatatattaatagttacattattgctggccatctcatttgggatgtcttctaggaatactctgaatatggtcaattcaaagattaaagagcattcactccatagaaaacttgaaatatgaaatcttatagctcagatatgaaggaaacttagcagtttccccagatttgacaattctaaaaattacatggtgctactaatacatagttgaggatgtaaaagaagcctctataaactgccaaaaagaaaaataaaaagggattttccattaaaaatgtatgtgctatgtaattttaaatgagatcatgccattatatagattttttttttttggacggagttttgctcctgttgcccaggctggagtgtaatggtgccatctcggcttgctgcaacctccacctcctgggttcaagcgattctccagcctcagcctcccaagtagctgagattacaggcacccgccaccacacccggcaaatttttgtatttttagtagatatggggtttcaccattttggccaggctggtctcaaactcctgatccacccacctcagcctcccaaagtgctgggattacaggtgtgagccaccgcccctggccagtatatggaattttaaatggtatgttttgtaggcacactacatatttcctaagactacttcagattattttttacaggggaacttagattttcacacattgttaaataaaaatagattatttttatttcaaaaaagaggatatgtaccatcagtaaccgtatttgcctatttccttgattgtacagggagaagatacccattatcagaaaaaaaaattatgcactatatgtaccagttatgtaagtccctggatcatattcacaggtatgctctcggagatttgacagctctgaaattaataaaatgtgttaacattcagattcaagaatttgaataaatgaagtgtaattctatttttcctttatactgaatgcagaaatggaatatttcacagagatgtaaaaccagaaaatatactaataaaggtaagagcttttacatgaaagctgggtatcagaataaaagctgaatagaaaatctttcccgaaaggttttctcctcctaccagaggaactttcagtccatgcggctagacagcctgtttgttacagtaatttttttccctctcaggttgtaaaaaatggtttatttaataaatgccatcaacataactgactgcacctggaagaaaataattgaaagcaccattttcacaccgcagacaaaaatgaaccctattcagacggccgttcaaaccttctagagggaaatgtggcagaggcaggatttgagctcaggtccgtctcactcccaagccactaaactacctgtgtttaaaccgtacaatttgctgtttcccagcacctgtcactggctgtcagcagagtcctctgaggctgtgtggctaaaagagcccttgctgggcaagctggcagcatgaccggacagacgactagtgtgtgttgttcatttgtagaagcgccaatgggttaaccagtttccaaacctgtaggcattttggaaatatatgtgaaacagccagaatatttgtaaacctgttccactgaatagacatcacttcctcatctgctggaggcactttgaggtgctcagaaagccagtaatttgtattttacagactactttagatgctagtaattttcctgctggtgcataaatatttggagtggtttgtattatgatagccacataatgggatgttacttgtccttgcttctttccccttccagcaggatgtcctgaaattaggggactttggctcctgccggagtgtctattccaagcagccgtacacggaatacatctccacccgctggtaccgggccccggagtgtctcctcactgatgggttctacacgtacaagatggacctgtggagcgccggctgtgtgttctacgagatcgccaggtagcaccaggccaggctcctgcctggttcctgcggcggagcggtgcagcagccaggctcgtgctccttcctttacaatccagatgtcatggtcattctggtttttctttctgttttactgtttttaatttaacagaaaattgactaggctttcattttacttgttgtacatatttggccttgcctgcccttcccagagaagagcaccagccctcagttgttctccctcctgcacaccctggtggtgtgggcagctgcctccttggggttgctgtgaggtgcttgatggggctgctgtggggaggggtgagccaaacctcccctgagaggtgcagtcatattaggtagggtgccctggccacaggtgtgaggatgaggcaccttctggcacagttggactctagaaagccccaatcccacccctccctgctccatcctccaaaccccccactcccccccagcctttggcaaggagcagtggcccagggacgaggagatgggggccggtcccactccgaggtgaatggtgttgagttgaagacgcgcacaggggtggagagctgcacctcttgctcccagtgggcctccaggcaggtggcagtgaggttaaggtctgggggtgcatctgaggggtcaaagtctggtcccgcctgctcaacagactgctacagaaatgcacttcaggacatactctcctttgatccagatggttcatactggtaacttttcattttggaaagctgaatggcaatttcactgcagccagaagtgtcaaccaagagtcccttcccatgagcccaggtcctgtgagttcatctggagggggcagatgtcaggagcacaaggccacctgtatctcaccagcgcacaagacggcccacggtgcaccagccaccaaactgggctgaggcactcatctccccacttggagctgtttcctgctcacccgcatttcctcctctctcctttagtcacaagagcctgccattttctggaatagaagctaggcctactaccagagctgtatttttaaatattatttgtggcatgtaatatgaattgaatttatttatacaggtttaaaatctgtatttatttttttgagatggagttttgctcttgttgcctaggctggagtgcaatggtgcgatcttggctcaccgcagcctccgcctcccgggttctagcgattctcctgcctcagccccccaagtagctgggattacaggcatgcaccaccacgcccggctaattttgtatttttagtagagacggggtttctccatgttggtcaggctggtcttgaactcctgacttcaggtaatccgcctgcctcagcctcccaaagtgctgggattacaggcatgagccaccgcgcccagcacaggtttaaaatcttgttcccacaattccaaaatctataaaagctctggaaaccaaaaggtttcttgggactcatttgttgacaaaacctgacctgtctcaccctgaatttgtcagcaaaactccccttggccgatgggaggctcactgtggggttatttatcacggttactgtgaattagtcacatttcaccacagacatcatgctgaacagatgacggaatgtggatctgtcttttgcctcttagaaaacacatgtcggacctattggtaaagtggaaacaaaaggtcaagcacaagggagagtggagcctcccagcagctaaggtcgctgcacacgccaggctgagttcctcgtgttccgtgtggtgagggtcgctgcacacgccaggctgagttcctcgcgttccgtgtgagcgagtctgcctggtcgaggggactaggcagaatggagagacccatggccatgtcctgactgtagggtcagctgagagaaaggaaaaatagacccaaagtcaggcaagcaagtcagacagtcagaggaagcagccccaagcttatagaatgagggatttatattggggaggggaatttgagggagttctttggtatggccgcatcctggggttggttttttttttttttttttttgagacggagtcttgctctgtcgcccagactggagtgcagtggcgcgatctgggctcactgcaagctccgcctcccaggttcacaccattctcctgcctcagactcccgagtagctgggactacaggcacccgccagcacgcccggctaattttttgtatttttagtagagacagggtttcattgtgttagccaggatggtcttgatctcctgacctcgtgatccgcccgcctcagcctcccaaagtgctgggatcacaggcgtgagccactgccccggccatcccagggttgtttgctggttaattttgccacatatcaccttgtgatgtttgtggtagcaactagatgaagagcaggaacttacagaagggtgtagggaaagtttgtttatgcttcccacgacctcctgctgtgagttctggatggtttgtaattggggtttgcttatcacagcaaggtctgacaggtgaagtctgctggctttaccgtggcgcctagataaaggcttagaaatgtaaagaggcttgagggaagggtgaaccgcacggagaagggttgcagagcattagggggaggggtgggcagcaccaagaagcttttttggggcagtttgtctctaacattccagccctttaataggtaatagaagaggggcgccgttggcgtctggccacttcttgctgggaaggggtgatggttatgggggaaggctggacagtagggactgccgttcttggagctgttggtattcttggagcagcatcatatcttgtattgtattgaaggctccgatacggtcctgtaaaaactgagtgagaaggcgtaggagacaagggctgaatgctagaaaaagaagaatggttatggctgggcctaagaggggcattagccatggaaaccaggtactaaaggaccaggagggccacgctggccatcgggggacattttctttaattttttgtgctcggtcctttagtgtttttacaaaatctcgtactaagccagattggttacgataaaagcaacactgttcatctagaaagaggcagagtcctccctttttggctgtgagtcggtctacgcctctgtgattttgaagaagcgctgctgctaaagaatctatttgtgattggagagttgtgatggatttggctatctcttccaagctatctgtgaggtctttggagagggattggtaataggaaacagaggtggttaatcccgcagtctcagttccacctcctgtagttattctggggactgctaatagaggtatgagttgcatagcacggcagtgtcggatgcgggtattaactgggattggtaggggttggtctcctggagcaacattgatttttggagtgaggaaaaccagggtgcaggtaggtgcctgtccagttagaggggaggcaaatataagttgaggtactgcataggaaaagtatgccttggcttggtagacagaactggttgtgtatgctaaaaagatgtactgttttgttgtcctcatgcatccatactcctagggccccggctagagctgctgctctgagtggttgtaaagggtgtttgctttaggctgggggctttgggttcttttttcccagcgtaagaggaagcattttgtgtccactaagatccatgtgggagtgttgctgaatgttgggataaggacacagtcgcaggtggcgggtgcagggatggtgcatggagaggggagccaagggaagagggataaatgggggtgtcggccgttgcagtactctgagtttttgttaaggaggtgggaggtgtcaagggctggggggctagataaacgaagcctgtctttattgttggtggctttgagagtagtctgttcggtggagggtttgagttgtgcggtgtaagttgcacagtttggaatttaggtggctgaggggaatgcttgagggtggatgtcgctggcgcacagtggtgctggataggataagattgtgtgggttgttacggttcctactaataggcattcatcacagctgtggtagggccaggttgcgtaagtaggcatgtaaggttgtaacacctggaccgaactcgctagctaactgggggagatttttgttaatgcctgtatgtcgagtttgaggggcagttaatgaggatttcaggatggtagcttacttgggtggaagtccagttataggctgagcaggggttgcattgtatgttgtggagaggagggatacgcagagccagcagtctcttgccagagaggaattggagttttttagtaaggagtgtgtgagattaagtgttctgtataggtgttcaggggttgtaggtattggttggactgaacgaagggttggggtattgattatgagaagggttagaaaggcagatagtgagcagaaaaataaatagttcggttccacccagagtaaagccacagagagagccttggaagaaaaggtcgattatccacttgaaaaaggcctccaggtgtcgttccgtgggtggaaccaggaaatatcttgtgagagggcgtgaaggaagagagtgaagcggcaggatagacaaaagcagggcatctagggaggatgtgggaatgtttgatagtgattgtgattcctgctgtaagggtaacgattaggcagacggctaaagtgagggagacttttggctggtattccaattggaaggagttacactatataatcccactgcaaacaatagggtaagtattataatgcctgcagttagggtgtaatagagtgtttccattaaaggaggctagttgtaatagtactttaaacctgtttgagatggatggatttactgatgtgaagtttcttctgggatggatgtgaggcggagtcaggttggcccaaggagtgtgctggaataccagttagaagttggtgaggtgctggttggaggatcggaggtgggagctctctttaacctggaaaggtgatactagggggtatgtcctgagagtttggctgcagtaggggttgtaagtgtcacacacgtccatgtgaaaagaccaccaaacaggctttgtgtgagcaacaaggctatttatttcacctgggtgcaggcgggctgagtccgaaaagagaatcatcgaagggagataggggtggggccgttgtagaggatttgggtaggtagtggaaaattacagtcaaagggggttgttctccggtgggcaggggcaggcggagggggtcacaaggtgctcagttggggagcttctgagaaaaggaatttcacaaggaaatatcagttaaggcagggaccggccattttcacttcttttgtgattcttcacttgcttcaggccatctggatgtatatgtgcaggcttgggcttagaggcctgacattcctgtcttcttatattaataagaaaaataacataaaatagtattgaagtgttggggcagtgaaaatttttgggggggtggtatgaagagataatgggcgatgtttctcagggctgcttcgagtgggattaggggtggcgtgggaacctggagtgggagagattcagctgaaggaagattttggggtaatgggtggtattgtggggttcttagaaggagcatttgtcatatagaatgattggtgatggcctggatgtgtttttttatgaattgagagctaaacggaagacacaaggtccaaataagagaaggagaaaaacaggtattaaaggactaagaattgggaggacccaggacttccaattagggagtgcccaagggggttcagcgtaattacttgcttggttggtgagtttttgggctctatccttgacagagccctcctttttaagttggaggctgagtttggtgaggtgtgtttttaaaagaccattagtctgttccattctacctttcctgaagattgaggatggtaagcggtatgaaggttccactgaataccaagagcctgagaaactgcttgggtgatttgactaataaaggccagtccgttattggaccgtatagaggtgggaaggccaaaccgaggaattatgtctgacagaagggaagaaatgaccacggtggcctttttttgaccttgtgggaaaggcctctacccatccagtgaaagtgtctatctagaccgagacgtattttagtttcctgactcagggcatgtgagtaaagtcaatttgccagtcctgggcaggggcaaatccccgagcttgatgtgtagggaagggagggggcctgaacaatccctgaggagtagtagaatagcagatggaacactgagaagtgatttccttgaggatagatttccatgatggaaaggaaatgagaggttctaagaggcagactagcagcttgtaatctacgtggaagaggttatgaaatgacgacagaatagaatgggcctgtgaggctggaaggagatatgttccttagtccaagaactatttgccttgtgtgggaagagattgataggtggaagtttcagtggtggagtaggtgggagtgaccgatgagaaggagaaaaactgccatgagggatagaagttggaatgctagctgcttctttagctaccttatcagcataagcgttgccccgagcagtggggtctgatgccttttgatggcccttgcagtgaatgactccagcttcctttggaagtaaagcgaccttgagaagtatttttattaaagaggcattaatgatggaggacccttgtgtagtgaggaaacctctttcagcccatataacagcatggtggggcaggatatggaaggcatgtttagagtcagtataaatattgatgcgtagttcctttgcaagagtgagggcttgagttaaagcaatgagtttggcttgctgagaggtagtggagggggcagagcagtagcctcaatgatagatgtggaagatactatagcatagcctgcctttgctggtaagcggtgattaggcctggtggaactgccatggataaaccaagtgtgatcagggtgaggaacaggaaagaaggaaatatggggaaatggagtgaatgtcaggtggatcagagagatacagtcatgggggtcaggtgtggtatctggaataatgtgggaggccggattgaagtctgggccaggaacactggtaattgtgggagactcaacaaagagtgagtacagctgaaggagccagggagcagaaagtatatgcatcaggtgtgaggaagaaaatagattttggaagttatgagggctgtagagagtgagttgagcatagtttgtgattttgagggcctctaaaagtgttagggtgacggcagctgccacacagagacatgatggccagcctaaaacagtaagatcaagttgtttggacaaaaaggatacagggcacggtcccggctcttgtgtaagaatttcaactgcacagccctgcactttggctctgtgtaatgaaaaagggttgggatgagttagggagagctagtgtgggagcagcttccagggctgtttttaaggaacggaaagaggaatggggaaaggatttaggatctatgtggtcagctaggttttcttttgtgtttatgtaatggttttgttaggatggcaaaaccaggtatttaaaggtgaaagtatttaaccatgcccaggaaggaaaggagttgttttgtagaaggggttggggtttgggagattagccagacatgattagcagggagggcatgtgtgttttgatgaagaattatgccaagataggtaacagatgaggaagaaatttgggtttgactgaagtaatgggggctgtccatgaagccttgcagcagtacagcccaggtaatttgctgagcctgatgggtgtcagggtcagtccaagtgaaagcaaagagtggctgggatgaagcgtgcaaaggaatagtaaagaaagcatgtttgagacccagaacagaataatgggttgtggaggggttgtggagggaggtattgaggataggagagtatatgggtttagcactacagggtggataggcaaaacaatttggttgataagatgcagatcctgaactaacttgtaagacttgtccggtttttggacagggaaaatgggggaattgtaaggagagtttataggctttaaaaggccatgctgtaacaggtgagtgataacaggctttaatccttttaaagtgtactgtgggatgggatattggcgttgagtgggttaagggtgattaggttttaatgggatagtaaggggtgtgtgatcagttgccagggagagagtagaggtgtcccatacttgtggattaaggtggggagatacaaggggaagatgtgaaggaggctttgaactgaggaaaagggcagcaatgaggtgtggctatagtctaggaatagtcagggaagcagataatttagttaaaatgtctccacctaataagggagctgggcaggtgaggataactaaaaaggagtgcacagaagaatgttgtccaagttggcaccagagttggggagttttaaaaggtttagaagcctggccgtcaatacccacaattgtggaggcaagggaaaagaaggtaatgtggagtgggtaagctccgtattgattaagaaggggatggacttaccctccactgtaagagttacccaaagcgtctgtgatggtccaggaggcttccgaggcaatcaggtagcattagtcttcagccgctaaagccaagaagatctgggaaggagtcagtcagagagccttgggccagagttccagggactctgggagtggctgctgggcgagttggacagtccgatttccagtggggtcctgcacagatgggacatggcttaggaggaattctgggctgtgggcatttcttggcccagtggccagatttccggcgctagaagtaagatccttggggaggcagttctggaggaacgcctggccactgcggttcagacgtttggaagttcttgtgtcctggagatgtggctggggtttgtctcacagtggaggcaggaattgcaattcagaaattcattgctacttggctgcctctactctattattgtacaccttgaaggtgaggttaattaagtcctgttgtggggtttgagggccggaatctaatttttggagctttttctaatgtcaggagcagattgggtaataaaatgcctattgagaataagatggccttctggcccctctgggtctagggcggtaaagcatctaagggttgttgccaaacgggccatgaactgggttgagtttttatatttgatgaaaaagagcctaaacactgatttgggagaggtcagataaagaaaaaggagcattaaccttggctaagccttcggctccagccacctccttaagaggaaattgttgagcaggtgcgggagggctagtctccccacgtgaaactgtaagctggaccctgtgtgaggatgggaggtgattaaaggattatagggtgggggagtggaggctgaggaagaattgagacctggctcagcctggcgaggattagcctggggaggaagggaggggtcagatgggtctgtagaaaaggattcaaaggactcagagcttggagtggagactgaaggaatagacaggagagaaagaagaaagatttgggatgagttgcattgggagcagagactagggagggaccgatgtgtaaaagaatgcctggacgtcaggcacctcagaccatttgcccatttttcgacaaaaatcatccaggtcttgtaaaatggagaaatcaaaagtgccattttctggctgtttagaaccattatcgagtttgtattggggccaagtggtgttggcgaagacacttaggttttaggtcaggcaagagttgaagaggttttaagtttttgagaatacagcctaaggaagaagaagggggaatggagggtggaaggttgcccatagtgaagcaggcaagcccagagaaaagagagggtagagacacagataaggagggtggtgagcagccctgggctgcaatgtgggtgagcagccaaagcaggcatccccgcagttgacttgccaccaagggaatgtgggtgaatgaccaaggcaggcatcctcgcggtgatcagacaccaatggagtgtgggtgaataatcaggcaggcgtccccgcagtgattaaacaccaagagaagactgtattcctgagtctgtgactggtgctggagttttgagtccacggatagaatgtgtctccttcgtctctactagagaggaaaaagaactggaattggaagaacagggagactgaagggtagcaagagaggctggagaagagagtgaaaagaccgcttacctgatttgaaattggtgagatgttccttgggctggttggtctgaggacccgaggttgtaggtagatctcctcacggagtgagggcaaggacaggggactggtctcccgaaggagtcctcctgtcccgggtttcggcaccaaatgtcacgcgcgtccctgtgaagagaccaccaaacgggctttgtgtgagcaacaaggctgtttatttcacctgggtgcaggcgggctgagtccgaaaacagagtcagcaaagggagataggggtgggtcgttttataggatttgggtaggtagtggaaaattacagtcaaagggggttgttctctggcgggcaggggctaggggatcacaaggtgctcagtgtggaagcttctgagccaggagaaggaatttcacaaggtaatgtcatcagttaaggcagggctggccattttcacttcttttgtgattcttcacttgcttcgggccatctggatgtatactgcaggcttgggctcagaggcctgacagtaaggatgacctggaaagggccttcccattttggtttaaggctggttgggttaagggtttttttttgtttgatttttgttttttgttttgagacagagtcctgccctgtcgccaggctggagtgcagggcacaatctcagctcactgcaacctttgcctcccaggttcaagtgattctcctgcctcagcctcccgagtagctgggactacaggtgcctgccaccatgcccggctaatttttgtatttttagtagagaaggggtttcaccatgttggccaggatggtctcaatctcttgaccttgtgattcaccaggcttggcctcccactgtactgggattacaggcgtgagccactgtgcccagccgggttaagggtttttagaaaaacatgttctcctggtaggagggtctggtcagtgaggcctttatgtggtattgggagggcctggtgtgcctgtttgcagaggagatggcggatgagggagagtgctgggaggtactctcctaattgagaatcagaaggaggcctgttttgtaagaggaaagggtctcagaaggaggcctgttttgtaagaggaaagggcatccatacattaattcaaatgggctgaggaaggagggtgcctttgggctggctctgacgctggctagagctatgggtaggagggaagtccagggcctctggacttctagagtgagtttgatcaactgagtgttaaggtttccatttgccctttcgacttttcctgatgattggggtcgatatgggatatggaggtgccactggatgctgagggactgggagagctgttgggtgatttgggaaatgaagccagggccattgtctgattgattggagcgagggagaccaaagctagggatgatttctcttgtggggatctgggagactactgcagctttttctgaagaggtaggaaatgcctccacccacccagagaagatgtctataagagtgagaagtagtcttgtgtttttgacgggaggcatgtgggtgaagtctatttgccagtcttcccctgggagtgttcctcttagctggtgtgtaggaatagatggggaatggagggctccttgagaggaggtgacagagcatatatgacattttgaagttatactttttagtgaggtaaataggtgaggggagaagaaatatgggcggaggaggagatataggggacatgcaccaatatggaaggattggtggagagatgtcaggattttgtcggtttggccctggggaaggtctagcttctggtccttatctatccagtccccctggaggaaggctccttgttatagtaatgaggctttttcagtggggggtactgaggttggactgcaggggtaatgaggaggagggaggcaggagcggaagaaagggaggcttcttttgctgccccattggtctttctgttgcctcttgagattttatctgttcctgtgtgatgtccccaacagtgtataactcctgcctcagttgggagatgtgcggcttgaaggagttggtaaataagggggtggttagtgatagggtcactttggcagtaaggaatctcctctcttgccagatggtggcgtgggaatgaagaatgtgatatacatctttggagtctgtgtaagtgttgactcgtttgcctttggaaagggttagggctctggtgagagctatgaattctgctttttgagaggaggttcctggaggtaggggcttagcttcaattactcggtcaagggaaacaactgcatacccagcaattttgggggagccagtgggcccagaaggggggccatctataaatagctggtcatcggggttggtgagaggctcggaggaaatgttaggaaagtgtggctgcaggtgatctaggacgtcagtgcaagaatgagtaggaagggaagaagatacagggagtaaggatgctgggttgaagggagcacttttggcaagaccgaattcaggatttttgatagagggcatggagtaattgaatccggaaaggagggagcctcatgctcgggaggagaggagatcctgtagattatgaggactgtaggtggtggtattttgactcaatgttagtttcctgcttacagctaaagtggccgctgctgctagcattctaagacaggttggccatcctctgactgtgttgtctaactgtttagagaggtaggctacaggggcaaaggaaggagggtctcctttctgttgccctaagacaccgagggctattcctcatcttttggcagtatagagtgtgagaggttgggagataccaggtaaggacagagctggtgcagtgacaagagcggtttgaagtttgcagaagttggggagtatgttacgtgagggatttagaggctcactgagagggcctttggctgcttcatagagtgggtgagctaggagggcaaagttgggaatccatattctaaaaaagcctgctagttctaggaaggaaagaacttcgcttttggaggagggcgagggcagattatctattagtgctgctagggcaggggtcatagcccgggtcccaggggaaagttgaactcctaggtaagttactatggaggtggaaagttgagcttcggagggggagactctataccctttgatggagagaaagttttaagagagtaactgtgtgagtttgagagtcttctagagaggggctgcaaaggagaagattgtccacgtattgaaggagacggctagggaaaaggtttaaggaagtgagatcttgagctaaagcttgtccaaagaagtgagggttatctctgaagccttgagggaggacagtccaggttagttgttgtgactggagggtgtcaaggtcggtccaggtgaaagcaaagaggttttgggaatcagggtgcaggggaatagtaaaaaaagtcatcttttaggtcaatagcagtgtagcaggtggtgttggagggaatgagacagagaagtgtagaggggttagggactatgggatgaataggaaagacagcctgactgatggctcggaggtcttgcaggagtcggtatgagccgtctgattttttaaccaggaggatggtggtgttatatgaagaacgtgttggcctaagaagacggcgtgaacagagcttgtttgtgatgggctgtaagcctttttggtgggttagggagatagggtttttggggatgctgggaaatttagagaggtcttttaactggattttgatggggtcgtggtgagtagctagggaaggggtggtggtgtcccaccctattgggtttacaaaagaggtgggaagtgggtactggggagaggggtcaggggctggactcgcatagaggagtaggagggactccggttgagggagggagaaaaaggtgatagaagctttgaatttggccaaaatttgaatttgaatttggctttgaatttggcctaggatgggggtagggcaacgaggcatgataaggaaagagtgtgggaaaacagtatcaaacagagagcaagtaaggggtctggtggcgcgtggacgcaagatgagtccatcagcccccacaactgagacctgagagggatgagtgggtcctgaaaattcaggcaaagctgagtaggtggccccgctatcaatttaaaaagagatcggcttacctgctactcgcagagttaccctgggctccaatgcagtgatggcagatggggccgggggccctgggcccggtcagtcctcagcggctaggctgaggagctgcgggaatgcaagcggttcttcactttttgtcttgttaaaggggtggtggctctgaggagcaggcttgtctgtctgttgagaggacagtcggacttccagtggcctgtctgctggcacactggacaaggactctttggcactcaagggttaggatacacccatgcccagtggccttctttgccacacttaaaacaaggcccggagggttgctgctatcgggtcttttgtgcccttgggtgatacggctgggttgatggacagccgctgctagaagctggtatttagcacgatctctttgggctttatctaatttattttgctcatccctgttattaaagactttgaaagccaagttaaggaggtctcgttgtggggtctgaggggcatcttcagcctttttaagtttgcgccagatgtcgggggcagattgggaaataaaatggatgtaaagaacaatagttccttcccgggaggcgggatcgacacgcgtgtatttttggagagtctctgtaaggcgagaaaggaattgggcagggttttcattggccttttgggagattcctttgagtttttcgaaatttacagccttatgggcagttttgttaaggcctgcagtgaggcaagtaatcatatgattacaggaggtctggcaggggcctgtgggttgatacgcccaggtacgctcttctcagggaactgcagcggcccctactggcctagtaggatcttgccgatggaggtcatcggcatgggcctgggctgcaagccacactctttccttttcttccggaaggagggtagaagacaaaataatatagagatcatgccaagtaagttcataagactgggtgagatatttaaattatttgatgtaagtgtcgggatcggagaagaacctggacgtttctcaatttgggaaacattagagagggaaaatgggacgtggacacggaccatcccttcggcccatgccacttcccggagaagaagcaagggagcaggctgctgggcgtgttgggctcgagaacgagtaaggggtggagatggggaggactcagagtcggaggtggggtggttggagagaaggggagagagaggtagagccggagcggaggcatacggtggggggtcatgctgttccggtggaggattaggatgttgtcgaggaggggagaaatcggtgggatcaaagaaggagaagtcgtccgctggggctattgggatgaggggagcaggaggtgagtcgggtttggagcaggcgaggagaatttgaaaagtacagcaggactggcagagggagggacgactacagagagtaaagaaagcctgaacatgaggaatctcagaccacttcccactgcggtggcaaaagttgtctaagtctctgagcatgtcggaatcgaaagtgccattttcaggccattgggagccatggtctgatttgtattgaggccatgtggtgttacagtaaaagataagccttttagggcagatttctgaacggaggccaagagtatacagattgtgtaggaggcacccaaggggggtagttttaggaggaatagactgagaggctcccatagtgaatggaagggaggggggtagaggaagaagagactgccggtgacgtcccctttcccgcggaacttgtcaggaatagaggaggtaaccaccgtgtcaggcgtccctgaaacggaggaaccagaggcctggaggctggaggaagcccttggcccagcgctgggtctttcggaaatgggagatggacggtcaagagttcagggaatggcaacagtctctttttactcaccctggcggaggctttgatggtggatgaagtcaccagcaatgggagagtctaggagattgtctgggtctttggcaggttcggggaaggggagattggccaggagaggggtgataggggagggagggagagagagagaaaaagagagagagagagagattgatagtgagcgagtcctggccagagtctatcccccttcccgggtttcggcaccagaatgttaggtcatccgagagaaaggaaaaattgacctaaagtcaggcaagcaagtttttattaacctgccaccggccgcttaacagtcagaggaagcagccccaagcttacagattgaggggtttatattggggaagggagtttgagggagttcttcggtatggtcacatcccggggttgtttgctggttaattttgccacatatcaccttgtgatgtttacggtagcagctagatgaacagcaggaacttacagaagggtgtaggtaaagtttgtttatgcttcccacgatctccccttgtgcggtccagatggtttgtaattggtgaggtctgttggctctgccctaacactgaccacagtgccccttctgcccttccagtctgcagcccctctttcctggagtaaatgaactggaccaaatctcaaaaatccacgatgtcatcggcacacccgctcagaagatcctcaccaagttcaaacagtaagtattgtgttctgagagtggatgtggacccactcccctgctaggacctgcagcagggcaagcccctccctgtgcctccctcaaacccctctcaggagctcctttggctgactacaggggttcaagttcacttgagggccagtgagtggctgctcagacagagcccatcactttaagtggtctcaaaggtgagctcttccttgagcatcacagaaagatttgtcacaggctttctgagggctggggagtcaggctgtgttccctgagtaatttaaacaggacttagaagcctttgggtggaaacgttccccaagcacagagcataggtggtgagggctttctgcagccctccacagccctgctggcgggaccgacgcctggaagaggtgttcccggactcttagggtcattctggtgaagctgaggctgggagttgggacttcccagggagggcctgtgggctgaggggcaagtagcacccagcggcccccacatcccagggagggagaaggtggcaaccattttggactcttctttttttgttaaattttatttcattcttctcatgtgggaaggtgatattaatcttttataggaaaggtagttttcttacatttttagcataacagatccccccctttataatagactatttttaaatagatttttttaagagcagttttaggtttccatagagccctgtccccatgtgcacacagcctcccctgtcgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcgccgcccaccaggccctgcagcacccctacttccaagaacagaggtaggcactctcgtgggttcggtggggcagatgcaggacctggcaaatgagacccatgggcacatggtggggcaaggtactgccccctggagggtccctggttcttgggaatcgcgctctctatcctgaagagtggtcagggcctcttggggcccacaccgtgctgccttctggtgtatcctccccaaaatgaggatgttagcagctccacggcaggagaaagaggggctggctgtccactttgcggttgatgccaaggctacaggtagtaatccttctagaagagcctggtgtgcggcccttgtaaatggtgtgaacaggatgcattctgagatggtagagcactgtggatgtcacctggcgctggaagtacctgctgaatgtgaatctaagacctgtctgccctgaggtcacctaattccggacctctggacactcctgtttgcctaactgtggaggtgacagtttgatctgaaactgcgagtccctgggtaggcagcgcttctgattcatggagccagctctgttcctggcccagagactgtcaggctgagacagaaaagaaaaaaaaaggctcctgattacagctcaggcagaaaagaagagctagtgacaactcacacagtagacaaattggagacaaagaagccagtaggccgtgtgctctgcgggctctcagtggagctgctccattctcttctccttccccgtaggaaaacagagaagcgggctctgggcagccacagaaaagctggctttccggagcaccctgtggcaccggaaccactcagtaacagctgccagatttccaaggagggcagaaagcaggtactaagcgaaatcggagccggagactgcctagctcagccgggactggatgccctcgggtggcctgtgtctctctcaggaggacgccacctgtggaggctgtggcagaccacattgtcagtcgaggcctgaacagcatgcgagttgatggctccatgtgttgggacatcagggaccccagttctatttgctcaagccctttctgccccagtagctaagaattgatgacgaatatcccatgtgagcaggcccagagaggggatgtttgcatgaacttttgtgtctgtcctgatgaccatatgcaggtgccaggttctatgccaaagcaccgtgcagacatcgcccctcagaacggccctggagggaggcgccaagaagatgcaatgctggcccaagtcacccacccagccagtgacaggtctcaagtcactgtctctgcctggctccagatgagcacttcgtcccatcagcagaggttgtgcacattttcggttgagaaatgccagctttgcccctcagtgccttcaccttcccacctaccgtgtggcatcctagcctggtgcagccctgtgtcacctgctggcagggtcacaccagtctcccagttctgggctggcaccccaacagtgtgacagtgtgcccttccatcattcgtctgttcggtcgtccgtacgtcactcgctcctcccagcctttaccgagtgctccctgaccgcttgggagctgggaacccagagctgcagtcaggctgctctccagaaagccaggctcctgtgtcccattggtccctgatttgacagctccacttgaatgtccgaaagacagacttgctgaaaccccttctcctgatctttccccaaacgtgctttttccctgtggcttcccatggccttccctccgagggaggcaactccgtcaactgcccaggccccccgtggacccttccttcatcccacaggggcttcgccttcttgcctcctacatcctcctcaccttgcctaagtcaccacagatggcctcctcactactgtccctgctctgcctccgctccctcctggacagagggtctgcttcaaacccttgatgtcactcctggccggcattcacccaagtccccaccctcagtcacatccgaggtcggcatatttttctctaagggtctgataggaaatattttaggccccgtggccgtggggtgttcgttacactccctgctttgctgcagtgtgaaaggagctggaggcaacacatgaaccacataggggctgcgttccagtagaactggggacactaaaatttgaatttcacataattttcacatgccatgaaacatttttttttcagtcattaaaaataaaaaccaggtgggtgcggtggctcacacctgtaaacccagtgcttagggaggccagggtaggatcacttgaggccaggagtttgagaccagcctgggcaacgtaggcaagaccactgccccaccaccccatctgttttaaaaattagctgggtgtggtgcgtgcctttggtcccagctacttgggaggctgaggcaggaggatcgcctgagcctaggaagctgaggctacagtgagccaagattgcaccactgcactccagtctgtgctacagagcaacaaacaccgtgtctcaaaacaaacaaacaaacaaaaaaccccaaatgtaaaaccatccttagctcacaagccacccaaaaccaggcgacaggcagatcagggtgtgagaccttggagctagagcaggaggcaggaggcgtgggcaccacagcccgcgagccctttgccgcccgcactgctcagcttgcagtcggcattcttcaggttccccctgaaggtttggcctcccccgtgggactctagtgggcagccactcccttggggtgtctgggacctggtggatgtgtcccagtcacatcttatggtcaagaaattgtattaggcaaaagcagtacaaaagagcctctttcgtttttcctaatttccataaagcagaaagcgttttatgtccaactggcctctgttctgtttcaagaaacagtccctaaagcaagaggaggaccgtcccaagagacgaggaccggcctatgtcatggaactgcccaaactaaagctttcgggagtggtcagactgtcgtcttactccagccccacgctgcagtccgtgcttggatctggaacaaatggaagagtgccggtgctgagacccttgaagtgcatccctgcgagcaagaaggtagcgcggaaccagcttctctgacggcgctgctcttcgacccagcccaggccgccactgaattttgtgtctgtaatttttctttgacagacagatccgcagaaggaccttaagcctgccccgcagcagtgtcgcctgcccaccatagtgcggaaaggcggaagataactgagcagcaccgtcgtctcgacttcggaggcaacaccaagcccgaccgggccaggcctgggtgatctgctgctgagacgccacggagggctggggatgcgcctgcgtccgtttcgcgctggccggggctctgggtgctgccctgcgccctgccgcacccgcggcccgcgcagctgcctaggatgttctgggctaatatacttgtaaaaccaccgcattctagggttttctttcattttcgttaagaatttggggcaggaaatactttgtaactttgtatatgaatcaaaacaaacgagcaggcatttctgtgatgtgttgggcgtggttggaaggtgggttctgcgtgtcccttcccagcgctgctggtcagtcgtggagcgccatcatgtcttaccagtgacgctgctgacacccctgacttttattaaagaataagctgtcgttacagtattgcattttaatgttttccgagtccaacatgtgtccttaccagccattcctttattttagcttttgtgggcacacgaggggaattgattttgttgggaagactttggtgtggcttaatttttttttttttttttttttgagacggagtttcgttcattgcccaggttggagtgcaatggcgcaatcttggctcactgcaacctccacctcccgggttcaagggattctcccgcctcagcctctaagtagctgggattacgtgcatgcaccaccacgcccggctgatttttttgtatttttagtagagacggggtttctccatgttggtcaggctggtctcaaaactcccgacttcaggtgatcctcccgcctcggcctcccaaagtgctgggattacaggcatgagccaccgcgcctggcctggtgtggcttaattttcatttgaagaaccattcagaaaggaacacacacaggcgtgtcctcggagccctgtgtgctcctcagtgaccagcctggcgaggtggtgcggggcacagggcaggcctgaagggtctcttctgagcataggcttcaaggtgaccacgttgtcattttagctcctggtgctcagctgtctctggggagtatggagccctgcccctggcctgtcagtgggtgctttgagctgtttgctgagtgccaacaataagttgggcaccttgtgtcctagaaagagaaacctgtttccccatggggatgggaatgggaacattgcaaagaaaccgtggcactggccgggctgctgggcacaagaaaagtcctagtaagtcctcttgtttatctgggaaagtaacttagtaattgggtcttctttcttttttgtcatcttcccaaacttaaagagatatttttgaaaaaggctaaatttcccaggctagtagtgtttaagcctccttgctcccctgttgagacaaatctgtgacacccttccttcacgtgctctccagtggtcctggccccagccccaggccacctgacacgacagcggggccgcaggagatggaccgcgggccacgcggagggagggcaggctggaggaggaggcaagggcggggagcgtggggcagcgagtccgtgggcacaggtgcccactctgcaccacatgggggcaaaggaacccaagaagaagggcagattccagtccggaagtgaggcttgccgtaatgttcagaccggaagtgaggcttgccgtaattttcagaccggaagggaggcttgccataatgttccagagcagggtgcagtgcaggcctttccccgggctccttttaaacccatttgagaccctggtgcagccttgagggctgcccttgctgtaggggaggtgtctgagcaggggggtggtgccgttctgcctctacagagggcctgggagtcccaggggagtcggacgtcaaggccgtgggcagagcccagcagcagggagggctgggggacagaaggctggggagatggctgtagggggggcggcgcgcaggtcacaagagagggacctgtgggtaggggagtggtggctaggagggccatgccctgtcccccggcctggcttcagggtcaggcatgttaacggattgagtgtgtacttgggaaacgtgttactctctttatgtctataaaatatgaagggaaagtctttacagttcttctgcaggcttttttgagaaagcaaatgtggtctgcagatgccggtgcccaggacaccagctgccctgtcctgactgtcacactcctcgtggtgggggcagcggggctgggggccctctggaggcaagaaacagtccctaaagcaagaggaggaccatcccaaggtccaccacttgaggccctcctggtttagttagactcgggcgtaaacgctctgaagcagtgtcgagcccggcacgccagggcccagggcagctgggcctccaggctggaggtgagcaggggaccagagcccagctccacaggccccctc

SEQ ID NO: 13573 - DNA, 13842 bp, Human
ttctttgctttcctttttctttttccctagagatagaggtcttcttatgtgcccaggctggtctcgaactcctgggctgaagtgatcctcctggctcagcctcccaaaatgttgggattacaggtgtgaacctataatgttaattcatcccactattggtggttttttaacttttaccacttgaataagatgctgttggctgaggatgctggacaattaccccctagctcctggtgtcaccaactgcactggctgaaccagccatgctagccacagacccctgactgtgaccaaggggaataggtatacatatttttaattttcttgttatggatttataaggtaagaaggagagggataaggatgataaagtatatttaatttaacatgttgtttgtttcataacttctttttttggattttattttttatagagacaggggctcaccaagtctcccaggctggtcccgaactcctgggtttaagtgatcctcctgccttggcctcccaaaatgctgggattacaggcctgagccagcacatccagcctgcttcatgacttctttctttttttttttttttgagacggagtctcactgtcgccaggctggagtgcagtggtgtgatctcggctcactgcaacctctgcctcctgggttcaagcgattctcctgtctcagtctcccgagtagctgggactacaggtgcgtgccaccatgcccggctggtttttgtatttttagcagagatggggtttcaccatgttgtccaggatggtctcgatctcttgacctcgcgatccgcctgcctcggcctcccaaagcgctgggattacaggcgtgacccaccgcacctggcctgagctaccgtgcccggcccacaacttctaaatattcagatgaatagtatgtgggtcttcctatgaacccttgccctaaaacatgcagaagttaggagtcggcctgtttccaggcagactttccttcctgatgcttttgcctccagtgtaagcagggcctgaccaagacatggagcacctttggtaggctaataacttgataatccaccaaaatgaaggtttttaaatattttctataaatacgaattgaatacctctttctttaccctttcaaaggtggctccacaaaagtagaatcacacttcctgtgaaaagtgttttaagttttctcctctagagctctgttgacatcggccatagcgaactctgtttatttttcctattatataaggaattacaagttggaatcagaagtaattggcatcctaatcctgatttattctagtggcagtgttttggagtcacttaaccctgtcatcctggttggccgtcccttctcccagctctaacggtgagcagctgataccctgctaggtgctggagagtcagaggtggacatcagggcccacctcgaaaagttgacagtctgtggtgggctgaagccagtagaaagctgctgtaggaaggcagaggagtggcccctatcccaggcttggggctctcagggaaggcttcctgggggtgagatgggagggtgggtccatatgctcttggaccagaatgagtagcccagagaaggcaagagggctcccaagcaaacttgtcctatttaattttttttttttttcctgcttagaaaagcaaaatgcgttatgaacaaaacaaaacaaaacaaaacaaaacaaaacaaaacaaaacaaaacaaaacgctgtagcaaagaaagcgaaaggctccagtaatcctccctgctcctcctcaccgcacggatcctgtgagataccccgagcattggaacctggagagcttgggcaggcattcaccctccttccagcagggggcggaacgtaaaacgccttgtggccgacgccctctctctttcacacgtcactggcgtgaccgtccgcgctacatactgcgcctgcgcaagggctgtggcccttttcccaccccctagcgccgctgggcctgcaggtctctgtcgagcagcggacgccggtctctgttccgcaggatggtgagtggatgcctcggtctcggggctttagatgcatggaggttcccttttcttgcccgtatgccagcctagggcccgtctcgcgcgtcgcaggggccggatggcgttagattgctagctctgacttggtcgaggtgcagttcccagcgtggccttaaatggctgccgcccggtgcgcgaacttggggggaggggttggcgaagaagggttgcgtgagcttggacggcggattggggagaagggtgagtttagtagacagcctgagtgcggatactgccgtctagtgtgagggggcgctggcaagcggccgggcgtgagaggtcgcaagcagtcgacctcagcctagctggggaacgccagaatggaggggggctgcaggtcctcgggtcccactcgacctccgagtaccgagtacttcgtgggttttccaggagaatgtcggagccggcaagtcttagatttaggaagcttgtgcccgtgggctgagcaagtggcttttaagccaaaattgtcagtggagcttggaggccgaggggtccctgggccccggaagctcctttaacatggaatacgtgcctcctgcctcttcctctagagtccgtcgccggatgagtttttaattattggggtagggccccaagggtgggatgaaatgttgctttagctgatggggaacagtgctgttttagtgggggaattactgctgaatgtgctcttgcccagttaagctttgtggcaggtaatttaggcttttgaaaaacataacatgggaagcgagagaggtacgtagttgttatttgaggctaggttttcgaagtgggacatagcgtgttccgaacaaaccgacgtttggcatcactgattgctgtctggagcagtgcttcgcaaaagtttggcacaattaccggtgctggtccttgaagaaacaaatatggaaattgaaagcgtttaaaaccttttgaaagcaatataacaataattttatacctgttaaatgtaataaattggggcctgcattttgtatgtttcttttattccatatttctctaaggattcatttttattgttttatgaaactactagtctgtgacatggaaggtagaggaaaaagattcttgaccctagttgcttgtgaaacctgggattctacaagtgacagttgtctgtttactcttgaagttcaagtgttactttgttacatggttaatttatgtcaaaagtatcataggctaagacatcaaagttttaataacattcttttttctttaaggggtttgttaaagttgttaagaataaggcctactttaagagataccaagtgaaatttagaagacgacgaggtactgtcacctttttgtgtttacaatattaatctgctttgcagatgcagtggagtatcctttctacaattatttttttctttcagagggtaaaactgattattatgctcggaaacgcttggtgatacaagataaaaataaatacaacacacccaaatacaggatgatagttcgtgtgacaaacagagatatcatttgtcaggtaagttgtattctagacagtcccctttttttattgctagagaaattgtgcttgggaagcaaagcacatggtgtgtgtgttagaagggctgtctagcacctccaaaagcatccagtgaataatttttccttttagtaggtctagaattggaacctgggaacttggtactttaaaaaatgctcttggttgcgctcatgcctgtaatcccagcacttcgggaagattgcttgagcccaggagtttgagaccagcctgggcaatatagtgagagtttgtcttcacaaaaaatgtaagaaaattagctgggcatggcggggcgcacctgtagtcccagctactcagtgggaggattgtttgagccccgaggttgaggctgcagtgaagtgagatcacacccagccctccaacctaggtgacagagcaagacactgaaacctagtttatgtgtgtggggtggggagattagaagtaagtaagaagttcttgcccatcccaattccagtagaagaatagggtttgtcctgatttttcctatatggccttatatgccacttaaccactgaaaaggtagttgtgaattaaacagggctttaagattgttctgcttattctttgaaataggttttaataaaatgtacaaaggtggctcccgcatgaaagacctttaggaagtgtcagttttgctcttgtactaagagcattctcactggactctgaaagctagaatcctgggcttttacaactaggagaaattctgagagttaagatttattgatattttgcagcaggtaggcacacctgtttcctgggcaaatagtttgttgattgtgaaggcattgtcttcctccgtacccaagttcagataactaaacgttaggttcctgagactttgctgactttagttatgtttagttcaaaagatgattgaaatatttgggtattcctctttgactttttaagcacctctaatttactggtaacccagctaagagtcttaagcattttaagtgatgttcatctgtgtccatcaatgtttttttattcccttgaaaaataattaagatgtagtaagacagtgaaagcaacagattactaacctagtttctctcttactatagattgcttatgcccgtatagagggggatatgatagtctgcgcagcgtatgcacacgaactgccaaaatatggtgtgaaggttggcctgacaaattatgctgcagcatattgtactggcctgctgctggcccgcagggtatgtacaagatgattttaattgatgtagtttgtggctgattgcttggagagttttctgcaagatgtttgtacatggataagatagcttaagttgtgcttcaggagagtgcttgcttccagttttctgctttgttaatggatctatctaggtcagctctttccaataaaattttctgcaatgacacaaatctgtaatttgctgtccagtggttttgccactagcgacctgcagctgttgagttccagcagtatgtaaacttgaatttgaaaatccacttgtagctagtgtctacttaattggacaatgaagacccttgctacttaggtatacattctgaatgttggcaaacattaaaaatgcagactcgtgggaactccactctagaccttctggaatctgtattttgatagtatgtaccaagtgatttatatgcacattaaaactggagaatcttggctaggcgcggtggctcacacttataatcccagcactttgggaggccgaggagggtggatcacttgaggtcaggagtttgagactagcctggccagcatggtgaagccctgtctctactaaaaaagtagaaaaaaaaaaaaagccaggcatgatggtgtgtgtctgtagtcccaactacttgggaggctgaggcaggagaatcacttgaacccagaaggcagaggttgcagtgagctgagatcacgccattgcactccagcctgggcaacaagagcgaaactgtgtctcaaaaaaaaaaaaaaaaaaaatgagaatcttagtgttttggagagtggccattgacgggaagattcatttttgttttaaacatttttcctggtagatgaagatgggattttgccttgtttttattatctgagttttttaccttgttttgcaatggaattgttaagcatgtgcagcaaggttgatgacaacccactcattggttataaacatgttttaatggagggaacattgtaagtataagaatcaagtttatgcattctcattgattgctgcataagtcaagtgtggacatgtagcaaagatgcaaaagtcataaaacaaaattgtttcaagtgaaattgaatgttttaagttttttttttaaatagcatttaaaaattcatgagcaagtggatctggtgaaagggtgggtgtggaaggaaattttcttttccagatgtcagtggtccttacggttatgacataagctattttaattttagagcagtttgaataattgaaaccagcatttacattggtttcttgaatagcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacaggtaagaatactatttaagaccttggtgcctggaccgtggtacttccctgtttttaactagttggactgtggagataaccgaattaaagtagctatcaattgaatgcctgctgtatgcctaggtaccatgcaggaggaacctagtagggcaggaaggaattatagcccattttataaattaagagtctgaggcccagagttatttgtcccaagtttttcgggccagttattgaaagagatgggattgaaaccactaccttttgcatatgacttaattcttattagaaatgagcaactccatcctctttccccatgcactttcttttttcaatcagaataaaaatgatttactgaattatgcaaaaaggtggatcctagaattttataagaagtttgaggaaaaggcttatgaaagatttctaaacctgcaactaggaataagattgtaggccattttgggaagttaagtaggttaatttgtagttccattggtttaatgatattttttgttgttgagtctgtgcatcttgatttattaacttcttaggaatattttagcatttggtgatttaaccaagaaatagtaatttttggtaagcctaaaatacaacccaactgaaattttgcttttatgatgtggaggtgggtggggggagttagttgcaagtacaccaagagcattctcacttgacaatttcattaactgtgatcttggacaaatcacttattcccatgtacccactgaaaattaaaggatttagagtataagttttgaaactccttcctgtgctgatgtgctggatgactaattttgtagtggtggaaagccttggtaatggcttttaaaggtttttgtagcatgaatttcttttctgtcctggaattcagagatgagctgctgaatgatgatatcccactaactgagcagtcagtagttggtcctttggttgcatatgatgcgataattgtttcaagacgggactgatggcagctactaaagtaaattcttactagtaaactaagttaagtgagtctatactaaaatatgaataactttattttagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatggtaaaacatttacctaaaaatgcctatattggttaatttatggaaataggtttattacttgttttgggggcaggtaacattcttatataggtgtgtttcttgacaacatgagctagacttgtcaacattcttttagtaatcttttagatgctcaagtgtgggagacttcaagcatctgaagatttggctaccttttatgctttggctgttctgtatttgtagatgtcatttctgtaatcatagttgtaatctgctttgttggataagaggtgctagataataaacttcacttattttgataccatctgggaggaaagctcttcatagcatatgtgtgctatattctggactttcccattatctcagacatgtacacaggaaaagagatttgatcactgggtctgcgtgatgttgtagaaatgaggggagccatgtttgcaagaatgagtcccaaagtgctgggcttacagatgagagccattcctgacccaggttctttttcgttagtgtgtagtagcttctattttggcatagctattggttaggaaaatttttaaaaacagtagttgggaaatgaccactttctgttatttctatgctttggacacagtgtaaaggctgaataaacaaatagcttgagtttctgagttaggaaaaggagtagttttttatcaataatgtaggtgcatgttaatttttactgcgttatatttctttgttacttatgacttcatcctggtaaagaggtcatttacttttggattatgattctactagtcttgcaaaatttacttcctaacctatatctttatgtagtcatgtcatacttgctcagaacttttcagactcccagtttgtgctttcagatgtttacttcctaatgctttcctgtatatgtgccttccttcagctagactactttttggctaatgtatttttctagctggctcattaattttatctacagtggcctctatcctcctgtgtgcctgctgaaatcctgtgcagacatctgatgtgtctccaacaggaggtggtctttacctcaattcaggcattatctacatgtctgcttgtctgacgtcttggaaggaactgggttgcttagatttgttgaatgactatatatgaagtcatcaaatggatttgttatttgttagtgaacagctagctataatagagtgctaaaagaggtagggaaattaactttcaaaatgggtataggtagttgaggtttcaaatgcagtgagcatttttgcattattttcctttaataatctttatgcaaatgcatgtagtaatcacatctccacattgattgaataattttagagacctggattactgtgacatagtctgtagtgggctataattattagatattcagagagttgcagctttttttttttttttttttcagtgagttttagaacaaaattgccctggcggggcatggtggctcacgcctgtaatccccggacttgggaggccgtggtgggcagatcacctgatgtcaggagttcgagaccagcctggccaatatggtgaaaccctgtctctgctaaaaatacaaaaattagctgggcatggtggctcactcctgtaatcccagcgactcgggaggctgaggcagaagaattgcttgaaccctggaggtggaggttgcactgagctgggatcgcgctactgcactccagcctgggcaacagagcgagacttcatgtcaaaaaacaaaaaattgcccaataaaatatctgatcggttggcttttcaggaaaacttctgacatctttctggtctagaggccttatattaccactagatactagggatagattggtggtagtgaaagacagaagagaggtccttggtacataatgctgggaattacttttaaaggcctgtgagataaagatggaaaacaaaagtctagggattgtgggatgacagatgaatttgcttgttggcctgtgtccagtccttggtctcagttaagctatgtcagtgttgtgactcttggtcccatacgttcatcatcttaatatcttaatacttttggcacttgttcttgaatgaaagaatctaggtcagacagtatttaaaatgagaagcgcaatatttgtttctgcagacaaaaatttgatttagagtgactcaagaagtgtggctgaatttctcagaagtacatgcagatttttctttttgttttcttactttttttttttgaggcaggatcttgttctgtttcctgggctggggtgcaatggcacaattatagctcattgcaacttcagacttctgggctcaagcaattctcccacctcagcctctcgaggtagctggggttataggtgtgcaccaccatgccctgctaattttttttttttttttttaatttttggtagagatgaggtctcattctgtcatctaggctggggtccagtgagctgtgattgtgccactgcagccttgacctcctggactcacgtgtagtcctgtagctgggactacaggtgcatgccaccattaataattgccacctggctaattagtttttttatggagacaggtctcactgtgttgccttagctggtctcaaactcctgggctgaagtgatcctcccacttcagactcccaaagtgcttgagattacaggcatgaaccaccacacctggcctgatttttttcttgagtaagatggagttctgtagtgataattcacattgcataaggtgaaaattgggaatttgttaggaaaaggtgagttacatttagaagttaaagtgtttaccaacattgatttagtttagttccttttgagaatctggcttagaaggacaagataagttatggttgcattaatatagtagggcacatgaaatgaaaccaagtactgtttgctttcctttgtttcagatggaggagatgtataagaaagctcatgctgctatacgagagaatccagtctatgaaaagaagcccaagaaagaagttaaaaagaagaggtatgtcgtctttttttttgtcttttcaagaaaacaggttgggaatggttcccacgtggggcagactgttggtgtaattgtgcaaactcgatcactagctctgcgtgatgtggcagaagcgaagggaaccaggtttgcaaaagtaactgtggtgatggaaatgtgttagcctcagacactactgaggtggttctttctatcctagtacagtctaagtactggttactgcatttttttattggctgacaagttgctttttgttgatctttcatgttttgatctttaaatggaatagaaagtaatacttaatgaacatgtaagcataaagtgatgtgatggcccacaaatacaatgtatagtaattaaatcaatgtatttaacatattcacctcaaatacttaacactttgtggcaacaacatttgaaatttattctcttaattgtgaaatgtacgatattctatattcatcatgctgtgcaatagaactaaaaacaaaatcatactcctcctgttggagattttatacttgactatcatctgcccattctttgcacccaccagcctctgtaaccaccattctgctctctgcttctgtgagttccattgttttagattctatatgaatatgaagtatttgtctttttgtgcctggcttatttcactgagcacaatattctccacttcattcatgttgcaaatgacagaatttccatcatttttaaagactgggtaataatccattatgtatatgtataccacatttcctttatccatttatctgttgctattaatatatagtgctgcaatgaacatgggagtgccactctcttggacaaactgatttcaaaacatttgggcaaatacctagaagtggtattactgaatctaacatgtcttctatttgacttttggccctatggtagtaggacatcacagaagttggggtttgggaaagttagcttaagatcatacataagtaaatgtatttgaacttggattatttaaccttctgattgcaaagtcttaaatattctctatcaaaattaaattttattaaaattttaaattaaatattctattctcttcagttatagtttaaaaaatatatattcctatcttttgtaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactatttctgtgttaagctcttattcttatgaaccttataggaaataccctgaaatattttggaaaagcaaaggagttgacaggtttttttctccaagaaaacaagtgtaactaactttttaagaaaaaaagttgttatttcttgggcttctgttttacctgacaggagtcattatcccttatgttgtatgatgaacagctctccctaaaaatttggcaagcaacagaccaaccatcagtgggaaatatttcttccatccatttattataaccagatgatgaatgggaaaagtaccttaaagtaaacaaaactggtgctaatccatggcgttgaaggaaagttttgagagaaagctgtccagtgatggtcacatagatttttaacatgttccactttaggtaggcgaaacctttgagcagaaaatagtggatcttttctccaaaaggtgtttaattttatggagatgttgaaaggtacatgccaaatctgagtatacgtgtgaaaataatatgaaagaggagcaaatactaaaccttgtatatcaagtttacatggggaaaaaaacattagataaataaatacatttacatgcctctttaagaaatagccctttggcccacaggatatactgtttgaaaatggaaagttattactaaaaagtctgctataatttattttagtcttgcacttacagtcccactttcacatagttcaaaatcaggatatgtggatcttgattgggccttaagatgtcagttttgaagggctcagtcagctgcgtgatactaagatgggccctttgaatctttaggaaagttcatccatttttagtcaataaaattggtgtactgtcaagtataagatttcttgaagtaagccacttgaaccattgtgaagctacacataacttgatgtctgaatgaggttaaaaatgggtgtataagtctttaatacagtaaaccatgctattaacccaacatctgttttataaagaagcaagtttaacctgctttgcagtcttaatttctgttaatgtgcaaactttaccatgctaagacattagtaaatttataaattttcttgttgaacagcagcttcaatgcaaacacaatgcttccagcattggtattttggctaaggtaaatctacaaatcactcactgttgatgtttatggaatgaagcttttcacagcattggtttttaaagtcagtcaaaatagttacacaatgaatgtacttcggagatgtaacagggcttctaaaagggcaggaatgacatcttggggacctgttgatcctacacctgccattacttcagtaatcacatactgatggcttctcaggcctggggggaaggagttttgtgtaactggcaggaatttgaagccatttttttttaatgctcaaaattgttctttaaaagtggcaggtttcttaaaatggtaattatgtccaaatgaactaagagtcattagtgtaggaaattttcttccacaataatgtttttaggttatttagtatcaaagaatgttccatttccatttgatttgctgtgactttgagagcaatacaagaataaagctgcttttctaattcttcacgaatttcacttggagcaccacgcagtaggtagtctttgagtaactgacaagcttttgccaagtttggttgtatcacttctgaagtacacttcattgtactctgatcacagctagttctacaatctgtgccatagacacagtccaaatcagactcacagtgacgatccttaataagttctttcaggtttgtctctggcacaatttttctcatatccaccattttcaaatcatacttatcattatatcctaggtttttggcactagtatcgcacatgaggaaatttccgtaggggccatggaaaacatcttccacaaattctagaagtcctatggctattttggcctttcttggccatgatggtgtgaacagctgatccatgcttcttctgaacccagatggaa

SEQ ID NO: 13574 - DNA, 66164 bp, Human
ctcagcactttcggaggccgaggcaagtggatcacctgaggtcaggagttcaagaccagcctggccaacataatgaaatgcccatctctaccaaaaatacaaaaattagctgggtgtgatggcaggcgcctgtagtcccagctactcgggaggctgaggcaggagaatcgcttgaacccaggaggcggaagttgcagtgcgccgagatcacgccagtgcactccagcctgggcgacagagtgagactccgtctccccgctccccccaaaaaagaaagaggtatgtacagggactttgggactcaagggaaaggcctgggtggatgggagggaatgagagaggctcttgggcagaagtgataactcgtcttgatcttgagggacaaatagaagttagactaaaaagtgaggagggaagttcaggtaaagagaagtttctcaaaggcatggatgtatgtacaccgagtaggatgtgacagtggataattgcttttttttttttttttttttttttttaatacagatagctgctatggctgggcgatctcagaggatcgcctgagtcgctcacgcctgtaatcccagcacttaggaggccgaggcgggtggatcacctgaggtcaggagtttgagaccagcctggccgacatggcgaaaccccatctctactaaaaatagaaaaattagccgggcatggtggtgggtgcctgtagtcctagctagttgggaggctgaggcaggagaatggcttgaacccaggaggaagtggatgtggcagtgagctgagatcgggccactgcactctagcctggatgacagtgagactccgtctcaaaaaaaaaaaaaagatggtcctgctgtgttgcccaggttggagtattgacaggcactgtcatggccaactacagcctgaactgacctcaagcgattcttctgcctaagcctactggctagctagtactacagataccctgcctcactgtcgctgaccgtgttgggaattggtgaagtagcaagagatgagtctagtaagggggcagattataaaggggtttgtatagcatgaaggatagtgagttgaactgtatgatcttaagcaacaccattgcataatttatgtggtgactagtgattgaataaaagcagtggtttattggatggagaataggaaaacagtaagtatctcgaatatttaaattatattcagcagtcatttgtgcccatgtatttgatactttgaagtggctgagattggcataaggcggggcggcagggtggcgggggggcgtgtatagatggaattaaaaaaaaagaaaaaaaaggctgggcgcggtggctcacgcctgtaatcccagcactttgggagtcaggagttgaagaccagcctggccaacatggtgaaaccccgtctctactaaaaatacaaaaaaattagccgggcgtggtggcacgcgcctgtaatcccagctactccagagggtgaagcagagaattgcttaaacctggaggggcggaggttgcagtgagccgagatcacaccactgcactccagcctgggcgacagagtgagactccaaagtggggaaggtgaggtggctcaggcctgtaatcccagcactttggcaagttgagttgggcagccaggagttcaagacaagcctggccaacatggcgaaaccccatctctactaaaaatacaaaaaaaattagccaggcgcagtggctcatgcctgtaatctcagcactttgggaggccaaggtcagaggatcgcctgagttcaggagtttgagaccagcctgggcaatatagtgagaccctatctctataaaaaatacaaaaaactctgcaaagagactgtatccccaaattctaactcaatgctttggcaccatttgtaggtgctttatgttagtacatattcaataaatgaacaaatagaatttggaaaatggtatcctggaaaccagaagagcattttaagaatcataatagttcagtgcagatgttcctgggaggtcaagttaagagtcaaaaataattcattagatttaacaatttagcatggtaagtgttaatcttagtgtaaggggagttttagaggaatgttgggggaaaagccaagtgtgatgtaggctgtaaagacagtgggtggagagagaggccacaggatcatgctgaagggcttaattgaagctctctggcttcctctgcagtctggcaggtgcactggccagaaaggggctctttggctgaatgctatgagtccgcttcagtaagagaagaaaggtggaaaatgctctgggatgaggtatggaagaaaagattgaggccataagaaaatgataggattaagggaagaattttaaaggagacttgacaaagtttatatggagggaagctagtagataaatgtcgaagatacagaaaagatggaccaggccatctgttgaagatacagaaaagataaaccagcacaatggttcatgcctgtgatcgtagcacttggggagcttgaggcaggcggaggagtgcttgagcccaggagttcaagaccagcctgggtaacgtagtgagacccatctccaaaaaaaaaaaaaaaaaaaaaaagagggaccaagggccttccaggggtgatgggggagtgttatctagagtccctgggaaaagagttctagatagaaaaagtgcctcatccttagactgaagggagaagcaaatgagaagattgagtcattgtaaggaatattgtaattcatttctttttttctttattattatactttaagttctagggtacatgtgcacaacgtgcaggtttgttacatatgtatacatgtgccgtgttggtgtgctgcacccattaactcatcatttacattagatatttctcctaatgctatccctcccccctccctccaccccaacattgtaaatcatttctatgaattacctctggcccaaattgaagcctgatctaagtttgcagaaactattttctcccttggactggagactgctcatttgatggtgtaggatttggaattagtgtataagctcatcaagggccaggttacttttgacctccagaatccaagctctttagttctatgctgtgctgtttcctgagattgaagtatgcacttagggcaacacaatttaataactgattacagttagtaatcactgagggaattcaaaaatttgtcagctgggtgttgtggctcacgcctgtaatcccagctctttgggaggctgaggcaggaggattgcttgagcccaggagttcaagaccagcccggccaatatggtgaaaccccgtctctactaaaaatacaaaaattagccaggtatgatggcgggtgcctgtaatcccagcttcttgggaggctgaggcaggagaatcgcttgaacctgggaggcagaggttccagtgagccaagttcatgccactgcattccagcctgggtgacagcaagaaaaagattcttttcagagttcccaaggttattttgagagttattgagtgggcaagagacgtggttttcaggcaatttattcattcaaccatagactgatgtaacaaggggatgctacactattgtgtgattgtcttcaacaaagtgaactgaacttttcattatcatttatgatacattgtttttgaacagttgtaatgagtggttactatgtaacattgaattcttgacattagatttcatctgctcatgatacatttttttttttacttaccattttcttctcctacctgttttttttgtttgttttgttttgttttttgagacagagtctccctctgttgcccaggctagagtacagtggcatgatctcagctcactgcaacctccccctccgggattcaagcaattctcctgcctcagcctcccaagtagctgggactacaggcatgtgacaccacacctggcaaatttttgtatttttagtagagacagggtttcaccatgttgctcaggctggtcttaaactcctgacttcaggtaatccatttgccttggcctcccaaagtgctgagattttaggtgcgagccacggtgctcggcattttttttttttttttttttttttgaggcaagttctcactctgtcacctaggctggagtgcattggtgcaatcatggctcactgcagcctcgacttcatgagctcaagtgatccccccacctctgcctccagagtagctgggactacaggtgtgctccatgatgcccagttattttttgtattttgtgtagacacaagatctcactctgttgcccaagatggtctcaaactcctgggctcaagtgttcttcccaccttggcctctcaaagtgttgggtttacagacatgagccgccgtgtatgacccatctttctagagatatatccacaggtaaaaaatgttttgaaagcggaaataacaaaatgacaactcactataaacattagaagcaatagtggaggctgggtgtgatggctcacgcctgtaatcccagcactttgggaggctgaggtgggaggatcacttgagaaccaagagtttaataagaccagcttgagcagcatggtgaaccctcatctctactaaaaaaattaaaaaaattagccaggtgtggtggcatgcagctgtagtcccagctacttgggaggctgatgtgggaggatggcttgagcccgagatcgaggcttcagtgagcagtgatcatgccactgcactccagcctgggtgacaaagcaagaccctgtctgaacaaaacaaaaaaacagtggactttcacttagatgggttagactgcagattatagttgccagtataatggtaactctgtacttttttcccctccttaaggtggcatattggaatgtgagtgtaagtgctttttagagagaaccttaaattaaccagcatgtttacttctgacactagacaagtggttaggacccaccattaacatgaaaattgtctgggtgcggtggctcaatcctgtaatcccagcgctttgggaggctgaggcaggtggatcacttgaggtcagaagttcaagacagcctggccaacatgaaatcccatctctactaaaaatacaaaaattagctgggtgtagtgtaatgcctccctgtaatcccagctactagggaggctgaggcagaagaatcgcttgaacccgggaggcagaggttgcagtgagctgagattgctccatggcactccagcctgggagacagagtgagactccatcttaaaaacaaaacaaaacaacaacaaaaacctcttttgggttcttttgtaggactcttgtggtggcttctgtttattattaaaaattaagagctaaaattaaaggctttagggaaagtgaaatagtaaaattgacagctgtctagcatagaaatttgcaaagtatcataaaaagccacataagcccatttttaaacgtttaaaagaaacagaagattaaagtaattgaaacagtaagatgggtaatgacagtggatacattataaaagggaaaatttttagtcatatattgctggacagtgagcttcacttcacattagaaaccagggcctccagccaagaaatgcagagagttcaccactgagaagataatcagattatcaaatattagctattgttttgcccagtgacaatgatatcagaattatttgttaatgtttggtgcattcatgttcaggccatctgtggccctcaattacagtgtatttaaggctgttattaaaattttcaagtgtacagaaaggtaaaatagtacaaaaaaactatatcagcaattgtcaacattttgccatatttgcttttctatatagccttcccacaggccttttaaagatatattacagatatgacttcacaagtttttttgagcaacacttaacatttcttcctgtataccttgctattacatctatcaagatgaacaatcccctagatttccctagttgtctcaaaatgttatgaccgatctttttctttttttcttttgccacctttctggctggaaatatggctgatgttttaaaaccaagatttggtatagaataaccaattgagtttggttatcatggttcttcctgccccccccaccccctgcctgcttttcctgagttgtatgtcatggatcttaatgtagagtcatttttcttattttctgtaatgaccttgacttttgtaaaataggccattttagcactgtcccttagaacttttctgccatgatggcagtgttctatatctgcattgtctcatacagtagctcctagccacatgtggctattaagcacttgaaatgtggctaagtttttaattctattaagttttgggtaatttaaattgttatggttaactaggggccatcatacagcacagctctaagtccctgaattttctgtaaaacaaaagttatatctaaaagcttgattaggctggcatggtgtctcacatctgtaatccccagcgcttttgggaggctgaggtgagaggatgacttgaagccaggaatttgagaccagtctgggaaacatagtgagactctggcttcccccctttcctgaaaaaataattaaccaggcatggtgatatgtacctgtagtcctactcaggaaactgagggaggaggattgcttgcgcccaggagttcaagattgcagtgagccatgattgagccactgcacccctgcttgggtgacagagcaagaccctgtctccaaaaaatttttaaaaatagaaataaaatcttgattacattcaattgttcacatttttggcaaaaaggctttataggtaatttataggtactatgtacttagccatgttaaatactacagagaagtctaggaaggtaactgaggaaggccagtgagggatatggaattatggaatgttttacagtatttatgatttgtgggacagcaaaaacttttgtgttagcgctgaacatggagaggatttgtatgtgtgttttaatagattttatttttggccgggggcagtggctcatgcctgtaatcccagtactttgggaggccgaggcaggcggatcacgaggtcaggagatggagaccatcctggctaacacggtgaaaccctgtctctactaaaaatacaaaaaactagctgggtgtggtggcgggcgcctgtagtcccagctactctggaggctgaggcaggagaatggcttgaatctgggaggcggagcttggactgagccgagattgcaccactgcactccagcctgggcgacagagcgagactccatctcaaaaaaaaaaaattttatgtttttgaggagtttaggttcacagcaaaactgagcagtaaatagtgttcccatctaccccgtttcaacactagtacagcaccagagtggtacgtttgttacaatcaatgaacctacattgacacatcacccaacattaatagtttccatagtttctgttttggtgtacattccatgagttttgacaaatggatctaccgttatactatcatacaaggtagtctcacttccctgaatatcctctgtgctctgcctattccctcctccccaaacccctagcaactgctgatctttttactatctctatagttttgtgtttttttgttgttttttgtttttgtttttgtttttgagagagtcttgctgtgtcacccaggctggagtttagtagggccatcttggctcacaaccttcacctcccagattaaagcaattcttgtgcctcagcctccaagcagctgggattactggcaatgtgccacattgcctggctaacttttgtatttttatcagagacagggaagtctcaccatgttggccaggctggtctcgagctcccgacctcaaatgatccacctgcctcggccttccaaagcgctgggattacaggcgcgagccgccatgcctggccaagttttgcctttttttgagaacgacattcaggctttcacgatgtcttttcatgacttgataactcatgccctttttttttttttttttttttaaaaggagtctcactctgtcacctaggctggagtccagtggtgggatctcagttcactgcaacctttgtctccagggttcaagcgattctcatgcctcggcctcctgagtagctgggattacaagcgttcactgccatgcccggctagttttcgtgtttttagtagagatgggttttcaccatattgcccaggctggtcttgaactcctgatcttgggtggtctacccaccttcacctcccaaagtgttgggattacaggtgtgagccaccacgcccagccgatagctcatttctttttagtgctgaataatatttcattgcatgaatgtagtagagtgtatttaccctttcacctacttaaggacatcttagttattttcaagttttggcaattatgaataaagctgctataaacatcctgtgtaagttttttgtgtggcaaggtattttttttaaaaaatcaaggctgggggaatgtctgtagccaaagataccagtggaaagtaattctagataaaaaattaaatgtagaaaatgaggcggggaaccgtgggcttacctgtaattccagcactttgggaggccaaggagggcagattgcttgagctcagtagttcgagaccagcctgggtgacatggcaaaaccccatctatacaaaaaaaatgagctggatattgtggtatgtacctatagtcccagataatcaggaggctgaggtgggagagtcgtttgagcccaggagtttgaggctgcagtgagccaagatcatactgttgcactccagcctgggagacagtaagaccctgactcaaaaaaaagtagaaaatgaaaccatgagactgcagaaagtatattgtgtaataaatacacatatatatatttttgagccaagatcgcgccactgcattccagcctgggcgatggagtgagatgccatctcaaaaaacaaacaaaaacgtaatacatagtaaataatactatatgtaaagttcaaaaatggtcacagcttggtctgtagtgattggagtggttaacctttgtggatgagggaggttacagtgacaggggcacctaaaaagtaggttagctttaaataattacaaagccaggataagagccagtttagttgtgacatcctagaatagctccatctttgttcttacgatttttctctttttctttcttttttttttttttttattttacaggtgaggtctcactgtgttgcccaggctggtcttgaactcctgagctcttttttgagacagggtcttgctgtgtcacccaggctggagtgcagtggcacaatctgagctcattgcagcctctacctcccgggttcaagtggtccttccacttcagcctcccgagtagctgggactacagatgtgcaccaccacgcctgactgatttttgtattttttgcagagatggggggtttcatcttgttgtccagtctggtattgaactcctgccctcaagccatctgccctcctcagcctaccaaagttctgggattacaggcatgagccacagcacccagcctatgacttttattaagcgctatatttccatatatgtgtaacatgaaaatcgtgaaagtagaagattgataaccaccttcaattcattttaatgtagtagtactcaatcttggccgcacatcagaagtaacagggaacttttaaaaaaccaacaaaactgattcccaggcgctctctccagagattgggacctgagcattggtatttttaaagacccacagctcctcatacctattaggatggctagtattaaaacaaaacaaaaaattactattggcaagggtgtggagaaattgaactcttgtacgttgttagtgggaatgtgaaatcatgtattgaccatggaaaatgggatgggcttcctcaaaaaattagaaatataattgccatatgatctagcaattccacttgtgtatatatatccaaaagaattgaaagcagggtcctgagacacttgtaaacccatgttcatagcagcagtattcacaatatagtcaagaagtggaagcaacccaagtggcatcaatgaatgaatggataaagaaaatgatagacatacgatggaatattatttagccttaaaaggaagggaaattctaacacacgctacaacatggatgaatcttgagggctttgtattaggaaaaataaaccaatcacaaaaaagataaatatgatttgtcactttaatgaagcatttagggtagtcaaattcatggcaacagaaagcagaatggtggttgccaggtacagcagggacagaagaatgaggatttgttggttaatgcacatagagtttctgttttgcaagatggaaaagttctagagattggtttcacaaaaaacatgaatatacttaacactgctgaactgtacacttaaaaagagtatggtaaattttggtatgttttacgccacagttcaaaaatataagtgattaatatgcaacaggaggtgagaactaatactactttaatgcagacaaagataatattggctaagtgttaacactggtctctaaaaatgggcaacttatttcattttcattttgcttatgtacttgaggtattatgtgcacgttggtagtacctttattatccttaaagtaatgatgctgtctaggaatattaaatactgtctttctgaaacacctatgaaatttaaaatattttattctagatgtagcaatatgtgccacagagtaacattttaatctaataaattcggttttaaaataaatcactttgggtcgggtgcagtggctcacgcctgtaatcccagcactttgggaggtcgaggagggtggatcacctgaggtcaggagttccagaccagcttggccaatgtagtgaaaccctgcctgtactaaaaatacaaaaattagctgggcgtggtggcaggtgcctgtaatcccagctactcaggaagctgaggcaggagaatcacttgaagccagcaggcggaagttgcagtgagtggaaattgtgccactgcactccagtctgggcggtagagtgagactccatctcaaaaaataaaaacagaaaaataaaataaaatcactttggctgggcatagtggctcaaggctgtaatctcagcaccttgggaggctgaggtgtgtggatcacctgaggtcaggtttttgagaccagccgggccaacatgttgaaaccctgtctctacaaaaaaatacaaaaattagctgcatggtgtcatgcatctgtagtcgcagctacttgggaggctgaggctagagaatcgcttgaacctgggaggcaaacattacagtgggccgagatcgcgccattgcactccagcctgggcaacagaatgagactccatctcagagagagagagagacaccataaattaatcacttttttcaaattagccagaacatttttttactttgcttttctctcttcattgaattaacaattgtagaatacttacacactgatcatatctttaacattctctgttatttcttccgactaggaatttatagacttttcctgctaagacctcaatttgtgtttttgtgaaagacaggaagactgagatgttgaaataatttaaaacagccaaggttggccgggcgcggtggctcacgcttgtaatcccagcactttgggaggccgaggcgggcggatcacgaggtcaggagatctagaccacggtgaaaccccatctctactaaaaatacaaaaagttagccgggcgtagtggagggcgcctgtagtcccagctactcgggaggcggaggcaggagaatggcgtgaacccgggaggcggagcttgcagtgagccgagatggcgccactgcactccagcctgggtgacagagcaagactccgtctcaaaaaaaaaaaaaaaaaaaaaaaaaaaaaaaaaatccaaggctaaggcatatatagtgaaacttttactatttgtatttgtttaaaaattgattcctttgccatttggcttttttttttttcatcctgtcttaatcatgatgtgctttaaaacacagtatgtgttaactcttttttgagatggagtttcattcttgttgcccaggctgtagtgcaatggcacgatcttggctcactgtaacctctgcctcccggatttaagggattctccctcctcaccctcctaagtagcttagattacaggcatgcactaccacctctggctaatttttgtatttttagtagagacagggtttcactacattggtcaggctggtctcgaactcctgacctcaagtgatccacccgccttggcctcccaaagtgttgagattacaggcctgagccactgtgcccggcttctgttactcttgaataacacttttcagctcctgtggaaaccattcctaaagtgcttctgaagtactcagtttttgtttttcaggacatgtacttgtagacaggattcaaagcagttaagaatgtctctgccaagtcgacaaacagctattattgttaaccctcctccaccagaatatataaatactaagaaaaatgggcgattgacaaatcaacttcagtatctacaaaaagttgtcctaaaggatttatggaagcatagtttttcatggccctttcaacgtcctgtggatgctgtgaaactaaagttgcctgtatgtatgtcttcaactatgttagtttcaaaaaaagaaaactcctgtaaatttctgtaagacataactagtctttaatattataaaacatatttggccaggcgcgttggctcccgcctataatcccagcactttgggaggccgaggtggggagatcacctgaggtcgggagttcgagaccagcctgaccaacatggagagaccccgtctctactaaaaatacaaaattagccgggcgtggtggcacatgcctgtacttccagctacccaggaggctgagcaggagaatctcttgaacctgggaggcggaggttgtggtaagccgagattgtgccattgcctgggcaacaagagtaaaactccatctccaaaaataaaaaataaaaaaaatttaacaactgatttatttagcatcattaaagtctatcccaatgagtatttttttccaagaaaaaagcttatttttctgagcattcgcattcttattttaataatttgtgataaattgtaatacatgttttcttattatagtatatgtcacttcaccttttggatgcagagttatcctgaattttaccttttctatgaagtttctcttgacacttcctggcaggcttagttgcatcacatacagaatttgactttaggtcttacgttaggaatttttagccattcattaatgcaatggttgagtagtttacaatatagctagtcaactcgaagctggaattttattctatggagtcagactccataaaaacaaggttctttttcctcatgccctttttattttcaaggataattttattctgaaattcttacctttgttcatctttattggcttttttttttttttttagcatctaaaaataatgccacagcagtcagctttgtttctcattactaaaggttctagtttctagaatatggcctttttttttttgagacagtctcactctgtcacccagactacagtggagtggcatgatctctgaccgctgcaacctctgcctcctgggctcaagtgattcttgggcctcaccctcccaagtagctgggaagacaggcatgtgccagcacacctggctaattttctgttgtttttttttgttgttgttgttgtgttttttgagacagagtctcgctctgtcccccaggctggagtgcagtggcacaatcttggctcactgcaacctctgcctcccaggtttgagtgattctcctgcctcaaactcctgagtagctgggattacaggcacgcatcatcacaccaggcttatttttgtatttttagtggagatggggcttccccgtgttggtcaggctggtctcgaactcgtgacctcaggtgatccacccaccttggcctcccaaagtgctgggattacaggcgtgagccaccatgcccggccaattttctgtatttttattagagatgggttttgccatgttggccaggctgatcttgaactcctggcctcaagtgatcctcctgccttggcctcccgaagtgcgggactacaggcgtgagccactgtgcccagccagaatatggctttttaaagataatcagttgctctctctagttgcaggtgtatagtgcattaaatttctttgtgtatcaatagttgtagtgtattcattcttactaacatttagaatttgttcaaaaccataggattattataccattataaaaaacccaatggatttaaatacaattaagaagcgcttggagaataaatattatgcgaaggcttcagaatgtatagaagacttcaatacaatgttctcaaattgttatttatataacaaggtatgtaagccttatgttatacttgctaattctttgccattacatataggagagaaatgtataaaatcatgtgatcatttcagatttcaattctcttcgtttgagatacttgacgtgtgtgtgtgtgtgtgtgtgtgtatataatttttttttttttttttgagatggagtctggctctgtcacccaggctggagtgcagtggtgtgatctcagctcactgcaacctctgcccccaggttcaagtgattctcctgcctcagcctcccgagtagctgggaatacaggcacccaccaacctgcctggctaattttttgtatctttttttagtagagatggggttttaccatgttggcctggctggtcttgaactcctgacctcaggtgttccacccacctcagcctcccaaagttctgggattataggtgtgagccactgtgcccggccaagatcttttacatatttttaaggacaatactttttcactgaatttcataattttcacataccaatacttgttcagtctatttgctataatatttttgtgcctgaatagctgtagtggcttgttatgtttttaaaaaccaaaataccaatgagagctggtttctgtgaataaggtatttcagaatgttttctattgcattcctgtcattttagttatgagataaaggaaaagccttagtatatactaatcttcattaaattttcacagtatggacccctggccataacctaaaaagccaaaccaattgcctacttctaaacttcacaagttgatttaaagatcagatatgttctggccgggcacggtggctcacacctgtaatcccagcactttgggaggctgaggcgggaggatcatgaggttgagagatcaagaccatcctgaccaacatggtgaaaccccgcctcactagaaatacaaaaattagctgggcatggtggcatgtgcctgcagtcccagctactcgggaggctgaggcaggagaatcgcttcagcccaggaggtggaggttgcagtgagcctagatgccaccattgcactccagcctggtgacagagcaagacaccttctcaaaagaaaaaaaaaattccaccttcctgggatgagtcctttgattctcccttttgcctttccctgtctcttgtttctctgtctaaaaaagagatcagatatgctctttgttctatcccagtagtagtacttggatttgtgttaatgaatttgcccatatgatatatgtagaaattttattttatttttttatttttattttttgagatggagtctcgctctgttgcccaggctggagtgcagtgtatgtggagattttaaacttaatcttcatattggctctcatccataaaattggatttgtgtatttggttttcttccatatagtattcccatttcctacagtactgtatcctgttctagctgttctagggcatctaaatattttaaagcttatatctcatttaaatatgagaattctaagtatttgtgatttcgtttattcaaaatcactggtgagtacactgaattgtaatagaaagtttgatttggctcccaagaaaactcaccagtgccagcttatatgtataaaagatttaaaactattagccaatgcgaatgatttttttgtctgagacggactcactgtgttgcctaggctggacttgatctcctgggctcaagtgatactcccacctcaccctcctaagtagctgggattataggcacacaccactgcatccagctccaatgtgaatttttaaaaaatcagtaccattggcaacttcattttaatttaactacaattccaaagggtcctttcagatgtaatattttaaaatgaagtttggtaattttcctgagctacctaacttagaaataaatgttctctttatttaagagaactgttgctttgtaaattacttactttttttctcagtcataaattgaagcaagaggaagacttgtaagcgaatagttaagattgaaaaattgaatatgttgcctgggtgcggtggctcatgcctgtaatcccagcactttgggaggccaaggcgggtggatcacaaggtcaggagttcgagattagcctggccaagatggtgaaaccctgtctctactaaaactacagaaagtagccagacgcggtggcaggcacctgtaatcccaggtactcaggaggctgaggcaggagaatcgcttgaacccaggtgacagaggttgcagtgagccgagattgcgccactgtactccagcctgggagacagagtgagacttcgtcgttgaatatgttggtagagttggcttagaaaaaaatattaaaaaattgagtcagtgctacagtgttattttattaattagttaattaaacagaattacttccagtcaaaccatgagacactttgtattgccatgagtaagttttgttttaacctatttgtgagtagaaattctcttttttttttttaagacggagttttcgctcttgttgcccaggctggagtgcaatggtgcaatctcagctcaccacaacctccacctcccggttcaagcaattctcctgcctcagcctcctgagtagctgggattacaggcatgcgcaaccgcacctggctaattttttttttttttaaacgtagttttgctcttgttgcccaggctggagtgcgatggcactatctcagctcacctcaacctctgcctcccgggttcaagcaattctcctgcctcagcctcctgagtagctaggattacaggcacgcaccaccacgcctggctaattttgtatttttagtagagatggggtttctccacgtttgtcaggctggtctcaaactcccgacctcaggtgatccgcccgcttcggcctcccaaagttctgggattataggcgtgagccaccgcgcccagcctaattttgtatttttagtagagacagggtttctccatgttggtcaggctggtctcgaactcccgacctcagatgatctacccccgccagcctccaaaagtgctgggattacaggcgtgagccaccatgcctggcgaaattctcagttttaatacctgtttgatttagtaggattgcttggattgtaattctttagtgttcagaaagccatttgggtcctttttagaagctgaaggagtaggatgctagaattttaaatgtgagctgctttcaaccatagagaataagaaaataaaatgtgagcagcttcactattttctaaatttataagagatgaataccgtctaggagtactatgttactgccttccataaagtgggctgaatttaaaacatttggtacagtgaccatactgtatatccttatggtatatttaatatattttgtagcctggagatgacattgttcttatggcacaagctctagagaagctgtttatgcagaaattatctcagatgccacaagaagagcaagttgtgggtgttaaggaaagaatcaagaaaggtaaggcaggaggtaaacactttatggttctctctctttttttcccctatctatctcatgtgtgtgtgtaaatccctcaaaggagacagacatccagaagtcctacatcctattctattaataaaaaatgtccatttgaaacaatctgccaaaccttgatcacaaggatgggtatcattcaagaatagtgaggactgcattgattatggcctcagagccagctttcttgtagcataatgccgttcacatagtagggattcagaaaatcatagctgttactgctgttttcagtggatcttgcatctgtgctgtactgataagaatgcccaaattgctagtgctctctgtattaaaaaaaaatttccatagctgagaatgaaatgttagtattgcgttggaagattgtctttttttcctaactttttcttcactcacaaaaatctttagaggaaatcatctttacaactaataatcatatcatttaaatatggtgtttcaaaaatcttaaatctgaagtattcaaatagatgtattgtagaggttaatcaagagtgtagtaaatgttggtttatctttggatcacttaagcagtgtaatctttaagttcttagtcattccatgttagtttcctcatttacaatatcaggaaaattatttatttatttatttatttatttatttgagacggagtcttcactctgtcgcccaggctggagtgcagtagtgcgatctcggctcactgcaagctctgcctcccagattcaagccattctcctgcctcagcctccagagtagctgggactacaggcgcccaccaccacgccctgctaattttttgtatttttttttagtagagtcggggtttcaccatgttagccaggatggtctcgatctcctgacgtcgtgatctgcctgcctcggcctcccaaagtgctgggattacaggcgtgagccaccgcgcctggccctaaaaatatttatctttcgtgattgtaaatgtttataaagtatatagttaagtgcctgagatataggaggcttgtaataggttcatggcagaggttgattttttttttttttgaggtttttattggtactaatatatacttttttattgctaatagatccttaaggtgggtcataacttatagtgctttaaccaaatctatgagatattcacatattcactgattatatttaagtccttattcttattttagaaaaggttgatctaatgtctgacaatgtgagacctaggcttctacaagaagatttaaataagcccttgtgaggtagataatacatagattagtatggtatttaaattgtaaaaccagcgtgctaattgttgctgacttaatttattacccttagcaagataaaaattattattttttccatttaatgttgctagaaggtaaaaattattgatctttttattgatcttttatctgagggaaacatactgttaacagttacctgagcatctgaaacaagtagctgcaacttaactttcaagtgtttaagtttttttgtttttgtgtgtgtgtgtgtttttttttttttttttttttgagacagagtttcactctcgttgcccaggctggagtgcaatggcatgatctctgctcactgcaacctctgccttccaggttcaagtgattctcctgcctcagcctcctgagtagctgggattacaggcgcatgccaccatgcccagctaatttttgtattttttagtaaagatggggtttcaccatgttggccaggctggtctcaaactcctgaccttaggtgatccacctgccttggcctcccaaagtgctgtgattacaggcatgagctgctgcacctggcctacatttaagttttttgttagaaataaaacttgaaaaaaattacaagacagtgcattatggaaaaaaagacaatgcattatgacacgtgtcagatgaaattacatgtaacatatgctgtgtttgaaaagaatgagaaattttgttttatttcgagacagggtctcattctgtcaccctggctggagtgcagtggcactccacaatcagttcactgcagcctcaagctcctgggcttaaacggtcctcccactttagcctcccaagtagccaatattaaggacatgtaccaccacacccagctaatttttttgtttcttacagaggtggggtctcattttgttgcccaggctcatcttgaactcctggcttcaaacgatcctcatgccttggcctcccaaagtgctaggattacaggcgtgagccaccatgcatggccaagagtgagaaattgatacgtgatgtgtgctagtacattttgcattgctataaagaaatacctggctgggcattgtggctcatggctgtaatgccagcacattgggaagccaagatgggaggattacatgagcccaggaattcaagaccagcctgagcaggataggaggaccctttatagaaaaatttgaaactttgccaggtatagtggcatgcacttgtagttccagctcctcaagagcctgaggtgggaggattgcttgaacccagtgggttgaaggtgcagtgagccatgatcacaccactgcaacagagcaacagagcgacagagcaagaccctttctcaaaaaaaaaaaaaaaaaaagaaaaggaaagaaatatgtgaggctgggtaatttacaaagaaaagaggtttatttggctcatggttttgcaggctgtataattatggcaccagcatctgcttagcttctgggcctcaggaagctttcaatcatggtcaaaggcaaagagggagctgttgtatcacatggtgaggtgggggtaggggagaggtgctcttttaagcaaccagctcttctgtgaactcatagagtgagcactccttcattacgtcaaggacggcaccaagagattcatgagggatccacccctcatgacccaaacacctcccacaccaggccccaccaccaacattggaggtcacatttcaacataagatttgaagaggacaaaacatccaaaccatatcacgctggaaaagttgggagaggctttagaggtgatacaagttatgtttgacctcaaagaataggtaggatttggcttcagagggaatgtctaagtttaaaagacttctgacagaagcattccactaccagagtcatgtctttgttagtcacagtggtaggaaaattgtcatatgatggtagctagtttaaaataatgtggttacgtacatgttgataatttatggcaaagaaaacttggtattaaactgataatgttgattgagcaaatacttgagtgctgattatgtaccacaacactgttctgtgctcttgagatattatcagtgaataaaacaaaaactttgccatcttggaattaatattctagtagtaagtgagagacaaacatgacagattcagtggaggcctcattgagaagtgaagatttgaaagaacattccagctagaggaatcagctagagcaaaggcctataacagatcctttcctcctccatcactttgagccaatgccttcatttgtgaacggatcttgccatctcaaccattttattcctttttgttatctcccttttttcttggatcattaatctctcctcctctatggggttagtctcattaccctataaacttgctctagtatctcatctttaaaatactcctttatccatatccttccagctattgttccttttttttttttctttctttctttcttcctgtatactcatgtagtctccttagcacaaattctagctttgattcaccaccaaaaaccttttgtcagtcagggtcacttgtagtcttcatgctgcaaaatttaagtagtgtttttctattctcattttatttgacttctgtcagtatttgccttaggagactactgtgtctttcttaaaatgcttttatttcttcatgcacacaataatcatgtggacttacttcccattctatagttctcttgacctggctggctacttcttacctttatagtgacatcttagttgtcagctttagagagggaggccttccttggctaccctctccataatagttctctgccttaatttagtcagtaacctgtatatttccttcctaacacttagcatcacttgtactcagtttgattacttattttttgtctgtttcttacactagacagtaagctacaagagcagatactatgtctgtcttgttcatttttgtgccctagcacctaaaatggtgtccaacacgcaataggcatgcagtaaatatttactgtgtttctctcatgtaacaagtactgcattaggcacaagggacttaggggtgaccaaaacaaagtccccttaccctcacagagctttttattcttgtgagggatagagacaaaattaaataattctaactattcctcactatgcatatctaattagctcctgagttcaaagagcaacagttggaatatcaaagggtgtgagattatctgaatgtatttgattcctaagttttagagagtagtgacaactcagacattgaggaatatcagccctatcttaaaatacattcaaatttacttagttcctgagtttgttttgcaagaattgaagagccggaaatagctatatgttgtatatcaaatgtgacaatggcatggaaaaaataaagcagaataagagctagacagttggtgagtggggataggtagagcgaaaatgttattttatatggggtggttgagaaggtgacatatgagtaaatgcctgaaggaaatgttggaatgaggcataaggatatcttcttttaggcaaaacaaatagtctgcttctgcttaccaaatttgagcaaggccaataggctagagtgaggtaagggcagagggaagtaataagaagtgaagtttgaagtgaggtagtgtgatgcctccagctttgttcttttggcttaggattgacttggcaatgcgggctcttttttagttccatatgaactttaaagtagttttttccaattctgtgaagaaagtcattggtagcttgatggggatggcattgaatgtataaattaccttgggcagtatggccattttcacgatattgattcttcctatccatgagcatggaatgttcttccatttgtttgtgtcctcttttatttcgttgagcagtggtttgtagttctccttgaagaggtccttcacatcccttgtaagttggattcctaggtattttattctctttgaaacaattgtgaatgggagttcactcatgatttggctgtttgtctgttattggtgtgtaagaatgcttgtgattttcgcacattgattttgtatcctgagactttgctgaagttgctaatcagcctaaggagattttgggctgagatgatggggttttctagatatataatcatgtcttctgcaaacagggacaatttgacttcctcttttcctaattgaataccctttatttctttctcctgcctgattgcctgggccagaacttccaacactatgttgaataggagtggtgagagagggcatccctgtcttgtgcaagttttcgaagggaaaagttttcaaactatactacaaggctgcagtaaccaaaacagcatggtactggtaccaaaacagagatacagaccaatggaacagaacagagccctcagaaataataccacacatctacaactatctgatctttgacaaacctgacaaaaacaagaaatggggaaaggattccctatttaataaatggtgctgggaaaactggctagccatatgtagaaagctgaaatggatcccttccttacaccttatacaaaaattaattcaagatggattaaagacttaaacgttagacctaaaaccataaaaaccctagaagaaaacctaggcaataccattcagaacataggcataggcaaggacttcatgtctaaaacaccaaagcaatggcaacaaaagccgaaatagacaaatggaatctaattaaactaaagagcttctgcacagcaatagaaactaccatcagagtgaacaggcaacctacaaaatgggagaaaatttttgcaatctactcatctgacaaagggctaatatccagaatctacaaagaactcaaactgatttacaagaaaaaaacaaccccatcaaaaagtgggtgaaggatatgaagagacacttctcaaaagaagacatttatgcagccagcagacacatgaaaaaatgctcatcatcactggccatcagagaaatccaaatcaaaaccacaatgagatatcatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaggaaatataaatcatgctgctataaagacacatgcacacatatgtttattgtggcactattcacaatagcaaagacttggaaccaacccaaatgtccaacaatgatagactggattaagaaaatgtggcacatatataccatggaatactatgaagccataaaaaaggatgagttcatgtcctttgtagggacatggatgaagctggaaaccatcattcttagcaaactatcgcaagacagaaatccaaacaccgtatgttctcactcataggtgggaattgaacaatgagagcacttggacacaggaaggggaacatcacacaccggggcctgtcgtggggtagggggagtggggagggatagcattaggagatatgcctaatgtaaatgatgagttaatgggtgtagcacaccaacatggcacatgtatacatatgtaacaaacctgcactttgtgcacatgtaccctagaacttaaaagtataataaaaaaaatttaaaaaaaaaagtgaggttggaaggagggaagaagtgtggagaagaggacaagcagatcgtacacatgctgtgagcactttggtttttacttagcgagattacaagccatcactgatttgagttttaaaagatcactttggttgctgttttgaggatagactatagaggaccgaagcagaagaaagacctgcctggatgttattgcaataattgagttgtgcactgatgatgccttgggccagagtgaatgccacttgtgagaagtgtttggagtctagataggaagataatgctaacagggtttgctggcgggttggatatggagtttgagagacagtggagtcaaagatgacttcaaggtttttgttgtgaacaattagaagaatagagttgccttgatggaaggttgaacttttgaaataacagatttcagagtgatatgatccaaatgtcttacatcataacattctgtgagaacagggcagaagaacgtgacaattgctcctttggcagaattttctgaagaaggtattgataagagaatcctattcacatcttttgttctgtgatggactatgttaacaattatgaagtccttggatatttatgcagagcattctgaagacctcacatagtattgtatggttggtctccagagtatctgaaatttttgctcatgttcatagctacctgaagctaaccacacagctcgattattagtcttggtttaagccaggcacctttttgaataaaactgataaacctaccattaataagaaatgttgaagtctccattattatatctaaattggtctaacctgtctaatcctgtgtgtgtagatttcaaaatgaaataagtatcctatgcttatattgctaaaaagctgaactaaatgaaatagaaaataagacagaaagtggtattttgtactttattcattcatatatttgattctggctcatacttttccaggcactcaacagaatatagctgtttcttctgctaaagaaaaatcatcacccagcgcaacagaaaaagtatttaagcagcaagaaattccttctgtatttcctaagacatctatttctcccttgaacgtggtacagggagcttcagtcaactccagttcacaaactgcggcccaagtaagtttgttgtagtttttaaatcattgctttttaacactggattttttttttccatttataggaaaattagtcttcagcgtctagcaatttttcttttttaattcatttagcatctagcaatctgaaataatactgtttccgcctctctatgcattttatgaatagacacctaagaggctagccaaattttagatatttcttaggtagaatttgtactgtttgggtatcttgatagtattaatatcagaagttgttcacctatatagttttcttttaaaaatcatatattcttgctgattttcaggtgttcagaaactttttttggtatatgactttgattttttacttttcattcatcttaaggtttgcacaagacattctttggtatgtgggaagataatattcgaactatttagtttgcctacaaaaggaaattaacctttagcaatatttaatacatggattgacaacaatatgtgtaaattatctatatgaagacttggtgccaataatctttccctttttttcttttaactgataaggaactatgctctgaatatcatctcaaatatatttttgttgttgaattgttctgttgtaggttacaaaaggtgtgaagaggaaagcagatacaacaactcctgcaacttcagcagttaaagcaagtagtgaattttctccaacattcacagaaaaatcagtggcactgccacctataaaagaaaatatgccaaagaatgttttgccagattctcagcaacaatataatgttgtgaagactgttaaagtaactgaacaattaaggcactgtagtgagattcttaaagaaatgcttgcaaagaaacatttttcatatgcatggcccttttataatcctgttgacgttaatgctttgggactccataactactatgacgttgtcaaaaatccgatggatcttggaactattaaggtaaatgttgccttaaaaggaagaacttctttttcttgattataaaagtaattcatcattgcaaagaaatcttaaaatctagaaaaagatgaaggaaattaagatcatccaagtcacactatctggagtgagtctctggaaaattttaaaatatatctttttgttttcttccacttgaacatgtccatggttctaggccgggcacagtggctcatgcctgtaatcttagcactttgggaggccaaggcgggcggatcacttgaggccaggagtttgagaccagcctggccatggcgaaacttcgtctctactaaaaaaaaaaaaaaaaagctgggaatggtggtgcatgcctatcgttccagctactccagaggctgagtcacgagaatcacttgaacctgggaggaggagaggttgcagtgagcggagatcatccactgcactccaggctgggtgacagagggaaactctgtctcaaaaaaaaagattatatgaaaacactctgcttctctgcttttgtgattttgttccagttctctttacatggaatgtcctccttcctcatctctacttgtcaaaattcactggattttttttcaaagtctaaaaaatatgaaacaaatgtagcaaaattttaacatttgtcaaatctggatggtggacaactgttttctgtatatttgaattattttgtaatatgaacatttaatgtacgtggtcaaataattattgaattgaactatttgtgaatcctgtagtttttctttaatttaggagaaaatggataaccaagaatataaggatgcatacaaatttgcggcagatgttagattaatgttcatgaattgctacaagtacaatcctccagatcacgaagttgtgacaatggcaagaatgcttcaggtgagctgttacttgtgctctgaaggtgtttttcctctgaacatagttgaaacgttttttagaaccataatgtaagagataaagaataataactcctacacctctaagtattaaatggcaaaaaccacaattacttttgcaccaacaaaacagtttatgaattatacttttaaaactgagagggttgtgtgttttgtttcgttttgtttttttgagttcttgcatcctttagtagcgaatctttttatgaagctgccctgcatacaaaggacactggggaaatattagtgaagaggggatgtagatagatgatatatagggttgactagagcccatgtcccactgaggggacagtctaaatggctgcaggtaatagaatgatctaccaactacagggcccttgaaagaagatcccctgtgctggcccggcgcggtggctcacgcctgtaatcccagcactttgggaggccgaggcgggtggatcactaggttaggagatggagaccatcctggctaacatgatgaaaccccgtctctactaaaaaatacaaaaaaattagccaggcatggtggcgcctgtagtcccagctgctgggggcgctgagacaggagaatggcgtgaacccgggaggcagagcttgcagtgagccgaaattgcgccactgcactccagcctgtgcgacagagcgagactacgtctcaaaaaaaaaaaaaaaacaacaacaacaacaacaaaaaaaaccctatattacttgagaggtctatcttgcctgaaaaaaatggagaaaagttggtaagtttggcaggcagagaagcatgagtctttttttttttttttgagatggagtttcgttcttgttgcccaggctggagtgtagtggtgcaatcttggctcactgcaacctccgcctcccgggttcaagcgattctcctgcctcagccaccgaagtagctgggattacaggcatgcgccaccacacgggactaattttgtatttttagcagagacggggtttctccatgttggtcaggctggtcttgatctcccccatctccggtgatccacccgcctcggcctccctaagtgctaagattacaggcatgatccatggcgcctggccagcatgagtcttaatacgtttcttctgatatatcttaaaggaaaaaagaattctggtcaaaatatgacactgaaatgtactttttgttaaaagctgtgattgctggattaaataaaaaatacagaaaaccataacaaactaatttttcattacaggatgttttcgaaacgcatttttcaaagatcccgattgaacctgttgagagtatgcctttatgttacatcaaaacagatatcacagaaaccactggtagagagaacactaatgaagcctcctctgaagggaactcttctgatgattctgaagatgagcgagttaagcgtcttgcaaagcttcaggagcaggtagttgattgtattgatacaaattttgataatctatgagctgctaatctatcaggaaattttttctgcagatttaaagctgttatagttaaatcgcttcataactgtggctttatttacttattggcaaatttgtaatgtttaatagtttttcctaatcaaatatttattatcataaaaatctgttattttaaaaaattatgttatctattcctaatcatgagtggttgattctcattgaaatgatttatgaaatagagatattttatggatgaggtcttattcaacattaactgctttttatgataaaatgttaaactgttctggagctcaagtctgaaaaatcaatgattaaaaacttaagaccaaccaggcaccgtggctcacgcctgtaaccccaacactttgggagtccaaggtgggaggattgcttgagctcaggagtttgagaccagcttgggcaacatagtgagaccatgtctctacaaaaaaatcaaaaaaacgaggcaggaggatcacttgagcttaggaggttgaggctgcagtgagccaggatcacaccaccgcactcccacctgggtgacagagcaagaccctggctcaaaaaacaaaaaacttaagaccacctggaaatgttatttattcttgatctgttggtagttgaatatttaagtttatgggttcagtacatgatagtttttgtaatttaatatatgccttttaaaaattcaatgcatttgtgaaattaaataaaaacttgaaggaaatgtaataagaaatgaatttcacaaaagacattcttgactttggagtggcttgatttttttctagtttctttaattatttagagacatgaatgtttacagattttttttcttttatcagcttaaagctgtacatcaacagctccaggttttgtcccaagtacctttccgtaagctaaataaaaagaaagagaagtctaaaaaggaaaagaaaaaagaaaaggttaataacagcaatgaaaatccaagaaaaatgtgtgagcaaatgaggctaaaggaaaagtccaagagaaagtaagtatcttttattatgatagcttattaagacaataacgataagttggactaaatttagtttttgttacagtcagccaaagaaaaggaaacaacagttcattggtctaaaatctgaagatgaagataatgctaaacctatgaactatgatgagaaaaggcagttaagtctgaatataaacaaactccctggagataaacttgggcgagtagttcacataatacaatcaagagagccttctctgagcaattccaatcctgatgagatagagatagactttgaaacactgaaagcatcaacactaagagaattagaaaaatatgtttcggcatgtctaagaaagagaccattaaaacctcctggtatgtatttctgcatattaatagaaatcggtttggtatttatgttggtttttggttatactcactttcttccctcctaaatcacacagctaagaaaataatgatgtccaaagaagaacttcactcacagaaaaaacaggaattggaaaagcggttactggatgttaataatcagttaaattctagaaaacgtcaaacaaaatgtaggtggcagtttttgtttgtttgtatgtatgtatgtatgtatgtaggagacagggtcttgtgatattgcccaggctggtcttgaactcctggcctcatgtgatcctccaccttggcctctcaaagtgctgagattacaggcatgcgcgaccatgcccagcctaggtggcagtttttaaatgttcctgcaactatttaattcttctggcattttaatatgtttctctgttttgtagctgataaaacgcaaccatccaaagctgttgaaaatgtttcccgactgagtgagagcagcagcagcagcagcagctcatcagagtctgaaagtagcagcagtgacttaagctcttcagacagcagtgattctgaatcaggttagctgtccccttaaatgtacctctgttgatgggagcactttttttcctgtaatattgatttatattttgaagaaatatttgttacttacccagaatccatggtttgtatatcatgctaattatttaattgcatgttgacaatcttagtattttccctaaaagagatactgtgtaagatgaaacttcgtattatatgtatatgacgtgtaggtgtgtaatgctgaaaaaaagtttactcaaggagggatagtctcaataaataatttcaaatcttaatatcaaaatatatcagataataaaataatgacctttacttgttttataaaataaaagattatttgagagcacctttcgctttactctccatgatctatcagatcactctaatgttgcaaggttgccatgttgtgatactatgttctgaattgaataatccttttgagttaaaccagtcatcccagaagctgtgaatcagatttttttttctacttctttggtttcttcactgtagagtattttcttccatctatagaaaaatgtactttaaattcagattctcagctatgctcaagtgccatattatcttgtatagtttagcagttgtatcaagcttaggtcatttatgttttctttgtgcttttctattaatgattacacagttgataagtaatcactaccccaagaatactgacttggcagtggtgttccatctttattgaccaaaaggcaaattcagaatttggacactgttgtccctaaattttgctttattttaaatgaggtgtttcttgtgaaattcaattctctttttaaagaaacatctcacacagaatattgtgacatcaggaattcttagcattattaaaagcatccctctttttttcagtgtggtagtatggtctgctgacttgcaatacattctatttaactcttagttctgtttagtttgcatttatatggtgctgattgctgtattttgtttttacatttctaaagtatgtagtgataaacatttttggagaataaacagaatttttactttgggatttgtcatactagaaaatttaaaaatgtagggctctgattatatagtatttccttatttgacttctaagcatagaacaatactggaataacttaagttgcatttagtattttcaattgtaattagcatttgtaacttcatctaataaagcatttgtggtctaataagttagagcactttgtcttttatttgtaggataaaagtcttactgttcctgttagtttgaattatctaattataataaatgcttcaagtgttagaggaaaagtacaatataatacagagttttcaataaagtaccttaattttaatatgaattatcagtttctgatacaatattattatatattgcttggaggaaagaatatttatcactaacttgtgttcttaaaatagtgcaatatatactctctgtttttctaacattctatcagaataactcagtctcagaattcaaatctttttttttttttttttgagacggagtctccctctgttgcccaggctggagtgcagtggcgctatcttagctcactgcaagctccacctcctgggttcacgccgttctcctgcctcagcctcccaagtagctgggactacaggcacgcccagctaattttttgtatttttagtagagacggggtttcaccgtgttagccaggatggtctcgatctcctgaccttgtgatccacccacctcggcctcccaaagtgctgggatgccaggcattagccaccgcgcctggcctagaattcaaatcttaaaacattgctgtgttgaatttttattttatggctgacatttttgtttaatgtcatctttttcaattaaaaggagttttaaaatatataatgttgaaatcaaagtagcaagtttttgtttttttggttttttttttttgagacggattctcactctgtcgcccaggctggagtgcagtgatgtgattgtggcctcctccgcctcctgggttcaagtgatcctcctaccgcagtctcccaagtagctgggattacaagtggatgccaccacacccagctcatttttgtatttttagtagagatggggtttcaccatgttgtccaggctggtcttgaactcctgacctcaagtaattctccctccttggcctcccaaagtggcgtgagccactgtgcccagcctgaagtggcaagtttttatatttgaacctacattataaatagtgtacaatttgtgacacaaggtcaatttgtcttctgataatgttagttgtttatttttgaaattttaattgttttatgaacaaactgtgctttactggaaaaacactttatatatgttataaattgcaaatgcaaagacaaatgggaaaaaattatatctttgcttaatactaaatgaagtaattggaccttttgtcctaatttttttttgcctttctccacatattctaatgttctaaatatcaatttcagttgcagctgttattttaaaggctcttaatttctagcatgtaaactaagaacattttttacttccctgggaacaacaacacacacaaaaaaaagccctgaaaattgtgaaaaataagcaagtcaaatcatatcattagcaatatctactataaaaataaagcacctactattcttaattatactagtaacattctcaaggaacagatggcaaattctatgtcaaagtttcaagcatgggcagaatgaggctatttactaagaaaatttaatttatgaaaattaggcacatcagcaaaagctttatctgctacatcagtaaaaattgactgaaaatatgaatatgaaaaataaaatataaatatgaaaaaataatttaaaaaaattttttttgagacagggtctggctctgtcgcccaggctacagtgcagtggcacgatcacggcttactcctctgcctcctgggctcaagccatcctcctgcctcagcctgccaagtagctgggcctacaggtgtgtgccaccacgctgggctaatttttgtactttttttgacaaaaatgtatagggtttcaacatgtttccaaggttggccttgaactcctgagctcaagtgatccgcccagctcggcctcccaaagtgctgggattacaggtctgagccaccatgcttggcccataaatatgatttttattgctttaaaaataattatgatttggccagaactgaaacttgcagttggatatcatgattccagaattctgattaataggcttttgattatttattgaagataataggctttgattattattattattttatttattgtgttttgagacggagtctcactctgtcgcccaggctggggtgcagtggcacaatcttggcccactgcaacctccgactcccgggttcaagcgatcgagtagctgggactacaggagcatgccaccacaccggctaattttttatttttagtagagacggggtttcaccgtgttagccaggatggtctcgatctcctgacctggtgatccgccctcctcggcctcccaaagagctgggattacaggcatgagccaccgcgcctggcaattttttgtatttttagtagaaatggggtttcatcatgatggctaggctggtctcaaactcctgatctcaggtgatctgcacacctcggcctcccaaagtgctgggattacaggagtgagccatcatgcctggtctttagtaattttttcttaatgtaattttcatttagtatctgtcttcctggattttcttatagcaatttggctatatgcaatttttcaaagcaagtcagtcttttataatgtttgtgtcagagacagagctttaattagttttgcttttttttttttttttttttgagacggagtctgctcttttgcccaggctggagtgcagtggcgccgtctgggcttactgcaagctccgcctcccgggttcacgttattctcctgcctcagcctgccgagcagctgggactacaggcgcccgccaccacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggcccaaatccttgaaaaatgagagctctatggactggaatcagcatgtcattgcaaattttaatgtgatttggttttatttatctttttgactggtgtcagcatatgcagataagtcaagaacatttattaaacttcggtataaatataaaatcttttaaaatgatttttcataactaaaatcaataaatgtcagatcaaagatgtagccaagccttgaaaatgaaatcaattctaatgcatgtatcttatgttgactaggctgtgctagtatgcacacataagctattgagagttttctaatgctcaacaatcttggggttaccttgagtgatttatagggagcaatataactaatagctttaatcctgtgactaatgatactgagaaaaaaaaatcaaaaggaacagcttatcaataggagtacttttaattaaaaccttataggaaataactccaggaactgtctaaatataagctcagatacttgattagtgtgaaatagaattttttcagtgtacttaatttcaatttttacagagttaaacacaaagaaactaaatggtcatgacatcagttcactgtttttctttagttgtttaagacttaaagtgaatttgtcacttcatcctttggactttttgcattttattggatttagtgtaatgttcagagaatgaaatttataagttctttaaataacatttgtttctttttttaaaaaactttcttagttatgggtgacatcaaacaggaataaataaatttgtaattttagtactaccacctaggtcttctatagacatgacaaggatatgatttttttcatgcaaggtttggaaaccaacaaactttgttcaagcctagattttaactttttagaggaggatgatttagtaagtgcaggaagtatacaaggaaagcctctaaataatctttgccattcgaactagaaagctaaaggtacatgactagagtttattaaattattttagacttttataaatcttttttttttttttggagacagagtctcactgttgccaaggctggagggcagtggctcgatctcagctaactgcaaactctgcctcctaggttcaggccttccaattagctgggcaacagacatgcaccaccaagcctggctaatttttgtatttttagtagagagtgggtttccccatgttggccaggctggtcttgaactcctggcttcaagcgatctgcctgcctcggcctcccaaagtgctgggattacaggcatgagacaccacgcctggcctatcaatcacttttctataatctgtcctctgtaatgaaagtgtggtttctttttctaatttaaaagtctttggtaattatttctgctatatatggcatcatattctgtttttttgttttgttttgtttttttgagatggaatctcactctgttgcccaggctggagtgcagtggtgcgatctcggctcactgcaacctacgcttcctgggttcaagcaattctcctgcctcagcctcctgtgtagctggagctacaggtgcacaccaccatccccggctaatttttttgatattttttagtagagacggggtttcgccatattggccaggctggtctcgaacacctgacctcatggtctgcccacctcagcctgcctcagcctctcaaagtgctgggattacaggcgtgagccactgcgcccggccttgtttttgttttttgttttttgtttttttaaatcatattatgttcctattcaacttttcaagttttttagttcaaattggcttgctgataatatttagtatctctggaacatctatctcagtgctttgattggtgataggtattaagtaaactctttaatcaaatctctatgattgcagatctttttttagttctatgggttttttttgttttgttttgttgagacagagtctcgcagtttcacccaggctggagtgcaatggcacactctccactcactgcaacctctgcctcccggcttcaagcaattcttctgcctcagcctcctaagtagctgggattacgggcacctgccaccacgcccggctaatttttgtatttttagtagagataaagtttcacaatgttgacaggctggtctggaactcctgacctggtgatccacccaccttggcctcccaaagtgctggaatcacaggtgtgagccaccgtgcccggcctatggttaactttttttgacagtttaaaatgaaaactttgctaacaaagttttatattgagtttttgggggagatatgaaattagaacatttataattagaatatatgccacagtatgcatttgtttaatagtgcatatattatccactttgatcctcttaaggtaggtgtatacatgctgtcatacttccctagagaaattagttggcaatgtgtaagttgtcattattgttatcgattttatttttatttatttatttatttatttttttgagacggcatcttgctctgtcatccaggctggagtgcagtggcaccatcttggttcactgaaacctctgcctcccaggttcaagtgattcttgtgcctcagcctcccgagtagctgggattacaggtttgcaccaccacgcccagctaatttttgtatttttggtaggcggggggtttcaccaggttggccaggctggtctcaaactcctgacctcaggtgatcagcctgccttggcttcccaaagtgctgggattacaggtgtgagctaccacgcccggccttgttatcgattttaattgatgtttgctagcactgatagagcttcttcactaattgaaatatggttgtagtttggtagtgaaaatatgtacatttgtcttttaatttcaaaggccaggaactcatgaataagcatatatatgtagttttagtttattatgctcttaaaaagtcaattatgtaagattagaatgagaagcaaaatgctgagacttttatgagacatatatagtaggtgtttttatttttttaattaaaattccttgatgccttttgctaatatctttagattttgaggtgctaaggttttgggacttcaaactcctgacctcaagtgatccacctgcctcggcctcccaaagtgctgggattacaggcgtaagccactgtgccagccttgaggtgctaagttttataataattttgagcctagttttatgtattagaaaactaaggtgatgcccttgaattttttttttttagtagaacaccaatctggtatgtcatatttgtactaaagagtttatattgtaggataatgtagttttaggtgcatatttgaataatttagatgtatagatatacatatatgaccatattaatgaagtctttttggtttttgttgtttttttgttcaaagctgaaaccataatttctcctttatgattatgattatttttagacagcttctggctctgtcacccagactggagtgcagtggtgcaatctcggctcactgcaacctctgccttttgggttcaagctattctcccgcctcagcctcccaaatagctgggactacaagtgcacaccaccacacctggctaatttttgtatttttactagagatggggtttcaacttgttggccaggctggtcttgaactcctgacctcaagtgatctaaccaccttggcctcccaaagtgctgggattacaggcatgagccaccatgccctgcctaatatgtcctttaaatgcgaaagctacctggatgtatattctcaatcttctcagtctgtctccttctcttcctcctatgcctagcccacaacacttaaataatacttagctgagtgacattaagaaggttcatgtcattttaaatacttgaattatttaaattaaaggatgtcattgagtggcatttagcaattttaacaatgtccagcatcaaacattttaggagaggaaagaacagtaacacatccagtggaaactgatggcttttcagaaggcagaaggtaattattaaaattagaatgttttaagtttgaataatgtttggtgttgaccatccgtggtgtcctggagcatgaaacaaataacactcaggtggtcatgaaagctggcttggagagactgatcagggcagttactaccagtttggtgctttaccttactgacccaggattatgactggggaggatagcatcagaaacaattgtaggataaagaaagagaaacccactagaaccgtgttggagagatctctttttatgtctgcttctactgccagtgtcagctgtacagtatttctaaaggcagaggagatactataaaactcatttcttgctgtatagctgaggctgccaaatagcttagaagtatttaatcagatagaatctttattatagagtttagcaagcacagcagacttttccacagaactaaaatagctttacttttaataaaagactgtatcctctcagataaatgacatccccttctcttatagtaaattctttattttttaaattaagcctcttagggctatatttatggctacttggtaaaaggtgattttagcataatggatgctgcttgtttgaaaccttatctctgttgcaacatattcctttttaaactgtcaattattcaagcttgttactgttatgtaacatactgcgctttttggcctaaacataatgtaaattgaaatttgtgagtggacatttactctactataggaaaataaaataatcttgaaagcaggtatccctttagaaattttagctgattcaaggagggtgaaaacctgtgactctaaggatttcttgatatgtttgtaataaagggattttcttgaaatcacccctgtatttctttctttttttgagacagagtctcactctcttgcccagcctggagtgcagtggcgtgatcttggctcactgcaacctccgcttcccaggtttaagcgattctcctgcctcagcctcctgagtagctgggactacaggcgtgtgccaccacaccgtgctaattttttgtatttttagtagagatggggtttcaccgtgttagccaggatggtctccatctcctgacctcgtgatccacctgcctcggcctcccaaagtgctgggattacaggcatgagccactgtgcccagcccccactgtgtttctaatatggaaaaattataacttggtattttttaagctaataaatattaaaatatttatgtgtatacatttgcagaaatgttccctaagtttacagaagtaaaaccaaatgattctccttctaaagagaatgtaaaggtaagtgaattctttatttgtatctgaattttaaaagtatgtataactcatgggtatagtagtagctttctttaaaattgttttcaattttatttacacgaagaaagttgtcactgtttttagcttatcaactaaatgttcaatgatttcttcctgaagaaaaccgaatagggaagctatttggcttcatttttcaataagacataacatttatgtaagccaaatggataagtagaacaaattctagaagcttcagcttatccctgagagtctgaatacagagggatggccttggtatcctgaatgagtgtacaaaactatgcgtacagtgaagtgaaatttctcaaaagatggtaggagaatggtagttaaggtttctacagataaagcttataattgccagctatccattttggcacatctatgtttgactagtagttgatgtgctttgaaaagaacagaagtggccaggcgaggtggctcacgcctgtaatcccagctctttgggaggccgaggcgggcagatcacgaggtcaggagatcgagaccatcctggctaatacggtgaaaccccgtctctactaaaaatacaaaaaattagccgggcgtgatggcgccatgcgcctgtaatcccagctacttgggaggctgaggcaggaggatggcgtgaacccgggaggcagagcttccagtgagccgagattgtgccactgcactccagcctgggtgacagagcaagactctgtctcaaaaaaaaaaaaaaaaaaaaaaaaaagaaaagaaaaagaaaagaacagaagtgattttttactagctcaagttgtcatcctcatatacatttttttccctttgtaccccttccaaacatacaattatttatgtaacaacatctaactaggttagggaaacacaataataaataatactgtcttaaaagagctctaatttgtgaaaaagaaatataatcacatggttaagagataatatgattaatgctataatctatataattatttttagaaaatgaagaatgaatgcatactgcctgaaggaagaacaggcgtcacacaggtaatgcttaaaatgtgttttaaagaacaggggaagaaatggtttacatatagattaggggcttactttttaaaataagtaatagcatgaagagaggcaaaaaaaaaaaaaaaaaaccacagcaagtatattcagagaaatatggaagctgagggtatttattagatggcttggagtatataacagggctttggacacgtaagtgaaattatacatatatatattttgttgttgttgttgagacagagtctcgctctatcacccaggctggagtgcagtggcatgatcttccctcacttcaacctctgcctttcgggttcaagcgattctcatgcctcagtctccggagtagctgagaccacaggcacacaccaccatgcccagctaatttttatatttttagtagaaacggggtttcaccatgttggccaagctggtctcgaactccagactttaggtgacccactcacctcagcctcccaaagtgctgggattacaggcgtgagccaccatgcctggccttcccattccttttgaataggaagaagttatagatggtctgtcttgccaaaggtgtattagtggaataaaaaattatgtcaagttatgaaggaactttggaagcatttttatctcaatacgtagcatgtagaatgccacctttttaatggtctatttttggtcaaaattttttcactttcactcactgaggaaaaaaatgcctatttatggtaaaaggtagtatatattaatccataggttcatgtatgaatgtatatatttgtgtagttcagaaagtgatttttttctttggctgatttaaacctgagcattaggctttgagctttggcctgggtctatattgttgtaataaacattcctatagcatttgttttattcatatttgcataggtgttacttgtacacttgcctacctactcactcaccccaatgccttgttagacaaaggagaaagactgtcttatttatctctgtaccatctacaactcagagcttagttagataaggctactgggctttgctactgtaacttcgcttgccacagaataggtgtgagatttcaggtaagctgcttctattatttctagaaaatgtaagtagagataaaaattatacctaactcagcattattgtgagaattaaagaaaaaccatataaaggacttaccctggtacctcacacatagtaaacattaaataaatgttagctattattacactacagcttttatttaatagttacctgaatattgaattagaatttattgatagtcttgtgggttgaccataatgtaattttaaatttatccccttatgtctgtaatacagtaaggaaaaatggctaaagtaagtgaattggtctctagatttgctataaaagctcaggggtttgttttgttttgttttttagtaattacaggaaagctttaaatgaatagcattgtttaataatatacatgtatactcatgtaaaatatacatgcatactcataactaagatcataggctttgacttactctacctcttgtaagccatataatggccaagttatttaatgcttttaaaccccagtttgctcatttgcaagatagggataactatacattatagatttgtgtgacttaaataataaggtattttaaaaaggtagcattaaattatattcttgactcttgtgtttctgttctctttggtatacttcttgtatggttaaaactaagtgataactttgattttgttttaacagataggatattgtgtgcaagacacaacctctgccaatactacccttgttcatcagaccacaccttcacatgtaatgccaccaaatcaccaccaattagcatttaattatcaagaattagaacatttacagactgtgaaaaacatttcacctttacaaattctgcctccctcaggtaagaaattaacaagtaaacaactgttattgagaaattgacttctaaacctatacatatatgaaaatgttatggtcatcttaaatgttaaatatctgggaaataccaacaatcataactagtaaattccaggttacaaataatcactgaagcacatcattagaaattatctgctttatacctgtaggcattcattatatttaaaagaaagaaaattatgtatatagttcacacccaatttactttcccagatctgagcagatctgggaaatactgttttaacttccatgacacctatctgggttagaaaagtaggaaagaataagggagggccgggcgcggtggctcacgcctgtaatcccagcactttgggaggccgaggcgggcggatcacgaggtcaggagattgagaccatcccggctaaaaaacggtgaaaccccgtctctactaaaaatacaaaaaattagccgggcgcagtggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaaaaaaaaagaataagggaaagatacttagagattctataagtaaagaaaagaagttacagatatataaaatagtttacagttaaggaaacttgggctagaaatacttgcctaagggtagttcctatttgtctaaaactggttaaatttttatatttttagattcatttgacttaatatcttatcagaagggaaagttttgcctgtctcaacttggttctggtgggttgaaggggatgtgtggcacgaagggtacttctgatacgagtttagcctagagcatgactaaaccttgagacactaatgtatttaggcctaggttaagggcagatatgaatattccttgtctattcttcttccctctagaatgttccctggtttccacttggccacccaagggcagaggtatctccctagcagaataaatttccaagctgttttgctgcaacacagattaggaggaagagggagatgttttgatccttcttcacagctttcagtttaaaatctccctactgttctgtgtgtgtgtgtgtgtgtgtgtgtgtgtgtgtgttgtttaaatttttttttgagatggagtctcgctctgtcttgcaggtgggagtgcagtggcacaatcttggctcattgcaacctccgcaatgattcccgggtttaagcgattctcctgcctcagcctcctgagtagctgggattacaggcatgtgccaccatgcccagctaatttttttgtagttttttttttttttgagacagagtttcattcttgttgcccagggtgggtgcagtggtgcaatcttggctcactgcaacctccgtctcccaggttcaagtgattctcctgtctcagcctcctgagtagctgtgattacaggcatgtaccaccacgcccagctaattttttgtctttttagtagagacagggtttcaccatgttggtcaggctggtctcgaactcttgacctcagatgatccgcttgcctcagcctccctattctgtgtttgaatattccattttgtctttaattaaagttatatctcttcattgtggggaagggaatggagatcaatggagaaaatatctaaggccacactggagggcattccaggaagaagaataaacaaatatccaaagtatgaaatatttatgtctactctttttttgaaatacattttcaagatacttggaggataacagaagatatgatagctataggtcatgagttacctagaataccagtgccattaatttgtatacaacaaattatatacaaatttgtatactttgtgtacaacaaggagctttgtataggaagcataatcagattttattcaattttattttatttatttatttttttgacacagagtctcgccctgttgcccaggctggagtgtagtagcacaacctctgctcaccgcaacctctgcctcccgggttcaagcaattctcatgcctcagccacccaagtagttgggattacaggcatgcaccaccatatgcggctaatttttgtactttttgtagagacgatttcaccatgttggccaggctggtcttgaactcctggactcaagtgatccacccaccttggcctcccaaagttctgggattacaggcgtgagccaccacacccagccccaggttttataatagggaaaaaattgctgcttaccatgtagaggatggattaagatgatgctctgatgtagttaggattaagtaaggacactgaatgctgtagtctaggaaataaattattaggaccaaaactaacacagcaactgtagaaagcatgtggatatataaggtatttttgtggcagaattgatgtacttcgttaggatgaatgagctactgggagattatctaatagttggattgaaaacaggggacagaactcatttggcacatgtttgagatgttacagaatatctaagtggaaatataaagctagaaataggtttctagaactaacagggtgtaacaggaattagaaattaggaattaacagtatgtagaagctacttgaagccataagaataaatgaaaacacccaggaaaatctgcagagcaggaagagaaaagcttaaagacaaaattctaagaaacaaaacctcctcagtaaaagtagaaaaaaatagttaaaagaagaggtaatcaatggtagagaaaaagaaaaaatagtgtaataaaagcccaggaagatagattttttttttagaaggaaatcaaaagtatcacatactgcagagcatttaagtaggatgaggaatggagagagagcattacattgggaatgtgagaatttttacttttgcggaagcttttttagtacctgttgtgatggggcagaaaccagattgttgtaaattgagaagtaatggaatttgagtgtagtgaatgtaaagcattctttgaagaactttgttggtaaagaggatggaaagatatttgtggctttaacaggaaaatagattttttggaggagtgggcaagattattttgagttttttaattggagggatttgaacatttaaaggctcattataaagagctaaagtaggaaaaagttactcttttaactagagtatgttttataagaatgctagggtagccttgcccttgaaaaggaatagattatgaaaaacaaaggtgagaatgtagtcaaggtgttctcttattcctaatttaagaaaacaccctatctatgaaaagtcaggcttttaatacctacaccttcagtaaggatcagtttattatattacttgaaattctgtttatatgatgcctattagtaagctaatatataaaggaaagtttggatgatgccagagtagctgttcttttgcagttagcaagattctcagaaacaacatggtttacatttgccaactgtaggtggcactatgcccaagggaaattgcaaatgtatgtgagccataaaatttatagagacattttctttttctggagttaaatctcaatagaaataaattttttgttaaaccttacaattaaatgataaaagcaatatgttgaagttttcttattggaaaaatagtttgacaaaatgttagagtacataaaagattaaaaaatgaatttttaagtgttactggttttcatcacacctgcccacatatgatctccacatgaaatggacaatgttgaattttttttccttataagttgaagcttttagccatacccttatccttatagtttaccctttccccttctcataaaaacttcactaaattgccgccatgaaaagggatgagttcatgtcctttgcagggacatggatgaagctggaaaccatcatcctcagcaaactaatacaagaacagaaaaccaaacactgcatgttctcactcataagtgggagttgaacactgagagcacatggacacagggaggggaacatcacacactggggcctgttgggggatggggggctagcagaggggtagcattaggaaaaatacctaatgtagatgacaggttgatgggtacagcaaaccactatggcacgtgtaacaaacctgcacattctgcgcatgtatcccagaacttaaagtataataaaaaaatttttttaaacttcaccaaattatattgagtttttaaaatatttaggctgttatataaacatgaattcataattgcaaatgaaaaagtaaatccaggagtttgctatctcataggagaaataaacaactggtatataaagtaaaaataatgtgccctgaaagaacctaaagtgaactttaaggaggtgaagaaggcagaatcacctgatgtgtttggcagatacatattttacagaatgagtatcatttgagctggatagtgcagaaaaaaaataaggcttacctatgtttatttagtatggaaaggcatttggatggaggaagcaacatgaatgtgaaggtatttaggcaactcataattccatgtgattaaagatttggttggattaaacaggaatgtggaaaattacaaaggtagaccaggtttagatcatttaaccctttagatactttggacttaattataatagcatagtcagtggggaggcaatgaaggtttttttgagtgaaggtgtgcctctgagtgattaatttgccaatattatttaggtgagttgaaggaaaggagaatatagagaccagagaagggaaggagaccagctgagctgttgcagtagtagggaaaaaatgacataaagtgatagaaggaaagagaaggggaaagttaaaagaaattgcaagagtagaatgggcaggtctgcaaaatatgaaaacatgctgggttaataacccagggatataagcttcggtggctcacaggatactggctggatactgtccaggttgacagacccgggacacaagatgaagaataggcttctgaggaaagatgagttttgtagtcttttgaggtatcacagggtcattcatgtaaaaatatttttcagagagttggacccttgacatacttcctaggcttttatgacacctctcttaacaatcccatctgtctgttccttacagatatctctttatttgcctccctttagatgttgataattctctgaattgcatccttaagcctctctgtttttttcatctaccccagaatttcccaaccatgtttcaaagcacagtcttactgaatgaatgtcccctcagctcttatagcaatgagctgggagcagcctttccatttatgcaggtggccatacattgatcattttctatatatcatgacatggaaaaggttggaagcagtgctctatacttgggtgatctttggcatccatgacttctagtctcatttttacaattcaaatgtatccaggccccaggcatgtttatacaactctactaaatgtctttacttaaacatcacataggcattccaaacacagccatgtaaaaactgaattcccccttttagtcctcagattgtatttatttttttgagacagtctgcctgtgttgctcaggctggagtacagtggcgcaaatatggctcactgcagcctcaaccgcctgggctcaagtcatcctcctacctcagcctctcaagtagctgggaccacaaatgtgtgccaccatgcccagctaagttgttatttgtttgttttgtttggtagagatgggatctcaccatggctggtctcaaacttctgggcttaaggaatcctcccgccttggcctcccaaagtgctgggattgcaggcctgagccagtgcacccagtctggtccccagattttaatccttcctctttaattgtcaataatggcactatcaccacttaccaacttagagtcagcaaattaagggtcactttagaatttcacttaccatacatactttttctccttcctaaataatcactgacaggaagcagagaagggaaggcagtcctatacttacagcttttctcactattttttccctttccttgttgaagtgaggaaacatggctacattgaggctgtgtacagacgtacaaattaaaaatgtgagcttttgttctgcattctttgacagtgttttgtcttgccctcctatgctcactgctattccttgatgttccttgctctcttcttctaacctcaacctcagtatgatttagccagagaatcagtcaagggattgatggatggtagaagcttaaatgtaagtccctataatatgtaagtggccaggattttgttagtttgggttagttaacaaagacagcagctcagttttgatttgtccctcttgttcttcagccacgaattagaacctgtagactatgactagagagaattgaatcaagtgatcaattaagtttcacgcatcaggatgttccatgttgcagatgacagaaaactcagcccaaactgatttaataaaggaattttgttggcatacataagcaatagtccaaagataggtcaatcttttagtcatggcttgataagggctcacactctgtagttaatcttcacaataataataaatgaaatatttgcatgaaaacttaagaattaatgaaattgcatagtttgttctcctcacctcagagtcagacttactgcgtttcacatccctgttcccttggtagctattttgagtgtctggtatcttagtttccctctctgtgtttttttgtctccaattggccacccaggcagcatctttcccttggaagccctgcactggcttaggtctgctcttcctaaatgagttactgatggtgagatagaattaccaggattggcttggcctaattaaaacccacctctaggctgggcgcgtaatacctgaggatagttattacattttagtcatccttacgttcccagtgcttagtacatagtatgtgctcagtaaatgtttagtgataactgggttttatcagcagtctaaattgctttagataagttatgctatggttttgaatgtttgtcctctccaaaactcatgttgaaatttacaggcctggccagccacaatggctcatgcctgtaatcccagcactttgggaggctgaggcgggcagatcactgaaggtcaggagttcaagtccagcctggccaacatggtaaaaccccatctctactaaaaatacaaaaattaaccaggcatggtggtgggtgcctgtaatcccagctactcagggggctaaagcaggggaattgcttgaaccttggaggtggaggttgcagtgagccaagattgcaccactgtacttcagcctagagcatcaaagcaagaccctctccccgcaaaaaaaaaaaacacacctctggagctgaggtcagtctaaactggagagctgctatagcatggggtcagataaaaaggttttggtgggtgagtatgatgtcagctatatttcatgctgaccagaacaagcaaaaataacaaaaaaagagcaaagtggtaactttcaaatgagaaatattttacagtataacaagtccctaactaagaatattccaaagttaaatgatgcatcaaaaaattagtctctttgttttcatagtgtctgacctggaaggaaaaataaaatcaaattctgggtaagtaggatgaaatattttaattatactattctaaaaatgtgtgcatccaggtgattctgaacagctctcaaatggcataactgtgatgcatccatctggtgatagtgacacaacgatgttagaatctgaatgtcaagctcctgtacagaaggtaaaagtaattttttttttctaacaaatcttgaagggatttgaaattgggtttggaagtggtacaagaggtatttaaaagccctgacttaaatgaaatgttggatctctaagcctaatttttgcctacgtaattttttgaaaaagtacttctgagcaacatccttcccctacccacatacctacctatcattggtcctcttgtttgtgtttttttgttgttgtttttttttgagatggagtctcactctgtcgcctaggctggagtgccgtggcacgatctcggctcactgcaacctctgcctcccagattcaagcgattctcatgcctcagcctcccaagtagctgggattacaggtgtgtaccaccatgcccagctaattttttgtatttttattggaggagacagtgttttgccacgttggccaggttggtctcaaactcctgatcttaggtgatccacccacctggcctctcaaagtgttgggattacaggcatgagccaccatgcttggcccttttgtttgtgtttaattgaaagttctataatgttgatatttgccagtgatctcaattttaaagcatgtcataaaaccatcttttagaatctattctagggatatctaagaaatccaagggatttcctaatggagtcttaatgtctacttaatcttcaaattatatactgatatcattctttcaacaaatattctagatgattgggatacattaagatacataaggtactgttcaaggtgttttcagaaactatgaaaggaatatttttatatattttttctctatccccctccatccctctgttccattaccctctacttcttaccttttccttgcaagtactttagaggacaaatctaaaggtgagaaggtggaaggtgagatgctttagttgagtgagtcatagaactagtaattagcccattccataggtagagacaaaaacaggttttattgacaacttacaggaaagcacaactggctaatcattggtgattggtaaaggtcattgtgttggggacagggagggatgttttgactccttttattacttcaggatagaaataaaaggcctataaatatatctagtcatacattttcttttgccttatatggggccctagacaagttttctcctcatatttcatggaaatacatcaaaagtgcaatcaagcataattattaaggagataattatttttagaaattcagcagaagatgttttagtattgcacagccctctttccgtattatagatggacaggtttaactgtagaaagggccatctagacttgtgcttatctaatatggtagcctctggtcacatgtggctaattgagcccttgacatgtagctaaaggagctaagttttaaaatttgtcttttaattaaaatttaaaatggacacaattcagtttcggaagacttagatgtgtttggaacagtttgactatacataactagtttttcaactgtgaattttatgaaatctaattatagatcaattgtttctagtaggaatttagcatttgaagttgaaatgtcctacaaatgtaaattgggatgacttagtatgaaaaaatactttatgtcttttatattgattacctgttgaaataatgctttgggtatatttggttaaataaatatattaaatttacttaaatttttaaaacgtggctattagaaaacattaaattacatatatttctggtgggcagcactaacctcaaccatggtgtatcttgtttaagaagagcagtcacatcacttaagttttttcttcttaaccaccaaaaggaaaaatatatccatgtcagaggactctcaacaaactccatggcatttttagggtacaatcttactttgcctcttattaatcctttgagcattttctttattttccctataggataataagtatcttgattacactgagggatttatttatttttatgctttctgcaaattatgcagttaatatatatgtcttaaaataattggcaagtgtgctactttaatgtggtctcagattaataattgagtttagatgatctattatgtttttgtattttttttctaactttagtaacctttgactttagtaaccttttactttagtaaaagtacatgaagccctttagaatcttaattagatctattgctgtatcatcaaaaaatgttttcttccttccaaaatttggttaacatctgtagacatagactgaaccaaatatttgttttaggatataaagattaagaatgcagattcatggaaaagtttaggcaaaccagtgaaaccatcaggtgtaatgaaatcctcagatgagctcttcaaccaatttagaaaagcagccatagaaaaggaagtaaaagctcggacacaggaactcatacggaagcatttggaacaaaatacaaaggaactaaaagcatctcaagaaaatcagaggtctgtaatttactggattaaaggagggtttgggagatatagaatgtattttaaatacattaaatttcttatttgttaagtgactatgattcaactgtttagtagaacacagagcaaattgtaattgcaaaaagtacatttgatactttttctaagtgatgatatctcttttgaagacaaataatcaagggattaagctactaaagatactaattactaaattatatagtcattattttacagaaatgtcttaaagtttttctggtctatgtgttagaagatagtggttcatcttggccacagttttccaaaaccatttatttgttaatatggattagcctatgtgtaatttgatgcatcaaaaataaagcttaaaataatgttataacatgaacatggttgtcttaatatatggctttatatttgtcatttaataacatttttgtaatacttttaaggaacttgaaacctactttgagctatactttttttctttaagggatcttgggaatggattgactgtagaatctttttcaaataaaatacaaaacaagtgctctggagaagagcagaaagaacatcagcagtcatcagaagctcaagataaatccaaactctggcttctcaaagaccgtgatttagcaaggcagaaagaacaagagaggaggaggagagaagcagtaagtgaattttagtttactaaatctaatttaacaagggaaagatttaacagagcactgtcttttgtatgttcaaggatgcatttggggtaatttttcagtgacagtggacttacctctttagtgaggatcaggttctaaaattaaagcttaaaataaaaaaattcatagccaaaggaggcaatgcaataatagagtattgatcctggaagtactagactacctgagttaaaatgatgattttggaggcgggaggatcttttgaggccaggagttagaggctgcagggagctatgatcacaccactacactccagtgtgggtgacagagcaacatggtgctctcaaacaaacaaaaaaagatggtctgcctatttactagactcttagacctcggcaattatctaactccctaaagtgggaataataatacctattgtgaaggtgaaatgaatgagcatgtattaagcacataggaaaatgcctagcactaggtgaagtgatttatcacttactattgttactgtttaaaaatctgtaaaccacctatgaattgtggccagaagatgtgccatctgttcctggtcagcatttcttcggttgactgctagattaagaagctgactttcacttaggagtcctaatatgcagaaaataatattttaaaagctacagttgattccttcttttattcatggattatttcagaagtgtttagtttccagatatttgggaattttctgattctagtgatttctgttagtgatttctaatttaattccattgtggtcgtacacatatctgactgaattgtttgaaatttattgagacttattttatggcctggcttatggtctactttggtaaatattctgtgtgcacatgaagaatgtgtattttattgctgttggatagggtgttaatcaggccaagttggtttatcttcttgttcattatgaaatgatctttacttctggtaagaattactctgaaaattacactgaaatttaaaataggcacttcacctttttatgactagcgttggcacagtaaaattctttccatcgttttacttttaacctatcttgtgttttttttttaattatttaaagtgagtttcttgtaggcaacatgtaatgggagcttgcttttgtttgtttgtttgtttgtttgtttgtttttatcgagatgaagtttcgcttttgttgcccaagctggagtgcagtggtgtgatctcggctcactgcaacctccacctcctgggttcaagcgattcttctgcctcagcgtccccagtagctgggattacaggcgcacgccaccatgcctggctaatgttttgtatttttaatagaaatggggtttcaccatgttaggcaggctggtctcaaactcctgaccttaggcgatcgcctgcctcggcctcccaaagtgctgggattacagatgtgagctaccatgcccagcttgttttttatttttatttttattttattttatttttttgagacagaattttgctcttgtcgcccaggctggagtgcagtagtgcaatcttggctcactgcgacctctgcctcctgggttcaagcgattctcatgcctcagcctcccgagtagctgggattacaggcccgtgccaccactcccagctaattttttgtatttttagtagagacagggtttcaccatgttgccaaggctggtctcggactcctgagctcaggcaatccacccaccttggcctcccaaagtgttaggatgacaggcattagccaaagatctctgccttttaatcacatgtttagactagttacattcagtataatcattgacattgttaagtttgagttcatcatcttgataattgttttctgttcctgtctttcttctctctctctttttttttctgcccgtttttgtattaagcttttttgttgttaacttttgttttaggttctggggtacatgtgaaggtttgttacataggtaaactggtgtaacgggggttcgttgtacagattatttcttcacccaggtattaagcccagtatccaatagttaccttttctgctcctctccgtcctcccaacctccaccctcaagtagaccccagtgtctgctgtttccttctttgtgttcctaagttcatatcattcagctcccacttataggtgagaacatgcagtatttgattttctgttcctgcatttgtttgctgaggataatagcctccagttccatccatgttcctgcaagacatgatctccttctttatgtctacagagcatttttttagtccacttcatctccttcattgacatagtcagtaactctttgttttcctattttagtggttgcttacggtttacaatatacagctttaacttaatcgcagtctgctttcaatttacgttataccacctcatgtttagtgtaagagctttacaacagttacttccattcctccccgtcagccttatgctattgcttaaatactgataatatctcttaaattgttttaaataaagaatcttatatttacatatgcagttaccatttcctgtgcttttcattcctttatttatttatttatttattcattcattcattcattcattcattcgtttatttttgaggtggagtttcgctcttgtcgcccagcctggaatgcaatggtgcaatctcagctcactgcaacctccacctccctggttcaagtgattctcctgcctcagcctcccaagtagctgggattccaggcacccaccaccacgcctggtaaatttttgtatttttagtagagccaaggtttcgccatgttggccaggctagtctcgaactcctaacctcaggtgatccacccacctcggcctcccaaagtgctgggattataggcatgagccaccgtgcctggcccatttctttgtttagatccagatatccaaatagtgtaattttccttttgcataaaggacttcctttgaacatttcttatagtctgggtccgctggcaatagttctttccacttttgtgcatctgaaaatgcctttatttggccttttttttccattcatagacttttattttttagagcagtcttacatttgtagcaaaaccaagctgaaaatacagagttcctacgtgccatacccctctatatatatgccctcccccaccatcaatgtcaatacatcattgtcagccttagtataatcaagtaaagtctatagtttacattaggattcattcttcgtgttgtactttttatggattttgacaaatgtgtaatgatatacatcagccattatagttccttacggaatagttttcctgccctgaaagtctcctgtggcccacctattcatccctcctcacaaccctggcaaccactgatctttttactgtctccacaggtttatcttgtccagaatgtcatatagttgggatcatgccctatgcagccttttcagattgttgtctttcacttagcaatgtgcgtttaaggttcctctctatctttctatggcttgatagctgaattttaaaaaattaattatcttaattgacaattatatatatttatggtatacaattatgttttgaaatatgtgtacattgtggaatggctacatcaaactaacatgtatcacctcaccttttgtggtgagaacacttgaaatctattctttagtaattttttagtatataatacattgtttttaactatagtctccatgttgtatattaaatctcttggaattcctactgtctaactgaaagtttgtattccttgaataatatttcctatctctacccccaacctctccccatatcctaataaactaccatttcattctctgcttctatgggttcaactttttaagaccccacagataagtgagatcatgcagtatttgtctttctgtgcctggcttatttcacttaatataatgtcctctggattcacctatgttgttgaaaatgatggggttttctttttaaagattgaatagtgttccattatatatatataacatttcttctattcagccattgatggacatttaggttgatttcatgtcttggctatcacaataggtcatttctttttagcacattatatgaatataccacagtttagttattacttacctattgaaggacatcttggttgcctccaacgtatggcaattaagaataaagctgccataaacatttgtttgcaggtttttcaacttgccactttttttttttttttttttttttctcttgacacagtctcactctgttgcccaggctggagtgcagcgccatgatcatggctcactgcaggcttgacctcccaggctcaagcgatcctcctaccccaaccccccagtagctgggaccacaggcatgcaccaccacacccagctaatttttttattttttatttatttattttttttgtagagacaaagtctcactgtgtggcccagggtagtctcgaactcctgagctcaagcagtctgcctgcctctgcctcccagagtgctagaattacaggtgtgagccactgtgcctggccctgccttcaattttgaaagacacttttgctgaatttagaactctagagctttaatgttttttcttttagcactttaaaggtacttgttcactgtctcattgattccattgtttccactgagaaatccagtactattatctttggtcttctgtatatagtatgtttttcctctacttgcctttaacatttgtattgatcactgggtttcagcaattgttttcttcatgtttcttgtgatttgttgagcttattcaagttgtgtgttttcatcaagcttggaaaaattttggccattatttattcaaataatatcccacctcactcccttgtgaggactccaattatttatgtattagaccatttaaagttgcctcatagctcactaatgctcttttaatttttttttttttttttttttttgagactgaatctcactctgttgctcaggctgcagtgcagtggcgtgatctcggctcactgcaacctctgcctcctcccaggttcaagtgattctcatggtgcagcctcttgagtagctaggactgcaggcacgtgccaccatgcccagctaattttgtttttgtttttatttttttagtagagacagggtttccccatgttggccagggctagtctcaaactcctgtccttaagggatctgcctgcctctgcctcccaaagtgttaggattacaggcatgagccacctgcacctgggctgttcttttaatttttttaaaattattttttccctttgaatttcattttggataaattcaccagtcttttcttcagtgtctgatcttctgttaacccccagtgtattaattttcatcccagacattgtagatgtgagatttgggtttattaaaaatgtgtgtggttttttttatctctattaaactgctgaaaaaatggaatacagttaaaataactgttttaatgtgcttctctgctaattccaatatgtatgtcagttctgggtcagtttcaattgattggttagtctcttctttgtgaatagtgtttttctgcttctttgcataactaataatcataaataccaggtgtcgtgaatgttaccttgttgggtgctagattttttttttttttcccagcaatctcagtcacatagaactggatatttttgtaatcctaggaaaaacgtgtaaattcataggacatataagaacattagtttgagaagagaacagccattggctttagctatagtattggttaaagtacaaattaattttctagggaataacaaaagttctgtcagccacgtattttataatactaaggtagaaacaaattgcatttaatagtgctgtacatttaacatatggtgaagtttactttagagcagtgtgatcttagtggaactttctacaatgatagaaatatgctttatccattcaaacatactagcaaatagccacatagggctgttgagcacgggaaatgtagctaatgcaactaaggaactgaattttaaactttaattttaatgaactcaattttaaatagaaactttttggtattgtctttttggaggtttttaggaactcattgttaaatttcgttagtagttgacctaaagtctttcttttttttttcctgagatgtagtctgtgggattacaggcgtgagctaccacgcccagccgacctaaagtctttctgtagtgatgtaaaatgtttcctgttggcactcacacgggcctgacttaagtcacccccaagtgatttcactgcaccctagttgcggcccaacaacacaactaggtaacctgataaatttcccaatatcctaagcacttttctggaacatgactagactaggaacccactgaaagctgactaatgatgttacatctagcagcttgataactaacaacccgaccttggatctatttgctatcatttttgacagcccagcctcttgctgccagtcgaaagagccatactctataaagcaataataacttgacacttagcagagttcccaaacgtttacctcatgccagttaccttgaccaaacttttgatcttaaatttgaacagttgaagagtgtatttaggaccacacagtaaggaatagccagcttatggtgtcagctatggggagcattagtattaaaaatcatggtattggctgggtacagtggctcacgcctataatcttaacactttgagaggccgaggcaggcagataactggaagttaggagttcgagaccaacatggtgaaaccccatctctactaaaaatacaaaaattagccagccatggtggcgcacctgtaatcccagctacttaggaggctgaggcagaagaatcatttgaatcgggaggcagaggttacagtgagccgagatcacgccactgcactccagcctgggcaacaagagcaaaactccatctagaaaaaaaaaaaaaaaatcatggtatctaaggttaattggtacagagaataccagttctctatcgataattgttccacatgcacagattttagtcaagatgtaagagaatctaaaataagccaatacacacaacctttaaataaaaacaggtttcattacatattctacaaattttgcagtatgtctggatacttatagcagtatcacatgatatttaaactaggacaacgtatccaatgcctatattggaggcttagaatagaacttaaaggaaaaatctgtgctagacatttggcatcctagaaactgggtgttaagaatgtagtctggggccgggtgcaatggctcatgcctgtaatcccaacactttgggaggccaaggcaggtggatcacttgaggtcaggagttcgagaccagcctggccaacatagtgaaaccccgtctctactaaaactacaagattagttgggcttggtggtacgcacctgtagccccagctacttgggaggctaagatatgagaatcacctgagcctgcgaggcagaggttgcagtgagctgaggtcatgccactgcactccagcctgggcgacagattgagactctgtcacaagaaaaaaaaaaaagaatgtagttcatgccagttgcagcagcttgcgccttgtaatcccagcactttgggaggctgaggcaggtggatcacttgaggtcaggagttcgacgccagcctggccagtgtggcaaaattgtctctactaaaaatgcaaaaattacctgggcatggcggtgcacatctgtaatcccagctccttgggaggctgaggaaagagaatcacttgaacccaggaggcggaggttgcagtgagctgagatcacgccactgcactccagcctgggtgacaaaacgacacaatgtttcaaaaaaaaaaaaaaaagattaaaaaaaatgtagtctagattaagatttaagaagtattcttttgtctctaaggcagatttaaagaaatttatatggtttgtaagagtcagacatacctttcaaatactttcagtaggtaaatcacaattccaaatattttcccacatagctaatgagaatgctaattcccattcaagaagccaaccaactgattgcaaattggtgcttttacctaccactctggtctgttgctgtttattgatttattttttaaaaataattttgtgaactttaatatttggtgtcatctcagatgctaaagaatatctataagggcagttagaaaaggcttcagaatatagttgacatttgtttcctttgtcttaattagctttttctctactttggcttattttttaaacagctttttcgtgattaatatggcattttgctgaatgttacatgtaatctgattcttcataaatgcctatacatagaatagactaggttacacagttagtaagtggcagaatcaaggaaagcccatagttttagcattacatattatagttatctcacataacaaagatattggttcattcagaaagtaattttgtgtgtctggcattatgctgggtttagaagtaagacagtgtgctctcagcgttcatgttcttattcatacccactctgtcaacattgaactttctcttttacttgtagggaggggtcaaacttattcttagtgttcttgtaggttttgttttttatttattacatgaacaatatattaacaaatcaggtaatatttgaacagaaataattatgtacaaatttattgttcaacctgagaaaataaaaattaaaaaattattgaatagttttcttttgtatgatttgttcctaaatgttgcataatcattattgtatagttgtagtaaagacatacatttttaaagtaatattaaaattttctgctttttctacagatggtgggtaccattgatatgacccttcaaagtgacattatgacaatgtttgaaaacaactttgattaaaactcagtttttaaattaaccatcaacttaaaatgaatggtaaaagatcaaaatgcatatggtaaaatgattgctttcagataacaagataccaatcttatattgtattttgactgctctaaaatgattaaacagttttcacttacatttttaatagctatatgcttattttttaaacgacataattcaaaggaaatttaataattttggatccctaaaaattggacaaattcccagatattcgttcattctataaataattgtctatatattataggccctgtactaagcaatgaaaatccaaaagatagctcctgcttgtttaaaaatgaagagtatgacttttctaattcaataagtgaaaaataatgaagaatatatgaaagtgtataaaaaacatagttcctgttgagtttttaacttttaaaacaaatattcgtctgccttcaaaaatatttagattctaacaaataatacttggtttcactgaatgtcagatttcataagattctcagctggttctatattaaaaatttatattgaaatgtagttttaaagaaatattggctggaactgccagttgtggtggctcataactataatcccagcactttgggagaccaaggtgggcagatttcttgagctcaggaatttgggcctgggaaacagggtgaaaccttgtctctacaaaaaatacaaaaaatcagctgggtgtggtggtgcgcacccgtggtcccagctacttgggaagctgaggtgggaagatcacttgagcccaggaggcagaggttgcagtgagctgaaatcacaccactgcacttcagcctgggtgatagagtgagacccctgcctctacaaaaaaaaaaaaaacaaaaaaacaaatgaggcatggtggcgcactccatgtagtcccagctacatagagggctgaagcaggaggctcatttgagcccacgaggtcaaggctgcagtgagctgtgtttgtgccacttcactccagcctaagcaacagaatgagaccctgtctcaaaaaaagaaaaaaaaaaaacaagaaatattgccgatggtttgaaagatgttgaatttgagtcaaaataactaaaatatttatttgtaatatttaatagtgaatattatgtatgtaagtttctatataaacttatgagatttcttaatatgcatatgtgatagtaatgaatgtttaaaatatttaaacaacaataagacttatttaaatattctgtaaaatatttctcttttgttattttcaagttgcaattatgtgtaaatcatgtgtatcagcttaatgtattttaaaattttgaactctggaagtgtaacatgattcaggcagtgttctgataccatctaaagtaaaaattcaaagtgtatgtttattatagagaaagagaaaaagttatcttgacttcacttatttttataattaatatgataaatttttgacatatctttaaattatcaggcatgtgaaaaacatgattaagtagtaactaaatggtgatgtgaccttcatgacacagccagaattaaagtgacagggtggctcacgcctgtaaccccagcactttgggaggctgagacaggcagattgcttgagctcaggaattcaagaccagcctgggtaacatgttgagactctgtctctacaaaaataatacaaaaattagtggggcatggtggcacgcacctgtagtctcagctactggcagttggtgggcggggggggtgggtctcttgagcctgggaggtcaagactgcagtgagccaagatcatgccactgcactccagcctgggcaatgagagtgagaccctgtctaaataaatacataaataaataaagtgatagtgtattcttatccaactatacctcttttaattaagaaatcagtttgtgctaaacagtacagattgtcctatgattatatatatatataaaattttatttacataatataaaagattatagagagctatgtttggttattctgtttaactgacttggcacttaacctcttcttaggctataaggggcctggcacattgcagataatcaacaaacttttagtgggttaaagtcagtttagcaaataaaagtcaataccattagtttataaccaatgcttcc

SEQ ID NO: 13575 - DNA, 7519 bp, Human
aggtataaatcaaggattcatgtaattttgtcattccttgcgtgatattttaaaaaacattctgtgtaaggtatttataaagcgtttactattaccgcaatcacaggggcttgaggaaaaactttgactgtggccgggcaccgtggctcacgcctgctaatcccagcactttgggagaccgagccgggtggatcacttgaggtcagcagttcgagaccagcctggccaacatggtgaaacccccgtctcttctaaaaatacaaaaatttgtggggcgcgcttgtagtcccagctacttgggaggctgaggcaggaggaatcgcttgaactcgggaggcagagcttgcagtgagccgagatcgcgccactgcactccagcctgggcaacagagtagaactccgtctcaaagaaaaaaaaaaaaaaaagaaagaaaaaaaagtggactgtgaaaactgaaaggactagaaaaactacactacaaagatacagaaaccaagaaagcaccatagcgtttgccttcaactgcttcccaacttgttttcctcttccaatttgattgtggtttcctctccagaaggaactccacagtacttagcgttggccacatagtaggttctcaaatacttgttaataaataagtttgttcgagaagctgggcaatgatattctacagctggaagaagaaacataatgatctagtaattagctcattaaaaataaacgttcttctttcctcagaggagcatttcccaaggcctgccttgatagccatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgagatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagcggattcgtcgctttcacggccatcgagccgaacctctcgcaagtccgtgagccgttaaggaggcccccagtcccgacccttcgccccaagcccctcggggtccccgggcctggtactccttgccacacgggaggggcgcggaagccggggcggaggaggagccaaccccgggctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaagtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgaggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatcctacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaaagactcttaatccttacagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttactgcagaggctaaagtcatttgagactttggatttgcactgaacgcaaatcttttttccaaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaaggatgactacttaaatgtaaaaaagttgtgttaaagatgaaaaatacaactgaacagtactttgggtaataattaactttttttttaataggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaagatgaagtggcatttcttttaacagttactatgttggaattggttacaaattttggagtggatttcaaaagtgagagctaacttcagttgatttcaaggtagtgcttggctttttttgtttagacagggttttactcctgccctggttggagtggaagttaacggctaactgcagtcctgacttctgggcttaagtgatcttccctgaatagcagggaccacaggtttttgccacc

SEQ ID NO: 13576 - DNA, 63783 bp, Human
ggagacatgtaatgtggcatcctggatgagatcctgggaccgaaaaaggatattaggtaaaaattaaagaaacgcaaattaagtatgaacttcagttaataattatctatactggctcgttagttatgatatatgcatgatactaatgtaagatcttaataataggtcaaactaagcaaagggtatggagaactcactgtactatctttgcaacgtttatgtaaacctaaaatttctaaaataaaaaatattaaaaaaaagaattcctctggtttgaagtctttcaagtctgttgcaactatattccctggcccaagttatctataaccttggtcatctgggagcttgttagcaatacagaatctcaggcacatcccagatgtactgggcttctcagagaaacagccccaattgggtagtttgggtaataaagttttggctttcacaatataggctggccaactcgacccaaaacagatgatggtgcacatgcctggagacccaggaggacctgtggtgcagatgaagtctgaggacactctgctggagaagtctcccttgcttgggcaagagaagtgggggagtcggattttttattctagataggccttcaactgattgaaggaagcccacccagattatggaaggcagccatctttacccagagttcaatgattttagtgttaacctcatccaaagacacccagcaagttaacacataaaattaaccatcacaccagatctgctgaatctgaatctacattttaaaaggatttgccaggtgactctgcataatccagtttgaaaattgcatttttctacaacccttagagagtgtaaaaatctacatggtaattcagtaactcagaaacaaggcttgatttgctgctttaacttgagaacttttctagcatttactgatctggaggtagggatgcctacagaaatcctcgccctcccttctaggtaaaggaccctcccctttgttctcacgtgaacctcactaagcttctaacctggtttactgaattagtggcttgtgggtcttccctgtctacaccaaactctccgagagcatctacatcttattttctacctccacagagacagcctttattggcggatccagatctgccctgccaaggcaagctgggttttcctagtttcactttcagagtccgcaaatgctagcacaatctatccaaattctatcgtggagataaagcatgcacacatacatcagaggattccataggtcgaaccatatgaaactacctatgttgattacttttacctataaaaccagcaacatcataggactcaacaaatttccattgctgtttttccgcctaaaagctattttaggaccaggagcagtggctcacgcctgtaatcccagcactttgggaggccgaggaggattgcttgagcccaggagttcgaaaccagcttgggcaatataataagaccaagcctctacaaaaataaaaagtagaaacaaaattagccagatgtggtggcatgctcctgtagtcccagctacttgggggagctgaagagaatcgcttgagtccaggagttggaggttgcagtgagctgcgattgcgccactgcattccagcttgggcaacagagcaagaccctgcctgggagaaaaaaaaaaaaaaaaaaaagctattttagggacaatatgccgccacagtcacgaggtaaatatgccgccacagtcacgaggtagatcgtacaaaggttgctaacagtatggcaactgaccgctaacaagcgaatgtcaagttgtgaaatgcacaccacccacttccctagttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtaaaccggcgggcggagcgggctcactttgcgccaatcctacgagaactcccagaactccgcttccctagtccaacccaagccagagttgcccacacctaagatggcggcgggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccggtaagcggcggggtcgtccaggggcttcgagtgggcagcggtaccgggggcggcggtctctgggccggcatggcccgggtacccgcaccctgcgccggcgggaccggagctgctcaggcgcgaggggacattaagaggggagcccgttcagagtgccgctcagtcccgcctgcctcggtgcgcagaagcccctcgggaaccccgggggccgcgaccgtgatcgcggagccgagccggggcctcggcaggtgcagccccaccgggcgggggcgggggcgggggcgggggcgggggagcggcggtgcagccggcgctgagctggtggttattttgggtagtgctgagcaagggacccagtggaagaacgaactgggagagaatcatcaaatgaatgggctaaggtccgagcggaggaccccggtgtaagagcaaactggaggagaaacctgcagatcagtaggcagagggctgtccttccctgtcaccgctaggtttccgccactgcgtatccgccagcatgtgacctggtagcttcttaggcggggagggaagacaaaaaaggactggagttaacatttgtgagtatgcagagggcaactattgtataacccagctgatatcttgacattgtgcagtaagagactaaaaacatcgaggacattttttttccgtctggcagtctatgatttaagttaggaaaaggttcagttatcctcaagatacctatggagttctaaagtaatttgccaaaggtcttggaacaaatcgaaaagcaggtacgtcataaagcatcttccctgaatttgagaaaattaaaatattttgctatttgacacttttgtaatatagtttatttaaaagtaacgaaaactaaagaacaaatcagtttgaatgcattctatagtttcaaagatctgtgcgtgagaaagagttgtgttggaaatttgactttggctaacccagaattgtatagtttctatatttttatttgtttttaatgttaccagatggtggcagtagaggtggcaaccttatagctccatctggcagccgggagcttattttagtcaacacaaactgtaaataccataccatagttacgttttacctggaagtcggacttagttccataaactgatcattttctgtggcttgtagtgttcaaattgtataatattcctcataaaataatatagaaatacagaaataaaagttataataaagatatttgccagagattattacattgttacaattgaaaaatatgtatatgtataatcaaaatttagcacaaatgttaaacattattctcaggaaaatgcagattaaaattacaacgaggcactatacacccactagaatagctaaaatccaaaaggctgataataccaaatgttagcagagatgtggatagaaaagttatacatctcaataaagattgagatggacaaatgtatacatttatcacgtaaattatacttcaataaagttgatttttaaaaaagtagcttatagcatcccttttaaaaacaatccctacttgattcatgtgttgagtgtatggatcttatggtactggccctgtccttcctggctttaggtggctacgtttgttacaaccatttccttttttattttccctctttacatacccactggagagcaagtgaagtggaaataatagtaacatactgtttttgctatttagaatatgataagttttatagagaaggagcatatatggcaattaagagaagtatataatgagcccccatgtaaccagcacccagattaaacagttatcaattcatggccagtcttgccttatgctcatacatactgtgtattttgaagcaaatcccagataccatgtcatttcatatgtaaatatttcaattatttacctctaaaagataaggactctttttaacataactacagtactattatcacagcaaataaaaataatgcttactcactttgggaggccgaggcgggcggatcacctgaggtcagcagaccgagaccatcccggctaacaaggtgaaacgcctgaaacgccgtccctactaaaaatacaaaaaattagccgggtgtggtggcgggtgcctgtagtcccagctattcgggaggctgaggcaggagaatggcgtgaacctgggaggcggagcttgcagtgagccgagatcacgcccctgcactccagcctgggtgacaagagcaagacttcgtctcaaaaaataataataataaaataataataatacttacaaaatactcagtgttcatatttcctcaattatgtcctgattttttttttttttttttttttttgagacggagttttgctctgtcgcccaggctggagtgcagtggtgcgatctcggctcactgcagcctcagcctccccggttcaagtgattctcctgcctcagcctcccgagtagctgggattacaggcctacgccaccacacccagctaatttttgtatttttagtagagacggagtttcaccatgttggcaaggctggtctctaacttctgacctcaggtgatccacccgccttggcctcccaaagtgctgggattacaggcctgagccaccgggccgggcctatgtcctaattttttatagtgtgttcaaatcaggatctcaataatgtccataccttccaaatgattgaaatgttttttgtctcttttaatctgtttcccctgccccgctccttttcttttccctgcaattttatatccttatgttgtcctttaacatcttctgccctcctgatttactgtaaattggtaattagtagatctgaagatttgataggattatgagtctgtctgtcttaattaccgtcatgactattccataagtagaatacaagtgtagaaagtagaattgtgtcagcatgctaattctcccatacacggctctagacactggagatacaaagaagtaaacaaaacagaacaaaagctcctgcccttatagacttttatattctagtgtatattttcctaaactttcagccctctccattttgctttcttcttgggttacaatcaaagtccaacactttattttcttttttttttttttcaggatctcactctgttgcccaggctagaatgcagtggctcaaacaggtcttactgcagcctcaacctcccaggctcaagtgaccctcctacctaagcttcctgaagaactgggactgcaggcatgtgccaccacacctggctaatttttttctttttcttttttttttttttttttttttttgagacggagtcttgctctttcgcccaggctggactgcagtcgcgctatctcggctcactgcatgctccgcctcccgggttcatgccattctcctgcctcagcctccgagtagctgggactacaggcacccgccaccacgcccggctaattttttctatttttagtacagaaggggtttcaccgtgttagccaggatggtctcgatctcctgaccacgtgatccacctgcctcggcctcccagagtgctgggattacaggcgtgagccaccgtgcccggcctttttttctttttctttttttttttttttgtagaaaaaaggtctcacttagttgctcaggctggtctcaaactcctgggctcaagtgatcctcctgcgtcagcctcccaaagtgctaggattacaggcgtgagccacagcacccagcccaacactttattttcttgccaatactctcgattcccttgcccccttctttgtcatcacatccatctcagtgccagctatctgctttcttagtgcctactcctgagcacaggcatgcagtgcttatgaagttacacactagggcagattgttcccaccaattctgtatgggtatctgctcagcattcctgtgtttcactgagaacctcatgcccccactctcttcaacaatttcttacttttcccagatcccaatttctcacaaatgagaactaacctcaattcctaagaaataacctcaattcctaatttccagaaaaaaaaacccataataattcacagttactctgtgccaagcactcttctaagtattttacattactaactcagtgaatccttataataaccctaattcaggcaaaatacttcgactagtgccaagcgtatagaaaatgcttagtaatatttgttttttgagacaagagtcttattctgttgcccaggctgaagtgcagtggcacaatcacagctcactgcagcctaaacttcccagactcaagccatcctcccacctcagcctcccaggtagctgggattacaggtgcacaacaccacaaccagctaattttgaaattttttgtagagatggggtttcatcatgttgcccaggctggtcttgaactcctgggctcaagcaatccttccccatctcagcttcccaaagtgctgggattacgagtgtgagccaccatgcccggcttgtaataaatattatctattattgtctaggcatggtggcttatgcctgtaatcccaatgctttgggatgccaaggtgggcggattgcctgaggtcaggagtttgagaccagcctggctaacatggtgaaatcctgtctctaccaaaaatacaaaaattagctgggtgtggtgatgcatgcctgtagtcccagctactcgggaggctgaggcaggagaattgcttgaacctggaagatggaggttgcagtgagctgagattgtgccactgcactccagcctgggagacagagaaagactccatctccaaaaaaaaaaaaaattatatattattttatgttattaaacttaatacccactatcccactcaatagtgttagttcttagagttactacaatacataatctagatactgcagatcatttagaatgtcctgctctccctatgtttatctgtctcatttccatacctctgtacatgctgctgcttttgcttggattgttccatctgtccctactggtgacttcctgctccttgaagagacttctccaagaggccttctctgactgtctccactgtcccctccatcagattaatgtgcctcttttgttcctttttatatatacgtacatagtactttgtcttattggcataactttctccagataaaaaggaggaagaaatcctttttactaagtgcctgctataatgtcttgcagtatttcatttaatccccatgcagcccagtgggtagatggtggtctctacatattatagctaagaaacctgagaatgaaaactagtaagtaatttctacaaaagcacacagccagtgaaaaatcagaaacagattcattcccaggtcccactctaaattagcctgtgtactttcagttacacccacacacattcctaagtttaaaacacattttagaagctgatgtttgtttttgatgggtgccatgttccttatgcaagcatgattttgctttgaacttgatgctcaatggatgttctctctcttggtcatgcaagcatgcttttgttggatcaatttcaaagaatattcacattcccaggcatgtttttctttactgctataccttcttgaaataaaaattttctgattgaatatatttgtaatcagcaaccattttattagctagtaattgtttatttttaatatttcttagaatctcatagtaatatactttgtgacacctgagttggctttttattttcttttttttttgagacgaagtctcgctcttgtcccccaggctggagtgcgatggcgtgatctcggctcactgcaacctccacctcccaggttcaagcgagtctcctgcctcaacctcccgagtagctgggattacaagtgcctgccaccacgcccggctaatttttgtatttttagtagagacggggtttcaccttgttggccaggctggtctacaaactcctgacctcaggtgatccacccgcttcgtcctcccaaagtgctgggattacaggcgtgagccaccgtgcctggccgctttttattttctaattactgactatgcatccaaaagttaaagttgcctgatctataacttgtaggtcagatttccaagtaataccacgagtaatttgaaatcattttacttacctttctttcatttctcaacattctagccccttgtaattcacatgataaggtatatcatagtcccaataaagcatcacttagggaaaactaataatgtacagtaaaataagataactgcaaataaggatagaatgaagtaataacattacaaattacagtagcataaaatagagttttttagagtaagagaattactaataacttcatccctccccttcacttactcccacatctaacatttgggcaaggcctgttaattctgcctttaaacatctcagatctgcccatttttcttcactgctgctttcactgtagtttaagccaccttcatctcttagctggaaagctacagtagtcctttaagtgatctccctgactgtacattccttacacccttcacacttctcctttctatagtctccatgcagggtccagatgagctctttaaaccatcaaccagataagctttttaaaccataaatcacatctcatcactcctttgctgaaataggtaatgatctttttaaatgctgcattgacaaaacagacatagtacataaatctgggtttttcttgctccaaattgctcaaagtaacacattttaatgcacacatttagctagatttttgagtcccccatccagacttctaggtaatatcacctgacacagagcaatgataaagaaaacatgttctgctgggcacagtggctcacgtctataattccagtgctttgggaggctgagatgggaggattgcttgaggccaaaagttcaagaccagcctgggcaaaatagtgagaccccgactctacaagtaaaaatttaaaaattagtcagatatgctgccatatgcctttagtcccagctactcaagaggctgaggtgagaggatcacttgagtccaggggttcgaggttacagaaagttatgatcacccactgtactccagcttgggcaacagagcaagaccctgtctctaaaaaaaaaaagaaagaaaaaagaaaatgtgtttttttacaaaacatgcctcacaatatccaaaccgtcattaactggacaactgcccatttggttgcagcagaaagcaaattcgcctagattctagtaatagagacaatgtgaatagaactttagaaattcagttcttacagatctggatctaactatggtagtggtaccataaatttcatagctgtacccctgaagaaaggatttaagaatgccaaatgaaaagtttcctgttaaaagaagttaatcttacacagggaaaaaaaaataatagcagttgttaaacataggagggcatacagaaaagtgagttggatcataatatattaatataaacctaagtatagttgtgcatattcattaatgtttcagtctaaatcagttcatctgagccagtatcaagacttttgtattctgtaaaatatattctctcctttgatgctaggttaatgaaaacaccaggattcttaagtaggggaaaaacatacacacatttatatgatgttgatgtgtcattaccaaataaaagcacacatattttcatttaattttaatatgtcattgcttaatgaaatacatgtttatatctttaaagaggtatttatcagccactcagagtttactaaacttaaagatgttcagactctggattagctaatttctctttgttactaagaggttgattatccttagtcagcatcctgaatcctatccctctccaattctgcaactcaataaaagaagaaaaaagagaaactatgcataagcccacagttagagtaataaataggtcaaactcctcctctcacatgatccttttattggttcctccaacctactctgcattctttttttttttttttttttttttgagacggagtctctgtctctgtcgcccaggctggagtgcagtggcgcgatctcctctcgctgcaagctccgcctcccgggttcacgccattctcctgcctcagcctcccgagtagctgggactacaggcgcccgcgaccacgcccggctaattttttgtatttttagtagagacggggtttcaccgagttagccaggatggtctcgatctcctgacctcaggtgatccgcccgcctcggcttcccaaagtgctgggattacaggcgtgagccactgtgcccggcatcctttttttttaatcatggtggtacattcactgatttccctttttactgtgagccctttacgcttgataactactgagcaactgtcacagatgctgcaactgtcataggttctgcaagtttgcttctagattcttaaatgcatttagtttacgatggctttaagtattaatcatggcttctgattcaaacccagcctttgaggatactcttcgaggtaagaaatttatcaagagaaatttcatgccctacccttggcagtaaattttttttgctatgctacatttaacaatgagatggctactaactcataatcagtaatatatcatgtcattgtaagtactcaagtacttattgaccatgtttcagatagtttttcagaaatagtaatgccattaaacctccttacctgcttttctcatgccgtatatctttgccagctgacaaggagtaggggttcagtttgaatctggaatagatctttttctcagcaaaggtgataaaactactacctccatgttttaatgaactttcttatagttcaggctctcatgtgtgaaatttttaccaaaactacagatatgagaaacagctaatctttgacaaatgtttcttagatttgcttaatctaagaatattctttaacattttttcataattatttttgtacttttaaaaagcaacctttttcattatttagacaatatcatgtaattaacttttttaattaaagcagccgggtatggtggccaatgcctataatcacagcactttgggaggctgaggtgggtggatggcttgagcccaggagttcaagaccagcctaagcaacatggcaaaaccctgtctctaaaaataaaaatttaaaaataaataaaaattttccccaatctttatttcagctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacggtaggtgctattttttaaggaaacaattttaattatcctaaaatacttgcaagtaaaaatattaaaaggtcttttttcatcctacagaaactatactttgtttgtgtatactctgaatcactttctttttgtgttttcccaggaactgattgggcaataacttgtaactatagctactactgctatgccgtaatacaccttcatctgtttgaaaagtagttcttccattccctctataaacataccatgcttaaagaaaatttggaaaaacctgttttatataacagaaaattaaactgttttaaattttctaaatagcttttataggagtattatttataaccctatatcacttatagagttacagctgcaagagagtttaggtaatctcagttgcaagatgaaaaacaagaactggccagtttcttaggacattcttttctgaatgtacacatgcccaacctaagccacataagtcattttgcctgccttatgttatagtggtattgataaatgtgtattcatcatttgtttataattaagttatatatacttcattttatgttgcttatcacacgaggagatagtacagaaagaaaagctagtattctttttagaagtacatttgcaggctgggtgcagtgactcatgcctgtaatcccagcactttaggaggctgaggcaggtggatcacctgaggtgagtagttcgagaccagcctggccaacacggtgaaaccctgtctttactaaaaatacaaaaattagctgggcgtggtagcacacacctataatcccagctactcaggaggctgaggcaggagaattgcttgaacctgggaggtggagtttgcagtgagccgagatcacgccattccactccagcctgggcaacaagagcaagacttcgtctcaaaaaaataaataaataaaaaataataaatttttggccgggcgcggtggctcacacctgtaatcccagcactttgggaggccgaggcacatggatcacgaggtcaggagatcaagaccatcctggctaacatggtgaaaccccatctctactgaaaatacaaaaaattagacgggcgaggtggtgggcgcctgtggtcccagctactcgggaggctgaagcgggggaatggtgtgaaccccaaggggtggagcctgcagtgagccgagatcgcgccactgcactccagcctgggccacagcgagattccgtctcaaaaaaaaaatttaaaaataaataaataaataaataaataaattttcacccattttcagtgctcacgaagatactagttcatacttagatgaatctcctctatcattcacaagcagagcattcaagcaggaaagagggtttctctctaaacaaaataaatctctccgaaaatctttatatttgactttaataatgttgctgagtaacatttgggtacacatcactcactttctccactccaacctgtgaccttcagggacaatactgctggaatgtacatgaaatcctagaattccacagataaactgcaaattggtaccctaaataaggaaaagtaagagtttgctttgtgtctttttctttgcaaagtgcttttgttgaccctgctacttatcttcatctgccttatatcagcagtagaaagaaatcccggaatggttcttgacatgttggctttgttatacagctacactgcattaaaaatgtcagatactcagatcagtcactaaatcttcattagtaccttgctgtgtgctgttactaatgaaaacacaggttctattcacatgaagtttgtggcttgatttaaattcttgctctttggaattgttccatgtgcttgtttaagtgcttcgtctgaaatggggagatattattaatatctacatttatgcatgttaatagccagcactaagtgaacactaactgtacatcaagccttattttatgtgcctatttcatttcctcttcccagatcacacattcggtaagtaatagagctaggattaaaaccaagcctggttcccaaagcctagctcagccactacagttttctgcttaatagctttctggattaagcctgtgactctttttttgggagggggaggcagggccggggggacggcagcctcccgagccatagtaggctcagagatacccaagccttttttgtgattcttttgtgagccttcttggtcatagttattataaagcttctggcagctcatcctgcagtctagttttataaaattgcaagccttcttgaagtttacgactgtcagttctttttcattcacttctaaatactgtatatctatattgttatgactcacccacctactagaaagtttgcatgttcttcagtccaaaatagtggttcaaaatctcatttatatgtacttacatgccagtaagagaaaagagctgctctgtgaaggtcttaaaggattgttttattcttttctgatttttgtagggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagaggtaattttcttttctctcttgttttacttcttaccgtgtgtctccttctcttcttcttaaagatgtcattctttggtatgaatatgaaccaaaaaataacgttggatgataacaggggtttattttttagagaaaggactaactagaaaattacctgaatagattttgtttgtggtaaatgaggtctctagtaggagcaccccgaaattggaacctttactcaaaaaccagagaaaacttttttccaaaagagacttcatagctcatactttaggagagaagaaaataaaccattaataaatggttaagatagtccaggcgtggtggctcatgcctgtaatcccagcattttgggaggccgaggtaggtggatcacttgaggtcaggagtttgagaccagcctggccaacaggtgaaaccccatctctactaaaaatacaaaaattagccgggcatggtggtgcacacctgtaattgcagctactcgggaggatgaagtgggagaactgcttgaacccgggaggcagaggttgcagtgagccaagatcgcgccactgcactccagcctggacgacagcaagtctccatctcaaaagaaaaaaaaatggttaagattgaccatccttacctcttgtgctcttgccaccgttaaactctgctctatcattgatgcccaagtctgaagcacattttacacaatagactgttgagttgcatttaatttcttttttatcgcttattcttttattttttctggtcttgtaacttagagacaaatattttatgattttatataactatctcaatttagttctatgattctgctctttttagaagtattattgatttttgcctcttttatttccctcctcttaatagttttatcattttttaaaattttgattcttgtctttcttttccttcccacttttcttttgtatttcatcatgtgtacccccatacttaataattttcacttttcctttataacttcgaacttctacctctgaaatccagggaatggtgtattttgctctcttgcatttctttaattcaagcaagataatggccactgggcttggtgtagaggatgaagattattttaagtagcagtgtatcatgctgttggaatgaacactggaccagagtttgaataatagctctattgtatctaacagtgaaaccttaggtaagctctaatctctagatctcagtcccatcattttttaaactgggactaaaataccttccctgttttcagtcacagattagatataaaattcatatgtgataaggattgctagaatactttggaaattgccaggtactattaaaagatttttcattcatctgaatgtttttattttgttcttatcagtagaggtccattaagtaaacccttcctgatcacaaaattaaaattactcctctattaccaggttcctgttcttcttgacaaagtaaaatatacttaaatctagcatattttctctgatcctagtattcaatctccttgctgaatgtattcccatattttacttccagtttatgccactaatttaacattacggcatattgatcatattaccactgttatctcaggtgacattttatttattcatttatttatttttttctagtctttgagacggagtctcactctgttgcccaggctggagtgcagtggcatgatctcggctcactgcaacctccgcttcctgagttcaagcaattctccttcctcagcctcccaagtaggtgggattacaggcatgcgccaccatgcctggctaatttttgtatatttagtagaggcggggtttcaccatgttggccaggctggtctcgaacttctggcatcaagtgatccacctgcctccgcctcccaaagtgctgggattacaggcatgagccaccgtgtccagccaacaactaaatagaatttaagttgtatttatactcaggttctctcgtccttcttcatcccttcaatatgtatcacaggtgcatttcctcattcataaaggacacttagattactatcttgcattcctaccatctgattcaccataaatatacctacattgtccctaggttttataataaagttttctacaacataatctctgtgggcatttccaaacatctcaagttttcttctataatgactcatcctgtggatgctccatcatatagattcttattgatttgcaatgtacctaaatcatctttgccttccattggtattacttttttttaattccttttgtttttgtttttgaaagagtcagcggaaagtacaaagtattaaaacatttattcttctctccactaataatagcactagttaccatttatctttacaacaattatgcaaccgccttgaagttcagggaggttaactaatctttctgaagtgacacagagagtgtccaaggagagccgttctctctcactgtcctgtggtatctcctcatttacccagtctctatgaaactccctgtttccacatcctgttagctctccgtgtcagtaattggcatctactaggcttgttatcacaggaaaaaaaagaagaaaggctgtaaacatgctaattgaattcatcctttttttaataggactgtttttctggttgattgtcagcttgaattttttttcagtatcccaaaatattagctcagtattttttaaagttataagttagtaatattccctttcattcaggtgattaataaagtgaatgagtaaaattaaccttgagcaagatccctttatgtcctcactcagtacaattattttagatttattgtaacccttatcttgttgtcttaaaaccagttccaaaatccatgaatctttggggagttttactttttttttttaagagatggtgtctcactacgttacccaggctgatctcgaactcctgggctcaagcaatcctcctgccttggcctcccaaagtgctgggattacaggcatgagccaccacacccagcctcaaattctgaaagtacttcattataagatattttcacttaacactgtaaaaatttctcatttcatggaacctgattcgtttgattcttatccagaaaatgcttttgtagcaaaatacttaacttactttaaagcattaacaaaactaccttacatttcatcagaaatatcatgttcccttctctcagggtgttacatttccagccatgcatgccatgtggtcttcttgggctccccctcttgaaagaagcaaacttcttagcatttcatatgcaggtgagataacaattaccaaattttgctgtaatatgttatgtatatatcaacctttgggaaaaagggcctgcataccagaacgatgcaatgttggattggatgcccctttggggagaacattaagtttcggtagtataactttattaccaatttttctctttggctcaacaacttatagtaatgcagcttaattgactaatgtcattttccccatctgccatcatctatttcaaagtatgttgtgttttcagatattggtatagagatgctattttttttctttttctgtttacttttttgggggttttaaattttatttttgtttgtttagagatgctatttaaaaaaaagaaaaaaaaaggccagtagctagaaaattgagtgtttttgtccttaaattgtgatttctgttttgattaactaatgaatgtatcatgattctcaacccctctcttcatgcatcttttttctattgcatctttatttgccatcattttgatctacaggtgagataacatgagttttatatatgtgaattataattttatcagattgcataagaaattctagcctttctttcattgactaaattaaaatttttccaccggactgctttttaaatacagtagttgagaaaaggcctctctgtggtacttttaagctaaaatctgaaggataagaacaaaccattcatgcagggagaagagcatttcagccaatcagaacagcatgtacgagggcactcaggcaagaaataacataagggttaaaagaagtggaaaactaccttggatggctagaactcagtgagtaaggaggatgatggcataagatgaggttagagaaagagataagagccgggttatatcaggtcttacaggctacaggaaaaaatgtagattgttttttaagaggcatgattcaattacattttaagaagattattcttgcagctatgttgagattgacatgagaaatctgatgataggttcaagaacaggtactatctaaggttcccttttacctattgaataaatcccaaactccttgaactaggggcaagattctttacagtcttcactactttgttgcagctagccttatatctctggcagatagtgcctagcatggagtaggtactcagtaactgttcaactgtccaacctatttttccagctttatctgcttttcctttcctttacccaaatgaagttcccaagcctactctctgctttactacttccattcctttgcttgtcctgttatactacctctatatcttttttctaatcttgtttctatgggaccacattttagccttttttttttttttgagccagggtctcactccaggctggaaggcagtggcacaatcgcccctcactgcagcctcaacagctgaagcgatcgtcccacctcaacctcccaagtagctaagtagctggtactacaggcgtgcatcaccaccatacccagataatttttgtatttttagtacagataggagtttgccatattgcccaggctggtctcaaactcctaggctcaggtgatccacccacatcagcctcccaaagtgcagggattacaggaatgagccactgtgcccagcctgttacccatcctctgtaagcagtagacttgtctgtcctatccttgtttctctctccaaagtttataaaatagtcttatgtgttgttctaggagcacagcttgggacagtaatttctcttcctctttctggaataatttgctactatatgaattggacttatgtcttctacttttttggtaagtttaaaattttaactaaattataatgtaacaaattcaaaatgtaataatagtagcctaataatgttttaaaaatatatcttccaaatcactgaaccacagttctgaaacacttcctgataacctgtttttcaagttggtatgatttacttgacctatttgagttacgagctgatgttagttttggaatatttctcagtagaaatgactgttgatcctgtacttaaatagtacatttgctatcaaaaaatcactatcttaggtattttgaatttcttctcaagcaaagtaggatgttctcacttggtagttttaatgttttttttttttttttctttttacttagtcccaaggcattttattgctcaatttccttggcagcatgatacacatttttaataaattagattttcacatagacatgtcatgcaagaaatatatctgcaatcaaaatttaaaactcaactaacaaaaacagacacctttggaaatatgtagattgtggaaatgtatcttcaaaaagatttgtctggtagaccctgataggcaaagtcatgtggttaaaagttgttttcttctggctgggtgcagtggctcacacctgtaatcccagcactttgggaggccgaggcgggtggatcacgaggtcaggagttcaagaccagcctggccaacatggtggaaccccatctctactcaaaatacaaaaattagccaggcgtggtggcacgtgcctgtagtcccagctactcaggaggctgagacagtagagttgcttgaacccagcaggcggaggttgcagtgagccgagatcacgtcactgcactccagcctgtgagacagagcaagactctatctcaaaaaaaaaaaaaaaagttgttttcttcaaaatgtataagcaataatacagttatagcaattatcccattaaagaattgagagaaacttgaaattgaatccaaactgaagtcagttttacattgaatttatagttacataattttttcaagacatgtaaaaattgttgttggtgctttctaattttgtgtttttgttttgttttgtttgttatttggtacattctaattttatctaactattatttttctattttaaggtactattggaatattttggtttcttttgtggatctggttagttagtgacacaccacaaaaacacaagagaatttcccattatgaaaaggaatacattctttcatcattaagaaatcaggtatggactttgacacattttaaaaataatgtcagaaactttttttcttcagaattaagatatcagtttttaaaaatatatattcctattgtgcatgctctagacaaagtagaataggcaaatgaaatgaacatccaaagtattgtctggctgggtgcagtggctcacacttgtaatcccagtcctttggggaggtctaggtgggaggatcatttgaggtcaggagactagcctagtcaacatagtgagaccctttctctacaaaacatttaaaatatttaaaaaaaaattttaaatacataaatatgaacaaagtattgtctgaagaatttcagttctttcattttttatagaaagtatagttttataaactataaaaaatatttttaagtcattttaaaaccttttagtgtagtgattatcaaatgagtcttaagtttgttttttccacttgattagtagaaaataaaatgtgttattcatgaaaggattctcattctgaccattagttgttagaaaaccaactagtgtgtttatacagttgtacatcccaaatctgaaaattctaaatccaaaatactctgaaatccaaaagtttttgagaacccacatgatgctcaaaggaaatgctcattggagcatttcagagttcagatttttggattttaagatttaggatgcttggccagcctgatggctcactcctgtaatcccagcactttgggaggctgaggcaggcggatcgcctgaggtcaggagttcgagatcagcccggccaacatgacaaaaccccatctctgctaaaaatacaaaaattagctgggcatggtggcacacacctgtagtcccagctactcgggaggctgagacaggagaattccttgaacccaggaggcagaggttgcagtgagctgagatcgtgccactgcactccagcctgggtgacagagcaagactccatctcgaaaagaaaaacaagatttaggatgcttaattgggaaggtacgtgatacaaatattctaaaatccagaatccaaaacacttctggttccaagcatttcagacaagggatattggacctgtatctatattttaaatgagtgtcattaaagaaagagaacagcacatttattatgatataatattataatatgatatacatctgtttgctcttctagagtaggtctttagaaaaaagtttatatcttattaaaaccagatttcaatcacttaatcgagcacaaaggcaaatcacaaataaaaatctataataattcaatatactaaattctcaaaccatggaaacaaaatgtttgccttttgagtagaataaaagaagaacataaaaacattaggaaagattaaaatatacacagtttgttttcagcattcttgttggcttcaaagtcactttattagtttaagaacataaaatatttaagacttttcctattaaattgtcatgattgatattttattttattttatttatttttttttttagacggagtttcgctctctcacccaggctggagtgtagtggcacaatctcagctcactgcaacctctatctccctggttcaagcaattctcctgcctcagcctcctgagttgctgggattacaggtgcatgccaccactcccagctaattttttgtatttttagtagagacgggatttcaccttattggccaggctggtctcgaactcctggcctcaagcgatcctcccaccttggcctcccaaagtgctgggattacaggcatgaaccactgtgcctagcccaagattgatattttaaatatttatatacaatataaccaggcagtaaaattaaaaacttagtcttggctgggcatggtgatttacgcctgtaatcccagcactttgggaggctaaggcaggcagttttcttgagccctggagttcaagaccagcctggacaacatagcgagaccccatctctaaaaagaaggaaaaatgtactctttaacatttctttttaagttttttattttgctataaatgtctctacaagcagctgaactttaagaattatgacctgtcttgatctttgccaaagattggcaaaaacttagaaacagaagaaatcagcactgtaataaagttttaaccaggtggagagctcatatccaaggttacttgggtctgagtcttcccagcaaaaaaaaaaaaaaaaaaattaatacaagtaaaaaagaaagttttagctgggtatggtggcacacaagtgcagttccagctcctcaggaagctgaggcaaggggactgcttaagtccagcaggtcaaggttgcagtgaactatgatcagccattgcactccaacctgggcaacagagcaagaccatgtctcaaataaataagttaagttactttgaaagtttagagtcctacctgatgttaattgagttacccacttttttccccttaaggaacaggtaaaaaaaatttaacacattataaacagatgttgccatgtaaaacttgatatgttttgtcattttctcaacattgatgggtaacagcttgctttctccaatatttcatttttatcatgatcttccagaactgataaaacttttgagtttgtttaaattttttaaaaagctttcccttggccaggggtggtggctcgcatctgtaatcccaacacttagggaggccaagatggaaggattgcttgggcccaggaattgagaccagcctgggcaacatgacgagacctcatctctacaaaaaatttaaaaattagccaagcatgaggttatgcacttgtagtcccagctactcggctggctgcagcaggaggattgagtgagcctgggaagtcaacggtatagtaagctgtgtttgtgccactgcactccagcttgggcaacagagcaagaccctgtcttaaaaaaaaaaaaaaaaaaaaaaaaaagctttctctacatcgatatgtgtcttaatctctccaaacttaggttgtttctcgacacacttcggaaaaaggaatattcagaggcaagagagttaggaggagaagcccagattgcattcctttttttttttttttttttttttgagtctagctcagtgcccaggctggagtacagtggcaccatcacagctcagtgcagcctcaaccctacaggttcaagcagtcttcccacctcagcctctcgagtagctgggactacaggtgcacaccaccatgcctagctaattattttttgtagagacggagtctcgctatgatgatcaagctggtctcaaactgctgggcttaaggagtcttcctgcctaagactcccaaaatgctgggattacaggcatgagtcaccttgtacaaccagactgcattcttaaagcacatgacgttatagttgacagtgttgtaaaatgatgtgttacgtgaagctgcatctttaaatcttggacccaagaaatgtgcagcatctactcattcattctttaaacatttttttttgaaactttactatgacctaggttctttgtcagctgaggacttaaaaatgaataagaggaaaaaaataaaacatggttcctgtggggcccaaggtctccagagggagacagacatggatggacagaatttcaatacaatatagcctgcataatgcagtgctgtaaggtacaggacatctttggaacagagaaggtggcagtcctcagccagcctggggcagacaggaaaagcttccttgtgtcagtgccttttggccaaaggaacacacttgtagttgaacaagttgggtttcttggttcgttgcagtgaggaagaaagcacaccatgaagaaccatggggcatcttagtgcagagttgagaggaacttgttgcagtttagacttgcagtaggtgactttgggaagggtttaaagaatcaatattttgctctggatttgataattctatgatgaatttttatctagaaggtggggtaaagctgtgattagtaagggcacagcagtcactcatattagctgggagaggaagatgtttcgcattttttgtagtttatggcatttgtgtttttgtctgtgctcagacatgactgtggagtggttttttttctttttcttcttctttttagagacagggtctcgctctgtctcccggactgtcatgcagtggggtgatctcagctcactgtaaagtggtcttatttttgtcttgctccagcatgctcatagagtggcctggtttcggttcaacaggacaaccccaggcctagatgttagaaccaggacagtttagcttaccgcagcccaggactgctttttttctttttttttttttttcttttgagacagagttttgctctttttgcccaggctgaagtacaatggcacgatctcagctcactgcaacatccgcctcccagtttcaagtgactctcctgcctcagcctcccgagtagccgggataacaggtgtgcaccaccacacccagctaattttgtatttttagtagaaacggggtttctccacgttggtcaggctggtctcgaactcccaacctcaggtgatccgcccgccttcatctcccgaagtgcttgtattacaggtgggagccaccacacccggcctgactgctttttttctttctcactttcctgagagaaagagtgatatcttctagagagagagtgacaccttctaggaaatgtggctgttgggtgttgctctcgtgcataaggtaaaggcaaaaaacagcaggaggaggaacagctggaagtcaggtcacagagggtcctctgtgcctccctaaggagcttagcctttatcctttaggcactgggatgccatgaagtatttgtaagctcgaagtgacagaatcagatttgcattgtagatagcttatgctggcagtcatgtcgaaggagatctgagctggacaagcaagagttgcagttcgaatgttttctcagttatccaaccaagaaaaagtcagtacttataggtagaaatgtgatttcattcttacaataagtggattttacaattatgatagcatatatagttctaattctgattcagaaatttctacaagaagagaaataggctgggtacggtggctcacacctgtaatcccagcactttgggaggccaaggcaggcggatcatgaggtcaggagtttgagaccagcctggccaatatggcaaagctccatctctagtaaaaatacaaaaattagccaggcgtcgtagcgtgtgcctgtagtcccagctactcgagaggctgaggcagaagaatcacttgaacctgggaggcggaggttacagtgagccaagatcataccactgcactccagcctgggcgacagagcaagactctatctcaaaaaaaaaaaaaatagagaaataaaaatcttcattgcacgctgcagttaaattcagaaggaccatctcatgactagcgagtgctttaagatcatcagctactcctctatgttgaagatctccttttaatgaattatggaaagacattaccacttcacccattgaagtgttctttcctatatatctgctatttttgttcttcttcttttctttcttcttgtttttttgagacggagtttcgctcttgttctcttgttgcccaggctggagtgcaatggtgcgatcctggctcactgcaacctccgcctcctgggttctagtgattctcctgcctcagcctcccaagtagctgggattacaggcatgcaccaccacgcccagctaatttttttgtatttttagtggagacagggtttctgcatgttggtcaggctggtctcaaactcccaacctcaggtgatctaccagcttcggcctcccaaagtgctgggattacaagcgtgagccaccacacccggcttcttcttcttttcttaattccaaggatatcatggggttttcttgtttggttggttctgggtttgttttttgtttttgtttgtgtgttgttttgttttttgacacaaagtctggttctgttgcctaggctggagtgcagtagcatgatcttggctcactgcagcctccctctgcctcccgggttcaagccatcctcccacctcagcctaccaagtagttgggacgacaggtgtgtaccacaaagcctggctaatttttgtattttttgtagagacagggttttgccatgttgcccaggctggtcttgaacttgtgaactcaagtgatctgcctgcctcagcctccaaagtgctgggattacaggcatgagccaccatgcccagcctgaagatagcatgttttgtaactgttttacttctcctttatgccttttaggaagagtatacaattttgcagcattgcgaagcaaatcaaatggggaccttggtttgaatatttagttgtcaaattaagacagaaattaagagcattttttacatgtaactttgctaaatcaatttgctgttacttgcatttgacaagaaaaattttttttaaatggcatattagaatatattcaagtatttgtcgagtgatcttaccctctatatttcacacatttcatgacaaataatttttatagtttgtccttttctgtttcaacttatatggaaaaaaagttgattgagctattattagaaattcgatgatacattctgaatacaagattcaggatctcattgatttttccttcacaaattccattatcatttaaatctccaaagtatatttgctttcaaaatgttggctgagcaaatgatctgagcaattttaaatttttttgcctgtatgtattttcctttttggggggtgggggtggggaggacagagtctccctctgttccccaagctggagagcagtggcactatctcagctcattgcaacctctgcttcccgggttcaagcgattctcatgcctcagcctcccgagtagctgggattacatgcacgcatcaccattcccggctaattgtttatatttttagtagagccagggtttcactgtgttggccaagttggtctcgaactcctggcctcaagtgatccgcctgccttggcctccaaagtgctgggattacaggtgtgagccaccacgcccagccacgcatatgtattttcttttatcagcagtggtattttagaataatgtagccctctaataggaactttcaggaccaggtgcagtgacttatgcctgtaatccgatcactttgggaggcctaggtggaaggatcacttgaacccaggggttagagacctgcctgggcaacatagggagaccccatttctacaaaaaatttaaaaattacccggtgtggtggcacatgcctgtagtctcagctactcaggaggctgaggtgagaggatcactagagcccaggaggttgaggttgcagtagccgtgatcgcgcctctgcactccagcctgtgcgacagagcgaaaccctgtctcaaaaaaaaaaaaaaaagtggcaggcacagtggctcacgcctgtaatcccagcacttttgaggcaggtggatcgcctgaggttaggagttctagacaagcctggccaacgtggtgaaaccctgtctctactaaaaatacaaaaattagccgggtgtggtagcaggtgcctataatcccagcttctcaggaggctgagtcaggagaattgctcgaacctgggaggcagaggctgcagtgagttgagatcgtgccactgcactccagcctgggcaacagagtgagattccttctcaaaaaaaaaaaaaaatgctttcataatttttaattttttgccaacaattagatatgatgaagccatcgagagtatgtgtttacattgcttgattggcaagatagtagtgtgttagaaacaatagcaagagaataatttctagatccagaacatcaaaaaaagctgttttgtaccttcttaagcccaaccttgtgttgtccagtatggtagccactagctccacgtggctgttatatttttaatttaactaatttaattaaaaatttagttttggccaggcacggtcgctcacacctgtaatcccagtactttgggaggctgaggcacgcagatcacgaggtcaacagatcgagaccatcctggccaacatggtgaaatcccatctctactaaaaatacaaaaattagccaggcatagtggcacgcgcctgtagtcccagctactcaggaagctgaggcaagagaatcacttgaacctgggaggtggaggttgcagtgagccgagatcacgacactgcactccagcctggcgacagagcgagactccgtctcaagaaaaaaaaaaaaattagttctggccaggcgtggtggctcacgcctgtaatcccagcactttgggaggccaaagtgagtggatcacctgaggtcacgagttcaagaccagcctggtcaacttagtgaaacccccatctctaccaaaatacaaaaattagccaggcatgacagtgagtgcttataatcccagctactcgggaggctgaggtgggagaatcacttgaacccaggaggcggaggttgtagtgagccgagatcgctccactgaactccagcctgggcaacagagcaagactccatctaaaaataaaaaaatttagttattcagtcacacatatgtcacacatatgacaagggttttgtttcacttcattttctttcatcaacctgttagaaggacaagatttaataaccacatgtaactactggttaccctgtggacaatgtgcatataaaacatttccatcatcatggaaagttctactggacagcactaccttaaactcttgaaggatttttttataaatgtctgctagatacgcggatagtttctcctagtaacatttgaaaattcatctttaacttgaaagtttttataaatgaagactttccccctgaaatataacttgtaatgtggaaatactataagttgatcttacaattcatattgggagaacagaaaactgttgtgttgtacctagattacaaatgaacactaagctggaatacatacatttcacattcttctttctaagcctctaaccctgtgagccttgtattcgtttgataagcagctattgagaacctgccatgtgaagggcttatgtgttagacatacagctcatcttggttgggtgattgttcaaaaacatcagattatcaaaaactcaattgatatttataggttgtgaaaacataccagtgtgactaaaattaaatatttcttatttcaggttatgtttccaagaggtagggtacattcttcagaatacattcagttttcagagatcaaatacatttacacttgtacctttcagcataaaagaatgatttcacttcctttgtggatttcaaagccatataaaaagagctatgttccaaattccttcaaactctaaaatcctctctgccctgagcttttcaatcaagaaggataagggcagactttttaaaatctgatctctacagcagtgggtcccaaacttgctgcacattgaaatcacccagggatcttcaaaaactagggatacttacctcccacccacccacaacctattcaattggtctgtggtgtgaccttggtctcagtgtttttaaggctcccctgggtgattcttatatgcagcaaagtttgggaacccactgctctatagaatcaccagtgaagccttttaaaacttagattccttggccctacactcagagtttttttgccttacttgtttttgttttgtttattcaataggcagagagtagaacacaggcccctataattgtaaagtatagctggagttgaaaaccactgctgtaaaagaatcaatgttctctctccttctctttccctatatctgtacatctttgatcatattaaaaaatacaaccaagcgcaatggctcactggctcacgcttgtaatcccagcactttgggagaccgaggctagcggatcacctgaggtcaagagttcaccaccagcctggccaatatggtgaaaccccatctctactaaaaatacaaaaatcagccaggggtggtggcgggtgcctataatcccagctactcgggaggctgaggcaggagaatcgtttgaacctcagaggcagaggttgcagtgagccaagatcgcgccactgcactccatcctggacaacagagcaagactccatctcataaataaataataattttttaaaatttgtaattaaaaaacacaagagcatatctacaaagatgtcaagtaaaaagtccatatgaaaaaggccagaagaaggttgggcaatactggttcttcctctttttaaaataacagcaactgtgaactctgaaggcagaaacatagattgctcttgcttttgagaaaaacaacagtcttagcgtatagaaaatataaaaatctgatgccctaaatatcagtggtatccaagctttcttgatcatgcaagaatcaataaacaggtgggaggctcacaatctgaatgtatatatatatattgttttcttttgagacagagtgttgctctgtcgccaagctggagtgcagtgatgtgatcttagctcactgcaacctccgctccctgagttcaagcgattctcctgcctcagcctcccaagtagctgggactacaggtcgcgccaccacatccagctaatttttgtatttttagtagagacggggtttcaccatgttggccaggatggtcttgatctcttgacctcatgatccgcctgcctcggcctcccaaagtgctgggattactggcatgagccaccacgcctggccgtatatttattcttaagttatctatatgtactatgatacttatgtatatcataaaatatatacagaaatagactttttaaaggattgatagatgaaataaacagaatatacataaaatttacatcttaatagaaaaaaacttctttgctataacttaaaaattacaaataatttgttgtttttattttttgagacagagtctcgctctgtcgcccaggcgggagtgcagtagcgtgatctcagctctctgcaacctccacctcccgggttcaagcaattctcatgcctcagactcttaaccagctggaattactgctgcgcaccaccacacccggctaatttttgtatttttagtagagacagggtttcaccatgttgcccaggttggtctcgaactgttggcctccagttatctgcccgcctcggcctcccaaagtgctggaattacaggtgtgagccaccatgcccagccataatttgttgatataataatatttaaagggagcaatgtgtttgactatgttatagttaatgatctgccattattttgcttggcgaagtagttgacaaaggactcatcaagaaaagtggcagctcagccgggtacggtggctcacgcctgtaatcccagcactttgggaggctgaggcggacagatcacgaggtcaggagatcgagaccatcctggctaacacggtgaaactctgtctctactaaaaatacaaaacatttgccagacatggtggcacgtgcctgtgattccagctactcaggaggctgaggcaggagaatcacttgaacctgggagagagaagttgcagtgagccgaaatcgcgccactgcaatccagcctgagcaacagagcgagactccatctcaaaaataaataaataaataaataaataaataaataaataaataaataaataaaaataaaagacacttaaaataaatcacttacgctgggggcagtggctcacacctgtaatcccagaactttgggaggctgaggcaggcagatcacttcaggtcaggagttcgaaaccagcctggccaacatgatgaaaccccgcctttactaaaatacaaaaattagccagatgtggtggtgcacacctgtaatcccagctacttggggggctgaggccggagattgcttgaacccgggaggcagaggttgcagtgagctgagattgcaccactgcactccagcctgggcaatagagcaagactccatctcaaaaaaaaatacataggccaggtgcagtggctcacgcctgtaatcccaacactttgggaggccaaggcaggtggatcacctgaggtcaggagttcgagaccagcctgggcaacatagtgaaaccttgtctctactgaaaatacaaaaattagtcaggcatggtggtgcatgcccatagtcccagctactcgtgaggctgaggcaggagaatccgacttgaagtggggaggcagaagttgcagtgagccgagatcatgccactgcactccagcctgggtgacagagcaagactctcttaaaataaaataaaatagtacttaaactgcaatatgctataatactctgagggcaaacaaacaagtgaggatgccattattaacctctctgaattgggggactcatacgatttgtaatcacctgacatactccagggccaacatatttattaaatattaatagagtgtgtttttttatttttataataaaaatgagtaaaaatggaaataaatagaaatatgtctttcctcaccccaacagatcatcttgcatacccctatggtgcttttaccctgctttaaagaccactactgcatatggctgcatacagaaaccttgtattgcctaatttttataaatcatttcaattgaataaagattggataattaaacatgaattctaacaggaccttccaatctctttcctttatccttatgtcaacctctgaatctgaccgtgaaactatattttagaaatagagaattcaggccgggcacggtggctcacgcctgtaatcccagcactttgggtcggatcacttgcagtcaggagttcaagaccagcctaaccaacatggtgaaaccccgtttctactaaaaatgcaaaaattagccaggcctggtggagtatgcctataatcccagctacttgggaggctgaggcaggagaatcacttgaactcaggaggcagaggttgcagtgagccgagattgtgccattgcactccagcctgggcaacaagagtgaaacttgtctcaaaaaagaaaaaaaaaaaaaagaaagaaagaaatagataaatcaatgctgcaggtgacttctgacattcataaagaatgtttagggttgacattatagctctacgaatacatttttactttttcctctaatctgaatcatggactttctagttaatatattttttaaaaaatcaaacaactaaatatttatcatgtattttgctatttaatatttcaaaggagttgatttaaaaatttggagtttactaattaaggtgatattctgtatgaattctggatagagttttagctgatacggtacagatctaagcattaacatagccgtagtttatcctaattattcctgttttcttcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagaggtaagaaaaaataatcatctgcttcttatatatatagtataagaccatacacagaatttgttctcatctgtataaaattcagttattctgtatcttccattttactctgctgtcctaaattttagagattcttatacatcaaaggactattaagaaaatgaaaaacaacccactgaatgggagaaagcatttataaatcaaacatctaataagggtctagtatccagacatattaagaattcttacaattcaataataaaaagacaactcagtttttaaaatgggcaaaggacttgaatacgaatacacatttctccaaagatacacagatggccaataagcacatgtaaggatgcccgacatcaggccgggtgtagtggctcacgcctgcaatcctaccactttgggaggtcgaggcaggtggatcacttgaggccaggcatttgagaccagaccgggcaacatggtgaaaccctgtctctgttaaaaatacaaaaaaggccaggcgcggtcgctcacgcctataatcccagcactttgggaggccaaggcaggcggatcacctgaggtcaggagtttgagaccagcctgacaaatatggagaaacctcatctctactaaaaatacaaaattaaccaggcgtggtagtgcatgcctgtaatcccagctactcgagaggttgaggcaggagaattgcttgaacccgggaagcggaaattgtggtgacccaggatcaagccattgcactccagcctgggcaacaagagtgaaactccatctcaaaaaataataataataataataataataataaataatcccagcactttgggaggctgaggcagaaggactgcttgagcccaggagttcgataatacagattggataatacagcaaaaccgtctctactaaaaacacacaaaaaaattaaccgggcatggtggcctacacctgtaatcccagctactagggaggctgaggcacgagaatctcttgaacccaggaggcgaaggttgcagtgagctgaggtcatgcccctgcactccagcctgggcagcagaacaagactctgtcccaggaaaaaaaaaaaaaatgctaacaaggctgactgcacaactgcactggctacatggacttacctgctttaaaaactattaaagtgaatcctcagtcactcacattccaaagtataccataaacattggcctggctatgtggaccaaaccttaaaacttcaggcagctaagctgtgaagaactcctctgtctacttctgaaaaacaagatcactatatagaaatatttccacaaattgcactgacagaagttaaattgaaactaggctttggcaacataatgggatggattcattgtgagcaatcttatttttcccaagttctctgttaacagagcctgattataatctactactacatttcaactataaagtggggctgatttttaaaaaagaaagaaataaataatatactactacagtgattaattgcattcaactgtgcattgaaaggttaatttggtaattatcatttggggtaaaactgagatccacaggaagattaaaaatagcaaatccagccgggcccagtggttcacacctgtaataccagcactttgggaggccgaggtgggtggatcacttgaggtcaggagttcaaggccagcctggccaacatgtgaaaccccatctctactaaaaatataaaaattagccaggcatggtagcaggcacttgtagtcctagctactcgagaggctgaagcaggagaatcactggaacccaggaggcagaggttgcagtgagctgaggccatgccattgcactccagcctgggcaacagagcaagactccatctcaaaaaaaaaaaaaaaaaaacaaattctcaaaatcatattaacaaaatatcttattttacttataaagtatatttaaagattactacactgatgtttctatttgagattttccaggaagaactatatatggaagaaataaaatatcaatagctggccagtaattaatgttgtgtactttaaaacaaggatcttttatcttgcattttcatagacaaaaaggtttatcttaattaaaattaaaagaaatgtgaatataggaccttctttcattctgtaaaataaaaagaaatgtgaatagagtttgaaaataattctataattatatagcctattttttaattgattttttttcttgaaaatcaatgtgttacattcatgaaatggcctaggtgtttttgtttttgttttttttaaatagtagagatggggtttcccattattgtccaggttggtttcatactcctgagctcaaatgatcctcctgcctcagcctcccaaagtgttgggattacaggcatgaaccaccctgcctggccatcagatggcctttgttcaaaataagcttgctttgagaagcgtggcatgcctccttttattgcactttgctttattatactctgcaaatattgtattttttatgaattgaagatttgtgctaaccctgcatggagcaaatccgttagcaccatttttccaacagcatgtgctcacttcagggctcttgatctttgaagttagtgttgtaattgttggggggcaccataatccttccccatataagatggcaaacttaataaatgttgagtgtcttctgacggctctgccaaccagccactaccccatctctttccttctccttgagcttccctattccctgagacacaacaatattgaaattaggctggttaataaccctacagtggccgggcgcagtggctcacgcacctagcactttgggaagccgaggcgggcggattgcctgtgctcaagagttcgagaccagcctgagcaacacggtgaaatcccatctctactaaaatacaaaagaagttagccaggcatggcagctcgtgcctgtaatcccagcacctcgggagactgaggcaggagaattccttgaacctgggaggcagaagttgcagtgagccaagatcacaccactgcactccagcctgggtgacagagcaagactccgtctgtacagaaaaacaaaataaataaccctacgatggcctgcaagtattcaagtgaaagcaagagtcacatatctctcattttttaaaatcttttatctaaaatgtgtttattgagatggttttccactcatcttgattcagagtgctcttagtgctgcttcctcctgaaggaacatccttccataagccttgcttttcctcctgtaggctggcagaggacagtagagcacccaacacacaaaactactgtttgtgcatgagtaaagaccgtgatgattttatagcgtcctgggcacttcacatccatgaagtaggaattagtgctctgcaccaggcatttcttcttgtgtttcctcttctcctcttctggagagggatgaaggaaattttttgcaagaggtgtgttctcgtcggtaggtcgtcacaaccagaaactcattttattttattttattttatttcattttattttattttaagactgagtcttgctctgttgcccaggctagagttcagtggtacgacctcagctcactgcaacctccacctcccaggttcaagcgattctcctctgtcagcctcccaagtacctgagatttcaggtgtgtgccaccacacctggctaaattttttatttttgtagagacagggttttaccatgttggccaggctggtctcaaactcctgacctcaagtgatccctttgccttggcctcccaaagggctgggattacagacgtgagccaatgcgcctgcaaaaaaattggaatcaatttttttaaataaatgaatacaagggatcttatccttgaagagaaaacttaacaactgtggaaggtgcctgtggaatgtataaatgctgaagactttagtgtatttaggttgttgcccaggctggagcgcagtggcgcaatcttggctcactgcaacctccgcctctcaggttcaagcgattctcctgcctcggcctccctagtagctgggattacaggcatccaccgccacacctaatttttgtattattagtagagatgaggtttcaccatgttcaccaagctggtctcaaactgctgacctcaggtgatctgcctgccttggcctcccaaagtgctgggattacaggcatgagccaccgtgcctagccggcagtttttagcattgcaacttgaagtggcaatattactaactgtgaggaattatcaaccttatcccaccaggaaacaaaatcaagatcagaaaattcacttatctgatttactacagcttattcttttttactttcctactaatattttgaaaccatttattcttatacaggattttgccacaaataatgatagatgtgatcccaccgtgcagaagtctaaatggaattgtgtttttttttcttttttttgttttttttctttctgagacagagtcttgctctgtcacccacgctggactgactgcaccagagcaatcttggttcactgcaacctccacctcccaggttcaagcgattcttctgcctcagcctcccaagtaactgggattacagtcatgtatcatgatgcccagctaattttttgtatttttagtagatacagggttttgccatgttgaccaggctggtcttgagccccgtcctcaagtgattcttcctccgcggcctcccaaagtgctgggattacatgcatgagccactgtgcccagccaagctttttttgtttgtttgtttaagggaagtagaataggcaatgcttgatgattggacgcgaaatatgagggaaaagaaaccatcaggaaagactctcagaggccaggcgcggtggctcatccctgtaatcccagcactttgggaggctgaggcggccagatcacttgaagtcaggagttcgagattagcctggccaacatggcaaaactccgtctctactaaaaatacaaattagccgggcgtggtgacacacgcctgcaatcgtagctactcaggaggctgaggcaggagaattgctggaacccagaaggtggaggttgcaatgagccgagatcacgccactgcactccagcctaggcaacagagcaagactctgtctcaaaagaaaaaaaaaaaaaagactctccagttctgttaaaaataagctgtgtgtgtgtgtgtgtgtgtgtgtgtgtgtgtgtgtgtgtgtgtagtaaataaacatgtaatgcacttttgagttatggttttactgggcaccgataaattttaagaaatacataaattgtaagaaaaaaatgaatggaagggaacttacagatttaaagagacataaaaggcaaatcaaaaaaattttaatggccaagactaaatcgaagtgtctagggatgtacatttgggtgatgtaactataaataaaagtgagtacatgattactatacaccaaaacgaggttaatgcttatttaaggggggaggaagagggctgtgataggactaggaccatgaagtgtcttctggcgaggctggcaaagttctatttcttgacctagatggtcattagaaagactcatgaggccgggtgcggtggctcacgcctgtaatcccagtacttggggaggccaaggcgggtggatcacaaggtcagaagttcaagaccagcctggccaagacggtgaaactccgtctctaataaaaatacaaaaattagccaggtgtggtagcaggcacctgtaaccccagctactcgggaggctgaggcaggagaatcacttgaacccaggaggcagaggttgcagtgagtcgagatcacacccctgtactccagcctgagtgacagagtaagactccatctcaaaaaaaaaaaaaaaaaaaaaaagaatgattcattaagctatgtttatgtggttttctgcatctgcattttattttatagtaaaaaaaattttttttaaataaatgagtgagaatggaagatgaaaatgttcagtagggagaatccataggctaacaggaaggtttgtcttctctcacaacccagatcccagagaaacagtcaagattacccgaagcagacagaactagggcaaggcttatttccctctgagacagactcttagggactgccttggactgaaccctataatccttctgacagccagacttatttactgtaattatattaaaaaattaacaacatattgctatgcatttcctttgctttcgagtggtggtcattggctgtgatgaatgtgtatgttttgtttttttctctcaccgtaattaatcctgtatcttcttattccttccagaatgggtttttatcttcattgccttatttaggctcttggttatgtatgatcctgtctggtcaagctgctgacaatttaagggcaaaatggaatttttcaactttatgtgttcgcagaatttttagccttataggtaagtgaagcaatcaggttttgttttggtttacagttatttaccatgtttacagttataggagataggaaaacaaagtgtgtttcccacttttacacacagttaacacaatactcaacacagaacacctcgctctgatcaccaaaatgtttgtggggatttctgcctacacataaccagttctgcagcggacaccagctaggtatcctgtaattcagttctgacactgtccagctggcggtagcatcagatcctataggttgagggctcagttccacaagatcgcccccctacttcggataccaatcacaagtcccagcttgtgacctctgcttctgactgaccggctataaatcagggttcccatgactgtcttgtcaggttcagttaatctgctagagcatctcagagaactcagagaaacactttattttatgtttacccacttattataaagggtattgcaaaggatatagatgaacagccagatggaaaagctgcatagggcaacatatgtgggaccgggtagggagttttcatgccctctcctggaacaccaccctccaagaaccccgaccgcaaaagttcatccaaaccctgtccctttgagtttgtatggagacttcgttaaatgggtatgattgattaaatcactggccattggtgactggctcaaccttcagcccctctcccctctctggagtttgggggtggtgccaaaagtcccagacctctaatccagccaccatcctgaagctgtatggggacccccagccaccaattgtctcattagcatacaaaagacactgttaccactccagaaattccaaaagttttaggagctgtgtgccaaaaaactgggggcagagaccaaatatatatttcttttttaaaacaattttttaatagaaatggggtcttgctatgttgccctgtctggtcttgaattcctggcctcaagtgatcttcctgcctcagcatcccaaaatgttgggattacagacatgagccaccacactggccatatttcttttcttattttttttcttgagacaggggctcactcttagcccaggctggagtgtggtggcatgatcttgactcactgcagcctcaacctcctcagcctcaggtgatcctcccacctcagcctcctgagtagctaggactacaggcacacaccaccatacccagctaattttttaatttttactgaagacggggtttcaccacgttgtccaggctggtctttaactcctgaactcaagtcatctgcccgccttggcctcccaaagtgctgggactacaggagtgaggcaccacacccagccccagccattttgtttaatttctttctttaatgggacaaggtctcgctttattgcccacattggccttgaactcctggccttaagcaattctgctgcttcagcctcccaaagtgctaggattacaggtgtgagccaccacacccagcccccagccatattttttaaaatcacaatatcacaacagttcaagacaaaataaaaatgataatattagtcttttattttgttcacataacaaaacactatgatgcatttaagtgcatttctttacaatatgtttctttttgaatcatacattttgaggattaagatttataatattcactgggcgcagtggcttatgcctgtaatcctagcactttgggaggctgaggtgagcagatcacaaggtcaggagttcgagaccagtctgaccaacatggtgaaaccctgtctactaaaaatacaaaaattagctgggcgtggtggcaagtgcctgtaatcccagctacctgggaggctgaagcaggagaattgcttgaacccaggaggcagaggttgcagtgagctgaaatcgcgccactgcactccagcctgggcaacagagtgagatcctgtctcaaaaaaaaaaaaatttataaaagatttatctccaccatggcttataattatttttaaaatggcttgctgtgccaaacatcatccctcacaattttatatatcactgtgctttcagctcagactttgcaatgaagatttttatatcaactttagacaagatgtaatcaaagtatttttaagcctccatcccttttctaagtgaatgcattttaagtttcaatccaaaaatatttactagcattattatatcaaataaggagctataaatcaaagaactcaaagaacccataaataatcatgtgtttcagactctgctttcagaaaggtaatttttttttttgagacagggtcttgctccgttggccaagatggacaaccatggctcactgcagcctcaaccttctaggctcaagtaattctcccacctcagtctcctgagcagctgggactacaggtcacgccacagcacccagctaattatttttgattttttgtagagacatggttttaccatgttgctcaggttagtcacaaattcctgggctcaagcgatcctcccacctcagcctttcaaagtgctggaattacaggcatgagccactgtgcctggcctagaaaggtaacttttaaaactatctaatcagttaggcatgatggtatgtatctgtagtcccagctactccagaggctaaggtgagaaaatctcttgagcctagttgtttgaggctgcagagagctatgatcacaacactgcactccaacctaggcaacagagcaataccctatctctaaaaatagttagaaaaaaatgtacataaaaataaaactgtctaagacaatcatttaactttttaaaagtctccagtagagaccctggaagtctcagtgactatacttcagtaattacattataaaaagaccctggctgggctcagtggctgttgcctgtaatcccagcactttgggaggcagaggcggaggcaggcagatacttgaggtcaggagctcaaaaccaggctggccaacatggtgaaaccccatctctaatacaaagattagcttggcgtggtggtgtgtggctgtcccagctattcaggaggccgaggcaggagaattgcttgaacctaggaggcagaggttgcagtgagccaagatttcgccactgcactccagtctgggcaaaaagagtgaaaaaaaaaaaaattagccaggcatggtggcacatgcctttaatcccagctactcaggaggctgaggcacaagacttgcttacacctgggaggcagaggttgcagtgagctcagattgtgccactgcactccagcctgggtaacagaatgagaccctatttcaaaataaataaataaaagtaatgaaattaaattaaatcagacatggtggtgtgcacctgtagtcccagctactcaggaagccaaggcagaggatcacttgagcctgggaagtcaaggctgcagtgagccatgatcgcaccactgcactccagcctgacgacagtgagaccctgtctcaaaaaaacaagaaaataaataaataagtaaataaatgtaattgaccttttttaaagttcctcagttgcagtatatacaaatacaacatttccatcatcacagagagctattggatagcactgctgtagacacagaaaaactgacagcccactcattaagtctcttctcatattttacgcttaactgcctgtaatgaccaatgtgtattcttatcagttgttaataatagggaggattcctgcatattaggtggggcagaaaaaaaaaaaaccaaggccgggcatggtggctcacacctgtaatcccagcactttgggaggcaaggtgggtggatcgcttgaggtcaggagttcgagaacggcctggccaacatggcgaaaccccatctctactaaaaatacaaaaattagctgggtatggtggcccaggcctgtaattccagctattcaggaggctgaggcaggagaatcacttgaacctaggaggcagaggtggcagtgagcccagatcacgccactgcactccagcctgggtgacagagtgagactccagctcaaaaaaaagagagagagaatgaagacagagattttaaaaaatctttttaagaaacaaggtcttgctctgacaacccaggctggagtgcagtggtgccatcatagctcactgtaaccttgaacttctgggctcaagcaatcctcccacctcagcctcctgagcagccaggactacaggtgtgcaccaccatgcctggcgaattttgtttttaatatttcgtagagacagggtcttgctgtgttgcccaggctggcctcaaactcctggcctcaagtgattctcccgcctcagcctcctaacgtgctgggattacaggtgtgagctgccacacccaggcaagatggagtattattctaacctcatccaacagagtttattattcagtttatctcctttggttatatgtattttaaaccacattctgtgtcagctattgcttctctctagaaacatatttttaagttgttcttgtcttgttcttctctaacaccatggaattttagctgagttttggccacatgtagatttaataacattgcataatgagattttccttttatagtatattagttgtattacgcccatgttttccagcatttttttttctcatgaaatttgttagtcttcctggcaatatagtgtttctacagtaggtggcagcaatttcaaatttcagatttataccatattaaggtagagcaaatattaatgctgggtgttttttcccttttataactttttaactccaggaatgattggacctgcagtattcctggtagctgctggcttcattggctgtgattattctttggccgttgctttcctaactatatcaacaacactgggaggcttttgctcttctggatttagcatcaaccatctggatattgctccttcgtgagtactaatataaagatttgctgtgattgactttaaattatatttttaaaaatcctgataaaaggccagaggcggtgactcacacctgtaatcccagcactttgggaggccaaggcaggcagataacctgaggtcaggagtttgagaccagcctggccaacatggcgaagccctatctctactaaaaatacaaaaattagccaggcatgatggcgggcacctgtaatcccagctacttaggaggctgaggcaggagaatcgcttgaacccaggaggcagaggttgcagtgagctgagatcgcatcattgcacttcagcctgggcaacaagagcaagactccatctaaaaaaaaaaaaacctgataaaatagatatgatataaaacttaccattttaagtatgcagttctgtggcattaagtattcacattgtttcataactagcaccaccaacaatctctagagcaatttcatcttctcaacagaaactgtacccgttaaacacaatctcccatttctccttcctcccaggccctggcaaccaacattctactttctgcctctatggatttgactactataggaatgactttaaattcttaacaggattttaatttacacaataattaaagcaggaagttgtttttaaatttaaacttttaactatcatcacctctgtccacagtgctctcattagaacattgcaataactcattactgtgtctgttcacccaactagactaggaactctgtgaaggcagaaactcccttattgtcctcagggctctccatggcacttggcatgtagtaggcattttgtcagatgaatgaatgtgaaagagtagacccaattgatttgtctaactatattacctatgtgcaaatatatttgtgtagcccttgatagtttacacatcactttcataaacactatccattttacccttaaagcattcctttgaagtaagtatttttgccctatttgaacgctaaagaaacttaagagaagttaagtgatttatcttgcagcacacagctaatataataaatgatagagccaaaacttgaacctaaaatttttacttttaagcccaaaattctttctacagctacctctctggaaatattctttgagccacatacttctaaaaccattttgtgccagctgacaaggtaaataagggagctatgtaaatattttaacccaaaagttttaatacactttatttgtaaaaataatagatataaatttattttggagaaaagacagatggactcttaccctcttttcactacctcaaaatcttcacacctggactcctacagaatcttctgatttctatgaatcctcagtctcctatctcttcaataaatactctaagataagctgcactctgtcacccaggctagagtgcagtgacgccactgtagttcactgtggccttgaactcctgggatcaagtaatccttcctgctcagcctcctgagtcgctgggactgcaggcatacatcaccatgcctggttaatttttcaaaaaatattttgtagagatggggtctccctatcttgcccagggtggtctcagtctcctggcatcaagtaatcttcccgcctcagccccccgaagtgctaggattacaggcgtgggccacagcacctggccaagacttgaggttttgtcaagcctagggttgacgaatagtcaaagggatatgggaattgagagttttggcaagaaatagttctaggctatgttatcgcttaggatgtttttagttgaagtatagaaattctaatttaaactgggctaaacagcataatctattgattcacttaattgtatccagaaataataggcttcaggcaagagttgatatccagctgcctactaatatcaccacagattgtttctttctcactctctgtcttttacagtagtagttttgtcctaagactgggtctgcttataaaatcacacaatgaaatgattgccagcaacaatcaggactacatgcttcttcattcacatcaagcagaaagaaaaggatcttttcctctctccaccatggaaataagtcctgggcttcattttggttgacccaaactgagtcacatgaaccaaccccaatggccaagagaatatcatgtgactttaggacaatcagcacctaccccaaaagttagaagtcaaagggtcagtgcccctcagacatcactattgctacacagatgggggtggggagtgggaatggatgctgaggaatccatcggtaacatccattataacacatgaagatgtaaataaacatgagtcattttgagccgggcacggtagttcacgcctgtaatcccaacactttgggaggctgaggcgggtggatcacctgaggtcaggagttcgagatcagcctggccaacatggtgaaaccccatctctactaaaaatacaaaaattagcagggtgtgatggcacacacctgtagtctcagcttctcaggaggctgaggcaggagaatcgcttgaacccgggaggcagaggttgctgtgagccaagattgtgccactgtgctccagcctgggtgacaaagtgagactccatctcaaaaaaaaaaaaaaaaaaattataaggaacataaaattggttcagcagccatccagccagaaggtggtaagtcacccacaccatttaataaatctgaaaggtagcttaggattcatcaggttcctgaagtcttattagaatctctggaatctgatgagggccccccctgctctcttgaactagcaatgaaagaaaattggatcatcggataaaaattggagctatggtcggccgggtgtaatggctcatgcctgtaatcccggcactttgggagaccaaggtgggcagatcacctgaggtcaggagttcaagaccagcctggccaacatggtgaaactctgtctctactaaaaatataaaattagccaggtggggtggtaggacctgtaatcccagctacttggaaggatgaggcagaaaatcacttgaacctgggaggtggaggttgcagtgagcaattgcactctagcctgggtgacaagagtgaaactccatctcaaaaaaaaaaaaaatagtgctattgtcaaaagatgaaaatagatgctgaagaaaaagaaaaccaaatatccatggtacctaccttataagatcgttgtgaagattaaatagaacacgcacagaacactttgctcataatgcaataaaggtatttgcatataatgcaatagatgtaattattttctggctaactttgagtcaggtgtggtgaccagggtcacagatcaatccaagtaaaatattaaagtgatgattggtgtgctttcagaaaggaaaatgctgaccactaaagagccaccattgggtcactaagagccaaaatggcaaaacagtctaacttctcaacataatttttagcctaatagaataaagaaaatatagtagatttgatatgtcaggacttcagccaggcctcctatgatagatgccgttttggacaaggtggagaaagatgaattggatgtacaattagataaatttgtcactactaaatttcagtgtaatagcatgctcattaacggatctagtcatttgagaaacactgtgccaggcactgtaccagatgttgaagacacaaacatgaaagtaacatgattcctgctggcatctgtataagcttaagctggcctggatgatggtgggtcatgtcatgaagtataatgctggacaggcagcagggggatcctgtgcctgagcttcaagcatcaggtgggtggttgaagtctacatcttaaagacccaggtccaaccctgaaattttatgagtcttataagccgaaaaagacatttatctagatatcataagaagctaaacaggtttagtaacataaatgatgccagcaaatagttgtagcagttgggaggatggtaagcaagtgcctttgtgcctcagataatgaggactgctgtactggttctcagctgactgagacacaactattccaaatgtaagtaggcccggtgaggtggctcatgcctgtaatcccagcactttgggaggctgaggcggttggatcgtttgaggttaggagctccagaccagcctgaccaacatggtgaaaccccatctctactaaaaatacaaaaattaaccaggtgtggtggcgggcgactataatcccactgactcaggaggctgaggcatgagaattgcttgaacccaggagttggaggttgcagtgagcagagattgtgctactgcactccagcctgggctgcagagtgagactcagtctcaaaaaattaaataaataaataaataaataaatctcatcaaattcaaaattattattatttgttttttgttttgttttgtttttgagatggagtttcactcttgttgcccaggctggagtgcaatggtgcaatctcagctcaccgcaacctctgcctcttgggttcaagtgattctcctgcctcagcctcccaagtagctgggattacaggcatgtgccaccacaccctgctaattttgtatttttagtagagagggagtttctccatgttggtcatgctggtctcgaactcccgacctcaggtgatccgccagcctcaacctcccaaagtgctaggattacaggcgtgagccaccatgcccagcccaaagtcaaaattatttatctcccttagtgtgtgtgtgtgtgtgtgtgtgtgtgtgtgtgtgtgtttaaaccttgcagttctagctcaaaggataactttcttatattttgattcagctcttcagatgagctttttagtttttcttttccaactggaatttcttcattcaaagcacatcagttatttctagttgcaggagtcttggctacatatcttattggggattacatatcttaggtttttcatagttgctttttgttgtggtaacaactgagggcccattcagtgtaatacgctactagttaaaacagaggcacttgaggaccataaacaagccataaacaagttcaacaccagggcttgtggtgaaaaatgaagcatgagaaaatttatctttcctacagattgggttcagtgattactgtgttttgttttttttaacaaggtagcattgtagattataacattataatattaagtactgattcagaatcagacaaattgggtgacattttatggtttttcttcatctataaaatgaagataatccagctgggtgcagtggctctcgcctgtaatcccaggacttcggaaggccaaggtgggaggatcgtttgggcccagcagttcaagacctgcctgggcaatatagcaagatcgtacctctaaaaaacttaacaaaattttaaaattttaaaaataaaatgaagataatccttcctcatggggttgattttataattaaaatgatataatatgatatataaaacccttataaacatgtctgatatcaggttttccaatacatagtcagtaaacagatacaaggttttccaataaataatattcctattaacatataaatgtgtacttggattttataggcctttacttctatagactgaaatagagattttatgttatcaatgtatttattatcttttgaggcagagtcacaccctgtcgcccaggctggagtacagcagcaagaccacggctcactgcagtcgcaagcaatcctcctgcaatcctccacctcagcctcctgagtagcgagcgggtctacagcctgagccaacacacccagctaattttgtgtgtttttttagtttttgtagagagagggtttcaccatgttgcccaggctagtctcaaactcctgggctcaagcaattctcccacctcagcctcccaaaatgctgggattacaggcatgcaccaccacacccggccccaaaatagagatttttctatggtaattttgttgcccgaattcatgggaattagatagattttcagctattaattccaatagtactccaacagcacagaatccagactgagtccatacaacttgttttcttccaagtggtcatcaatctttcatggcctgtcctggccaagtgaaatataagtacttgaatgagcttcttgttgctgacatttagaatttcatggcattcgtctgcacttaatatctgtcactggaaaggctggcaacattgcagttgactcctcttactgccaaggtgttaatggtttaaaaagaaaaaaaaaaaagagaggctctgccaagcttggttaatttagatacacccctaaaggggatgagccaaaaagatctgtacttcatggttttgttatagtgctgtgtgtatgcacaagttttgaacataaaactttgtgatctttatacataactgaattagttaagcagcactttttttaactgaactcctccttctcctttaagtgttttttttttgttttttgtttttgtttttgttttttaccaaaaacattaaacctaaatctaatgaaccccctaggatctagagtctagaaactatcagtgtacaggaaatacaggaggtataagattatgtgaaatgatacctaagagatacaatcttcaaagtccagaattcatgaatatatacaggacaaacatcctagtaaagggacagcaattttaggccaggcgcagtggctcgctcctgtaatcccagcactatgggaggctggggcaggtggatcacctgaggtcaggagtttgagaccagcctaaccaacgtggtgaaaccccgtttctactaaaaatacaaaattacccaggtatggtggtgcatgcctgtaatcccagctactcaggaggctgaggaaggagaatcacttgaactggggaggtggaagttgtaatgagccaagatcacaccattgcactccagtctgggcaacaagagtgaaactctgtctcaaaaaaaaaaaaaaaaagaggcagcaattttaaaaatgaattatcgggccaggtgcagtggctcacgcctgtaatcccagcaatttggcaatttgggaggctgaggcaggtggatcacctgagatcaggagttcaagaccagcctgacctacatggcatgcgtgtatagtcccagctacttgggaggctgaagcagaagaatcacttgaacctaggaggcggaggttgcaatgagctgagatcgcgccactgtactccagcctgagcgacagagactccgtctcaaaaaaaaaaatgtaattaatggaacaagcaaattttatgtttgatatgatctcacgtctataataacatactagaaatatatacagacagaaaaaaataggatatttatgaaaatgttaatgttgatcatctctatggggaagaattataggtaattttacttcattatttttttcttttttcgtattaattttcaaaaattaattacaattgaattttcaaatcaggaaagaaattttttttaacttaaaaaactttaagctagacatgctaagctttctgtatgaaaatgatatctcagaactttcctatatcactataaaaaggggttatttccatggctgtgttcctgtatgtaatttttttttttttttttttgagacggagtctcgctctgtcggccaggctggagtgcagtggcgcgatctctgctcactgcaagctccgcctcccaggttcacgccattctcctgcctcagcctcccgagtagctgggactagaggcgcctgccatcacggccggctaatttttttgtatttttggtagagacggggtttcaccatgttagccagcatggtctcgatctcctgacctcgtgatccacccgcctcggcctcccaaagtgctgggattacaagcgtgagccaccgcgcccagccttcctctaatgttaatgttttttttgttgttgttgttgttgttaatttttattttttttattgatcattcttgggtgtttctcacagagggggatttggcagggtcataggacaatagtggagggaaggtcggcagataaacaagtgaacaaaggtctctggttttcctaggcagaggaccctgcggcgttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatgtatcttagtacagaacaaaatgaaaagtctcccatgtctacttctttctacacagacacggcaaccatccgatttctcaatcttttccccacctttcccccctttctattccacaaaaccgccattgtcatcccagcccgttctcaatgagctgttgggtacacctcccagacggggtggtggccgggcagaggggctcctcacttcccagtaggggcggccgggcagaggcgcccctcacctcccggacggggcggctggccgggcagggggctgacccccccacctccctcccggacggagcggctggccgggcagaggggctcctcacttctcagtaggggcggctgggcagaggcgcccctcacctcccggacggggcggctggccgggcggggggctgaccaccccacctccctcctggacggggcatctggctgggcggggggctgacccccccccacctccctcccggacggggcggctggccgggcagcagggctcctcacttcccagtaggggcggccgggcagaggctcccctcacctcccggacgggttggctggccgggcggggggctgacccccccacctccctcccggacggggcggctggccaggcggggtgctgacccccccacctccctcccggacggggcggctggccgggcgcggggctgacccccccacctccctcccggacggggcggctgccgggcggagacgctcctcacttcccagacggggtggctgccgggcagaggggctcctcacttctcagacggggcggctgccgggcggaggggctcctcacttctcagacggggcggctgggcagagacgctcctcacctcccagacggggtcggggccaggcagaggcgctcctcacatcccagacggggcggcggggcagaggcgctccccacatctcagacgatgggcggccgggcagagacgctcctcacttcccagatgggatggctgccgggaagaggcgctcctcacttcctagatgggatggcggccgggcagagacgctcctcactttccagactgggcatccaggcagagggtctcctcacttcccagacgatgggcggccaggcagagacgctcctcacttcccagacggggtggcggccgggcctaatgttaatgttaaaatgctacttaactattgaaatgcaagtttttcaccagctgaatataaaatcccattgcaataagacattttatttagacataaaatttcacaagaacacaacctggagcagaatagctgtctattgaaagaagcagccaggcgctgtggctcatacttgaaatcccagcactttgggaggccgaggcaggcagatcacttgaggtcaggagctcgagagcagcctggccaacatggtgagacaccggctctactaaaaatacaaaactagcccagcatgatggtggatgcctgtagtccccgctactcaggaggctaaggcatgcttgaacccgggaggcagaggctgcagtgagctgagatcatcccactgccctcaagcctgggccacagagtgagactctgtctcaaaaaaaaaaaaaaaaagaaggaaagaatgaagctgtttaaatgtgtatcacaataataaacgtctatgaaaatgtttctacaggtatgctggtatcctcctgggcatcacaaatacatttgccactattccaggaatggttgggcccgtcattgctaaaagtctgacccctgatgtaagtagataatttacttgtaaactggaaaggttttggagctgcacatctgtgtcaaagttcagtgtattttaattaagtttaaaattctaaatgttcttatgaaattctttttagcaacaaaaagctaaatgccttaatggatgggaaagtatattttcaaagaacagtttttggattttagacaaaacaattgaactaagtcaaatgaagacactgtagctgaaaccacacaagtagttaaaagttgtgatattggccgggtgcagtggctcatgcctgtaatcccagcactttgggaggccgaggcaggtggatcacgaggtcaggagttcaataccagcctcaccaacatggtgaaaccccgtctctactaaaaatacaaaaattagccggtgtggtggcaggtgcctgtagtcccagctactcaggaggctgaggcacaagaatcgctcaaacccaggaggcggaggttgcagtaagccaacatcaccactgcactccagtctggcaacagagcaagactccgtctcaaaaaaaaaaaaagaatttcaggacatacttacagactttcttattaccaaatatactgatttcagacatatatccgacagatagtgttcctacttcttctccacatctaccatttctaattccttaagtgacacggtacctgttactatttcctctcacttaataaaaaggaatgttgtagaaatgctttttctaaagttctgtgtctcaatatggacatgtccaaaatgtttaaccttgtcctcatggagcagggtggcaacaccagaacctaagtcagctcactaccatgtgttcatttcacttactgataatgccagcacttctgctagggaaatatggattcctgaattacagtcttgtatgtttacaagtgggaactgcgcttgatttgggatatgttacagcatttgtttaatgctattaaaaggatatcactgttttagctgggtgtggtttgtacctgtagtcccagctacttaggaggctgaggcaggtggatgcataagcccagggttttgaggctgcagtgagctatgatcatgcctctgcactccagcctgggtgagagcgggagaccctgtctcaaaaaaataaaataaataaaaaataaaaataaaaaaataaacaaaataaaataagtttcgcactccgttgcccagtctggagtacagtggtgcagtctcagctcactgcaacctctgcctcccaagttcaagcgattctcctgcctcagcctcccaggtagctggaactacaggcactcaccaccatgccctgctaatttttgttttttgtttgtgtgtgtgtgtgttttttggtttttttttttgagacggagtttcgctcttgttgcccaggctggagtacaatggcgcaatctcagctcaccacaacctttgcctcccgggttccggcgattttcctgcctcagcctcccgaatagctgggattacaggcatgtgccaccacgcccagctaattttgtatttttaatagagacggagcttctccatgttggtcaggctggtttggaactcaggtgatccgcccatctcggcctcccaaagtgctgggattacaggagtgagccactgcacccggccaaataaaactctaaagtatattatttttaaaaaggaaaagcacacacttaccttcacaattgtaatttctttcttctttttgagatgaagtctcacttgtcccccaggttggagggcagtggcgtgatctcagctcactgcaacctccgcctcccaggttcaaacaattctcctgcctcagcctcccaagtagctaggactacaggcacgtgccaccacacccggctaatttttgaatttttagtacagatggggtttcaccatgttggccaggctggtctcgaacttctgacctcaaatgatccacccgcctcagcctcccaaagtgctgggatatcaggcatgagccaccgcgcccagcctgtaatttcttactttgagcactgcctcaaaaactttgtggaatgagtcagcatataaataaataatgcaataattaaaattcaaagtgtgtctgaggttcaatgttgttataaacaaaacagtattctctaaaaactggtggaatttttgttaaaaaacaaactaggagctgtgtgagacttgtagtacaacgattgattttaagttcactcattgccttcagataacactgaagtattattttgtcccagagaccacacagggcagctttgtcttagtaatcctaagaagctgtttcaaacatttctttctggtataagatgtaattattgactgattcctcagcagaatttaagatgagtatctaagattttttttcactaaactgcactcatctcagacaagtatagccaccacagggtgtttctttcttcatgtttctccttttttcccaaataaatgacctcatactggcttcccagtgccttctctttcacttcctcattgctagttctactgcttgtttgtttgggttttttgtttgtttgtttgtttctttgttttttgagacagggtctccatcgcccaggctagagtgcagtggtgcaatcatggctcactgcagcctcaacctccccaggctcaggtgatcttcctacctcagccccccaagtagctgggactacagatgtacactaccatgtccagctaattttcctacttcttgtaaagatggggtttcaccaccttgcccaggctggtctcaaactccagggctcaaggtagccacctacctcggcctcccaaagtgctgggattacaggcatgagccgccatgcctggcctgcttggttttttttgttttgttttgttttgtttttgagacggagtctcactctgttgcccaggctggagtgcagtggcacgatcttggctcactgcaaactccgcctcccgggttcacgccattctcctgcctcagcctcccaagtagctgggattacaggtgcccaccaccacgcctggctaattttttgtctttttagtagagacggggtttcaccttgttagccaggacagtctccatctcctgacctcgtgatccgcccaccatggcctcccaaagtgctaggattacaggcgtaagccaccacgcctggcctggtttatttatttatttatttttgagacggagtttcactcttgttccccaggctggagtgcaatggcatgatctcagctcactgcaacctccgcctcccaggttcaagcaattctcctgcctcagcctcccgagtagctgggattacaggagcctgccaccacgcccagctaatttttgtatttttagtagggacagggtctcgccatgttggccaggctggtcttgaactcctgacctcgggtgatccacccacctcagcctcccaaagtgctgggattacaagcatgagccaccacgcccaaccagttttgttttgttttgtttttgagagggagtcttgctctgttgcccaagctggagtgcagtggagcgatctcagcctcactgcaagctccacctcccaggttcacgccattctcctgcctcagcctcccgagtagctgggactacaggcaccagccaccacgcccggctaattttttatttttttagtaaagacggggtttcaccatgttagccaggatggtctcgatctcctgacctcatgatccgcccgcctcggcctcccaaagtgctgggattacaggcgtgatccaccacgcccggccgtgtgtttcttagttaatgctgcaaatgtagtcaccactctggttagactgaaattgaaaaaatccaaaaaatggttgttaaaggtagtcacatgacccagaaatttagataactgtctgatatttttatgccacagggttatacactgaacagttgtcttactgacagatcccatgttatatcctgctttgtatgccattcaagatcttttatacttgccaggcctctctctgatgtcacagatcctcaaagctgaacttgagttcatcttaacagtatttacttgatccacctgacacctttcacctgagaacccaggagaccgtgcacaggcataagactttcttagtgttagttagtgttaggcatgattcagggacatgccagtacactttttattgaagtatatctatctatcttcagtaaactttttattgaagtataactttttttaaatgcacaaatccaggccaggcgtggtggctcacacctgtagtaccatcactgcgggaggctgaggcgagtggatcacttgagcccaggagttcaagaccagcctgggaaacatggcgaaaccccatctctaccaaaaatatatatatatatgtatatgtatatatatacgtatatatatacatatatatacacacacaaagaaaattagccaggcatggtagcatgcacctctaatcccagctccttggaaggctgagttgggaggattgcctcagcccagaaagtggaggctgcagtgagccgagattgcgccactgcactccagcctgagtgacagagtgagactctgtctcaaaaataaaaacaaaaataaataaatgcactaatctaaagtgtgcagctagatgaatttccacaaagttaatacatctgtgtaaccagcacccaatcaagaaacagaatattacctccctcagtaagaccccaggtaccatttcctcctatttttccttcaccctcaccaagtggaaccactctcccaacttttaaccccatagattagtatggtctgactttgggctttatataaatggaataatttagtatgtaccttttttgtctggcttcttttgcttcatattttgtttgtgagctgtatttatgatgttgtagcccattctcattgctgtattgtattacgttgaacaaatataccactatcctactgctggtggacatttgggttgtttcaaggatgaggcttttatgaataatgtggctgttttaacactcttgtgacactatctttttaatgaagtgaactacacacaaaattttatttcacttgcattttttgtcttcctttatagaacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattgatttttggatctgacagttctgtgatgtttcctagtgtccacagtgactctttgacatcttttctgcatcctgctcgagccatcgtcttctctacacacatttctgctaccacaaagccgaggaacttgggcctcctaagggatacagcatcagaaatctctgttgccatcaacctgcccttcctagctctgaatagagtcagtccttcttgctatagcatatgcccacactacactgattctctctctcccacctcctctaaggacttgcttcagtaattctttttttaaataattgagacagggtcttgctttgttgcccaagctgagctcaagcgatcctcctgcctcagcctcccaagtagctggcactacacagcatgtgctatcacgcccagttaggagctcctctttcatttacttcttcagtctctccccttattcttttccttctatctcagagatacacacgtcttctctagtccttaaataaaaatacagaagtctcctggagacattaaatcacaagtgtacagaatatctctaagataatactcaagaaactggaaaacagtgtgtgattttatagatagatatagatacagatatagattttcatccatggttcgaggctcataactcccgtagctcttgttatgttgagcgcctttagcccttagaagtagcctcaggaaacagaatctttctgatcctctcctctcctcctttcacctgctgctttttctcccaaggcaggaatcttcccccacctttctgtcttggaactggtcataaagaaattctgtggctggggaggtggctcacacctgtaatcccagcactttgggaggctgaggcgggcggatcacaaggtcaggagttcgagaccagcctggacaatatggtgaaaccccgtccctactaaaaatacaaaaatgagccaggcgtggtggcgggcgtctgtagtcccagctactcgggaggctgaggcaggagaatcacttaaacccgggaggtgaaggttacagtgagccgagattgcaccactgcactccagc

SEQ ID NO: 13577 - DNA, 9086 bp, Human
  misc_feature (1)...(9086): n = A,T,C or G
ggctgggagagggagaggggaaaagaaggccaaagtttactctacctggaccccactaggtcatcctggacatcaaacacggcttgtcccacccttggggctcagtgagatgaggcttctcctgcctcctctgcctgccttgtatctttttcttacaactagatcagaaggaacagagccatgtcttttgcacctctgtgtccccatgcataccctaccccatgccttgcagatagtaggtactctatgcattttctgtgaatattaaggagtggcccctcacccctctccactaccactgcaaggacagacccagaggaagacaggagccctggaaacatccattagtgggactaaggggaggagcagagggggaaagtgcccagtactcctgccttccagcagagccagcccccagctccccacgccctcctaggagacacctccccaaggtaccctccccaccaaagactgggaggtcaggtgtcaggctaggctctcaggaaggaattcccctcccttcaagcctccagtccaaattcctctcaagggagagccaatgaaaggcaggactcagacaggagagaaagacaccaagcatggggctcctgaaggtcccctcccctctgatgcttgcctgggtgccctgctcagacacaccatcaattccccctcctcccactgtgttccctaccatgggttggaagttatcttaccacagagtggttaagccctggcctttgtagcccaacatctggattcaaatcctagctccttcacatatgagctgtgtggccaagggccagttactccacttctctgaactccctatccccttggtcattaggcctacagactcagaatccaggcctcctggttgtttctgggctctgactctcgaaaaagactatctgggttcaaatcccagctctaatctgtgcttaacctctctgccgcaggatctttatctgtaaggtggggacaataatagtacctacccaccatctagccttattgtgagaattagctgagggagtttatgcaatgtgctcagatcagacttggcacacaattagcacccactaagtattggctatcattagcaatagctgataagcttggaacgtaccttgcaccgcaccttgcaccgcaccttgcaccttgcaccgtccctggcaggtagtaagagctcactaaatagaagctatgattaccttcacccccactagactatcctggccctggaggtgggttctgggtcatatccatctttgattccccagcagccagcatggggcctggcaccaagctcaatgaagacctgccaggaggaccagaagatccagggtgtggggtggcacgagcctcccaccagggagaagaggaaccgaggtgtcggggaagagaaaacagagcagagggagaaaagccaaggcagagagataagcaagtgaagtgagtgagaaaaggaacaggagaggctgtggcggagagagataaggaggaaggatggagaaggcgagggtccgagccaaatgcccagggaggcagggagccctggggagaaacgctgggcgaggccagggctgcggcaggggagccgagccgggagaggggcgcaagacctggcgctgggcgggacgctcgggcagggtgcgggaggggctgagggccgcccccactgcctccccgcttggagcggggccaggcggccggagattggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagccatgcgggcggcggcggcggcggggggcgtgcggtaggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccaggtagcgccgccgccgccgtccccgcgcgctccgacggccctgcagctcccctagcacagctctgcgaaccccccaagaggtgcagctccccccctccgcccacacacacacacacacgctgtcctagctcagcccagcgtccccggaattatcccccgcagccttcccgccttcccacctccccagggagtggcagcatagtgcctcccgtcggctccagaccttccctctggctctcgttccctggaaacccctggcacccctctcagtacccatccaaccaagctgctgagaatcccccaatgccgtccccccaatcctgggacgtcctgataaatgccttatgacccctctcagcccaagaatgcctggggtcgttaaacaatgcctttcacctggatcccgaggcaccaaagcaagcatcatccccactccgtgttgggaccttgggaagagaggagaggtgagggaagggatgtggagaaagactggggactaagaatgttctggactatgatctgcgtccccgttttctgtacctggaaccctaagatctccaccctcttccccagttcccctggctgggagtcattcgggtaaggctcagtgcggaaggaagagcagattaggctctgcccctgaagagaagcccttaggcaagttgcttgacttcactgagcctcagtttccccatccataaaataggaagccatcccaggctcatgaaacctatgaggtcctaagtccctcctcccacccacccctcagtcccctgaaccctaatttctccctggtctcagcctccccttttctgtgctggtccacatagctcttccaggctggctccatgccctctcccccttcctccccgtctgctgtcagacttgagtaggcgcttctgggcctcggttcccttttctccaaaataggagtaagggctgggcgcagtggttcacacttgtaatcccagcactttgggaggccaaggtgggtgaatcacttgaggtcaggagttctagaccagcctggccaacatggtgaaaccccgtctctactgaaaatacaaaaattagccgagcgtggtggcacacgcctgtaatctcagctactcgggaggctgagacagaagaatcgcttaaacctgggaggcagaggttgcagtaagctgagattagagagccactgcactccagcctgggtgacagagcgagactacatctcaaaaataaaataggaataagaatccctatttcataggctgaggatgagaggagataaaatttaaaagacaatgcacatcatggctgcagccgccagggtcatggggcagtcactgtgcccacctggcagttttgtcactgcacagcctgtctggtgattgtcaatcactctgtgagcaggtagtgatatgattgccatcatcccatctcctgataaggaagtagaggcttggcaaggggaagtggctggtcagtgaggaagcctgcaccccaagtggctcttggaactccaatcccctcaccaactgtcccccaaccccaccccactttctctcttcagtgaccaagatctgcgcccagtgtgagatggagcacagtgctgacggcctcatggagcagatgtgctccagtgactttggtgagtgtggggcccacgctgccactgccccgacatcacccccagcccctctttcttgacgcacacgggaacatacatgcccacatccatcacagtgaatcccaacagtttttgcatcatggctcccgtttagaagccaattataaccataaaccctttcccaagagaaatgcacctctttctgcatcatctcaggaccatcacaagtcccctaaggccatgggccttgggcctcagaaaccaccccggccagggctcccacagccctcccttggtgtcattttcagagggccctccatgactggatcatctctgtggatagtgcaggcttagcccagagatggatggagccaggtggggagtgatggctctaggatggaagtggagcacccttgtccatgggtacctccacctgggactcagcacacctcctgccagcggagctgtggtcacctgtccccacagcttcatcccagagccttcccattttctgggacaatccagccaagtccggtcaggacctggctcacacatgggccacgcagtccagtgtgtgatctttgccaagtcagttccctgttttgtgtcttagcctccctgtctataaaaaaagaaaaaaggagatgataatgaagtcctttcttcagaggagtcttttatgttggtagcctgtttggaaagagaatactgctattgcaaggggtgtatgtgtgtgtcagagagagaaagagagggggaaggggacataaagagaaggaacaagattttatgacaatttcctgccaagagtgggcagttattctctgacttctccctggccccacagagatgggggcccagaagcctgaagaagggagagaccagcccgagggactccccaccccaccctgaggcccaggactccttaggctctctacgtccactgtagggtgacctgcaccatggctctctgggcacagaccctgccttcatcctagccccccaaaggaaaggagttagggtctcagtgcctccagccacaccccctgccccactcctaaacatagcacaaacacactcccacccaccgtacaatctctctctcacacacatacacattactgtacagtggtgtgttcacaccagcaacagctgaactgtgtgtatctattcccagctccacacccagtcatgcggtcagttatggtgggagtatttaccccatggatgtcaatgaatgcaaagcagggctccctgtccacagagccggctgttaaatatttgccagcccaccactgttccaaccacactcaccgtgtgtgcatgcacacacatatacacaccccatatatactccataccatacactcacacacagccagaaatcccagtgggaatcatccccagagatcaggaagtccagcttccctccatcacaaggatccccttccaagcagtcggccccagtcccatccactccttatcccctccctggggagccccacatgctgctccatcaagagctctccaccctgcctttggtgtctcagaagggcttggactctcgattcacgcaggtcacaagctctctacccctcatttcccctcttctgtaccttgaggatgaaacgtgatgctgtccttgagagtgcagcatgataagtgcttcataaatatgaaaatgtgccctacgagctccacccttccaagccccgcagggcatcaggctcccccagcccgaaggtccagaacacaccaactctgtgcccaccagcatcccacacagatctgaccattcccaacttgcccctgtcctttcttcccacagtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtgatgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgtggctcgattcccgggattcattcctcagcctctgcttctcccttttatcccaataagttattgctactgctgtgaggccataggtactagacaaccaatacatgcagggttgggttttctaatttttttaactttttaattaaatcaaagaaaacaataactggtttggaccaggtggtttctttgtcagctggttcccaagaggtggggggagagggaggtttagaatggagcttcaaaaagaagcccttatcttaacccatggcctggccacatagacctccttggaatgcctaagaaaagcaaggcctgtgtttttgtagtacatagcaagggtcaccctgtcattctgaccgctaagtgagggatggagatggccgttcttttgtccctgaggaggaatggaggtgccaagttcccagcttctcccacagtcagaagactcccatggtcctgcagcagctccccgaggaggtcagggcctgatcagaggagtccaagaaggtggggccacagggaactatcgtgaaaagcctgaggccgaagacgtgtcactcctccccttcggctttcacacaccgcgggcactgctccttacctgtccctggtccagcagcatgagcatcacctgggagctggttagaaagacagcatctggccgggggtgcggtcgctcatgcccataattccagcagcttgggaggctgaagcgggaggatcccttaagcccaggagttcaagaccagcctgggcaacacagtgagaccctaactcaacaacaacaacaaagaaatgcagacctgctgtatctgaatctgcatttgaacacataaacattagaatcatctagggagcttttatagaatcctgcaccctactctaatgcaattaaatcagaatctctatagggtgttcaggagttggtgtttttagatgctccctggggtgatgtgtagccaggattgagaactactatctagataaggtgacaactgagacagggagagggcaaggggctgagggggtgccccagtgggctcagagcagatgggggctgctgccttgaggtagatggacagggaggggagacagcttgggaggcgagaagccacccccactctaatgggcagactatggacagggcagtgccaggaaggagctccctgggggggtctgtcagcagatgccagatgtacctagagcagggggctaggggcaccccctgaggggctctccccaccggtgggggtaaagctgggatgctgtccagtcaaggcctggtgttcctccaagacaaaggagcctcattctctggaactgaggaaagccttggcttccgctcccagaggtgaacgtcacctcagggaaatgactccagaggggccaggggctgagttcttctgtgggccatgagcgcacattcgcctgaggtctggctagcaggtggtccgacagcgcgcccataaatcaccccgggcaggcaggtggcctcgccgcaggtcaacagctgcacaggccgccttgctcctccctcacccatccgcgcccaaaccctgcccagtgcacctggctccctgaatctgcgccttgtctcccagcctcctaccctgaccaaatgtttacggacacttctgtggtcaaccaggaccagggatgattttccatggcacacacaggactgggtctgccctggctgaagtactacactgacttctgccagatgctggcagctgtggggcagcagggcgaggggaggactcccttagcccatcccgtgaagcccaggaaggcactcctctacccccacaaggggtcagggcccagcttgaaacatctgctgtcccccaacatctgctgtcagactcgccaagaatctcttttctgggaccaagaagaatcttcccaaagaccagggaggtccttccaggcttgagccccacccttcattcccttcagtcacacaagactccctcccgctggctggagacccagcagctgtgctgccccaagagcacctgggtgcagtgaacgatgcggcccccaaccacacataacagaaaccccaggaaccgaaaccccagcttctccacacaagaggggtggaggtggacaggtgggaggtctatgtccaactgccttcctgctctgccatggg

SEQ ID NO: 13578 - DNA, 4438 bp, Human
gctgggggggtcagcggctgctctgcttctcctgtgcacccggggttgctcttcagttctctaacttagtaagttggactggcagcctcttggttgtacaccattttattcttgattcgcttttctgattcaaagtgaacctgagtgccttaatcctctaaggggaattaattgcttgtttcagtgcttaactctgatcctggctcagtccccatggggacaagtttcttcctgttaggatctgtgtgtgttgttcaaaacacaatcagaaaggtaatgaagtttttcttatgacagaagccagaaatgcaggctattttcttttctattgcataagtagtgttctcaaactaactttatgttatgaaggatgctattgaactcaatacataaaatgtagaaaattttagttggtcattctagcaggctggattatttcctagaaatgaaggttaacttttattgcctggttttattttacagaaataagctatcatcttctgcagaagacaattactgaactgattttccagagttggaattaaccttctgtggcctaatcaccttcatttctacgtaatatcaccctcccaagcatttttcttggttttggaaaatcattaaggccacaaccactactcgatatgcctgatgccctctcccacttataatgtgttcatttttatttttgagaagactatagctagtagatatttctagaagatgttgataaaggatggagttaagtggagacctgaggagggagcagggataaggaagggccaaggggaagagggaattcacattcatcaggtgctcacgcctgcacagtcggcagtcagtggagggtaactctttggggtaaataggaggaaatggaagctcaagaacttgaaatcacttgcccaaagtcccacaggtgctcagggatggaggcaggaactcaagtcaggcctgttatggcacagtggattgtttgatacttgccctgcactctgtccctaaatgcccatctacagaattctgaggttgcctttcctgatgctggccctgcaagggctgggctcacactgtgtctgatgcagcagggctgacttgggggcaattacttcacattaaggtagagaccaagagaaatacttgttttaatctggaaaaactcagatggcttgcctacagccgtttcttaccattactcattaaaccaagcccttacattttatctgagaccctgactctaaccctgtgccatggaaaaacaaacaaacaaacaaaaaactagcatggtgagagggggcagggttgaagacacagtaacatgtggctctcagaaggtggcatccccttctgcagtggcagtgtcacccctcccagcccggcccaggggcctggtgcacccaaagaggagcccgacattttctcagccagaatgaatcacaggcacattctgctgcggttctgagaggcatctggccagtgttatagacttttcatgtgtcctgttggttgtgatcctcacagcagcccttggagatgggctgaacatgagagacaaggaacaagagtacaaggagataagaagctcaaaaaacaacaaacaaaacccaaagctagcagaaggaaaggaacagtaatgattagagcagagataaacaaaaagagaattttaaacaacagagaaaatcagttaaaccaagagttggctgtttgagaagactaacaaaattgacagacctttaacttaaataaaaagagagaaaagatctaaataactaaaaccagaaatggacgagaaaacatcacgtcctacagaacaacacatcttgcagaaataaaaaggccaagagaatattatgaacaattatgccaacaaattgtctaacctagatgaaatggacaaattcctagaaagacacaacctactgagactgaacagacctacaactagtaaagagactgaagcagcagtcaaaaatctcccccaaaagaaaagcccactctctctccggtccgtgcctccaagatgacaaagaaaagaaggaacaatggtcgtgccaaaaagggccgcggccacgtgcagcctattcgctgcactaactgtgcccgatgcgtgcccaaggacaacgccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccacctcgatttagacctgcgggtgctgccccacgtcccccaccaaagcccatgtaaggagctgagttcttaaagactgaagacaggctattctctggagaaaaataaaatggaaattgtacttaaaaaaaaaaaaaaaaaagcccaggaccagatggcttcactggtaaattctaccaaacatttacagaattcacaccagtcctcctgaaactcttctaaagaatgaagaagaaggaacatttcagtgttgagcatcaccctgatactaaggccaaagacactccaagaaagaaaactacagactaatattcttgatgaagatcgatgccaaaatcctaaacaacacactagcaaacagaattcaacaacacattaaaaggattatatgcaatggccaagtgggatttattcctggaatgcaaggatgtttcaatataagaaaatcaatcaatgtaatacactacattaacagaatgaaggaaaaaacacacaatcacttcaattgatacagaaaaagcatttgacaagattcaacacaacttcatgatttaaaaacagtcaacaaaggaacagaaggaaattacctcaacatcataaaggcagtatatgaaaagcccacagctaacatgatactcagtgatgccagaatgaaagcttttcttctgagatcaggaacaagaaaaggatgctgctttcatcagttctgttgaacatagttctgggagtcctagctggagcaatcaggcaagaaaaagaaatttaaaaggcatccaagtcagaggtaagaagtaaaattaactctatttgtaaacaatatggtcctgtatagaaaatgtaaacatttcaccttaaaacttttagaactaataagcaaattcagtgaagttgcaggagacaaaattcacacaaataattattgcatttttatacactaacaataagcaatctgaaaagacaaactattccatttatgatagcatcaaaaagaataaaatacttaggaataaacttaaccaagcaggcaagatgtgtacactgaaaagtacaacacattgctgaaagcaattaaagaggacataaataaatggaaagacatcccatgttcatggattggaagacaatattgttcagatgtcaatacttcctaaagtgatctacagattaatgcagtcctttaatgcagaaagaggaaaacccaatccaaaaatgtatatggaaatatcaaaggaccttaaatagacaatgtgatcttggaaaagaacaatgttggaggtctcatacttcctgacttcaaaacttatcataaagttactgtaatcaaaatagcatagaacaggaattcctccttatctgtggttttgctttccatggttattgtttaatgggtacaaagtttcagttttgcaagatgaaaaggttctggagacctttttcacaactcaaatatacttaacactactgaactgaacacttgaaaatagttatgataaattttatgttatgtgtattttatcacaatttttaaaactccacaaattaaaaaacaggaaatacagagaaggatttggtttatcagataaaatttaaaacaagtagggaacaaaaagcatagggaagtgtagggtgctttgcaaaccatctctgccattgcagagcctgagtcctccaccatacttgacagggtcacctcccttgggccttggggtcagtgcaagtgacagagccagagaggcttttggagtccagcaggcccaggctcagttcctgctgctgcctctcaccagcttcgggccagagccctcatcttagtttcttcatctgttaaatgaaggtaataccacctactttacagagttgagagcattaaataaactgagatgacacaggctacttagtgcggggcccagtacacccaggtgaacctcggtcgtcggtaagcaaggtcccagaagtcctccctgggaattagccttcttcagaaacactatcctccaactctcttctcctcttacctctgtcctaagcctgcttgtccactcttggatgaaatatttttcttcctttgcagttgaatccccggaatagtgaaaacaatgaccattgcgtgctgagtacctgctc

SEQ ID NO: 13579 - DNA, 44245 bp, Human
  misc_feature (1)...(44245): n = A,T,C or G
tttcttgcgtttttgttttggtttgtagcttatcagttaacattagtgttagtgtattttatgtatagcccaagacaattctttttcttccagtgtggcccagggaagccaaaagattggacactgctggcttacaccatcaccaatagtgggacaaatctgatattaaatgcctcctaatgtaatacaatattaactacacagtatgacctttgaagtatccttatccaatgtttaatctgaactcctcaagcctctggtaacttgcaactgataggaaatacaaaatctagaggtacaaaataaataaaatcggacaatccagcattagggcattcttcatgacaactgcttggtatcttaaatttgtttaaaaagacagttattattgggaaaaatgaattagattaaaagctttagattaaaagaagccaaagaaagttaaagcccaacttcaatgggcaatcattcataggatcctggttcaaaaacaaactatttacaaaaggtattctggagacaactggacaactggagaaatgtaaatattctctggaccttaaataatagtagcgaataattgttaattttcattgatgtgataaaggttttataggaaatggttatataggaaaatgtccttgtaggagacatatagctaaagtattctgaactgaagtgtcttatctacaacctacagatctgagaaaaataaaaccaacaaccaaaacacacacacataggtacacatataaatatataaataaatatggaaaaatatttgaatctaggtgataatgatattgagaagaaattactcaggccgatagtacgagtatgggagtcctcagtgtaaaaagtgaagtagaggttcctcttcaaatggactttcctttccgtctaattaggaataaacagtaacttctcttaaaagcaaaatttattcaaagaactgtgctaacatattggaggccgaaacaatgaggttcgtgatcaactcagtatatcactggaggctatatgagtaagcagcaaactgtttctcataaatgcagaacgttggcgaactgacaaactgcgtatgccacccaggaggactgctgagggtagttacgatctaggcacaaatgtttcttatgattaggcataattgaagcctgtcagtaacaatatgaacctgtgatcaattaagcagctgaccaatcgttaccacctcctccctgctcctgttacccaaaaaataggaagggctgtggaagctctgtggctgcctttgctcacgagaagcagggagctctcttcttcttcccctggccctttccttaaaacagttccttttgtcttaagttatcatttctacgttcgtcccttcatttgatctcacaatgatggtctcaagcagtaacagtagtaactgctgtaacgatggtctcaagtagtaaccgtggcagttggccacactaacattctttgatatctgttggccgtaataaagaaatcaatgtactttgtgctcttagctgccacattttagcctagatatttgccctggcatgcttatactggtccaaggaagcattaggccatagcctgttttcttccttatctggaggtgtttttacctttctcagcattccacaagttgcttcctccttcctttgttctcctctgtctttgcctcttttggaaagttctaagttgctagccaatcaggacaagtacagaggtccccttccagccaatggaaaccggacacggtagtagggtgcacgtgtcaggttataaatgaccctgtctcctttatgcgtgtgtgctctcgtggcaagactactagcgagcggcaacctttctgcagaaagtaaactagccttgctaagagctcctttgtctcagtgttgatttttgcaacactgagcgcccgttcccaacatcagtaaggcttttctttttaatgaaaagcagccccaaatccttttctaagagcagcctgtgaagtcgagctgcaggcacagacaaacaagggggtagcttgcttgggtgaatggtggcaggaactaccgactagacatgtttaagatgagggctccatcttcgcttctctgccagccacgtgtacagtaagaaggggttacaataggcatatgggtgattttgtgcttttcgttcatcttttctgtgtttaaaatgttcagaataagaaattggaacaaaggagacatgaatagacaattcctaatcatctttaagagtccgctttgtgttttacttaccaccaccactttgaaggctttcttgcctataccaggacaaactcagctctttatcccttttccgaattttcctggtactttcactttgaatacagcgcttaattaacattctgccttgtacctaggactaacacagtataaattcccagaagacaaagtaggggaatacaataacaggatatagaattttaacagctaaattagatgaatttatgggtgacctttattgggcaaaagaaaatgttaagttagtataagatttagtataagctaccatctcaaaactcagggtctcactggaagagaaagtgactccaggtagaattcctcagggagacattcacttccatcattcgctgaaccaggagctttggacagcctcggattgcaccggcatatccaaggacaccacatcagcggacaagtcataaacagccttgggaatacgcggaaaggtcaaatttacctaaacaattaaattctcttttaaattttaaggaaacacaagtatgctttcgctttaggtagggcatttgagagcaaaatgtactaatactttgaatccgccaagcagacacgatctgggtttgaccgttctctccgggtaaaggtgaaggctgaccacgggggccgctctccctccaggccccagccacgccctctaacccaggttcccgtcctgcaccgcgccgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgctgccaccccgcctagcgcagcgccccgtccttccgcagcccaaccgcctcttcccgccccgccccatcccgcccacgggctccagtgggcgggaccagaggagtcccgcgttcggggagtatgtcaaggccgtgacccgtgtattattgtccgagtggccggaacgggagccaacatggcagcggggttcgggcgatgctgcagggtgagagggagcccagcggtgcggtggggctggaacatgggtattgtggtgtcggagcagggggccgtgggccaaaaataggtgcggccgggaggagtgggaagtcgggctgaggaaggagccagcctaggggcccccaacctgctttcacgcctcctaccaccggacggaacgtagcctagcgtttcattttccgtatcctcccgtcaggcgaccccgttatagccggcatcctctctttagaatatcgtttttctttctctggtaaaccctccaaatatttaccgcgggaatcccacctttttccaaagtgaccccgtctctgtgtcagaaccacgggaaaaagaaaaatggagcagctactccttgaaatacttaatgtttaataagcttttcgttgtaacgtttccacgttgcttacgggaaaaaaaaaagtaaaaaaaaaacctgcagaattttatgtgaacttgtgtgtatattctagtattggatcttaatagattctaaataagtttgtcactagatgaattttggtatcttaaatattcttgatatgttcacaccactgccatttagatgtcacttaaaattaagttaaagttatgtcttggaccaaaaaagctgcggttttagaataatcctaaagaattgctgcccatgttttgctggtgttatgcaagttaatgtgcagtgaaggcagaaattgggagatttcagctatttttaactcctacaccagaaaagcagatttctcaacctccaaggaaggatctaaaaaaaacctgatatagaaaacttacaccctttttctcttctttaacccataaaactgacactcttatattcccaagaaatgcacaaaagtgttcaattctagtggtgctgtttcgatatttggaatttcattgttctagacagagagcccgaagtaataaaaccaatagttatatagcattaggctttcaaaacattatcgtactttaatcgtccgaaaatacgcagtgagattagtcccattttttggttttgaacggaagctataagcagtttgtaaacctgtctacggccacaaatatggttgtggaacctagattcacattcagcaattataactccagatcccgtgctgtttctgttttctatttgcaaaccacctctctaattaactggctaactttgttatgtaattaacaggttgatgggcattgtattctggtaatagcaacctttgcactttgttccatgtaacatattttcctgaacagtcacatgtgaagtgactttttccctatttaaattccctcggttggccaggtgcggcggctcacggttgtgatcctagcaccttgggaggcctcggcgggttgatcacttaaggccaggagttcgagaccagcctggccaaagcagggaaaccctgtctttactaaaaataggaaaaattagctgggcatggtagcatatgcctgtaatcccaggaggctgagtctgcagtgagcggagatctctccaccgcactctagcctgggtgacagagggagactctgtcaaaaaaaaaaaaaaaagtctctcagtagaccatttaacctggtttgagttctgacttttgtgcatggtatttaaaaacgcatttataatagagtcaggttttttgttctgatttttgtggaatgttttcctttgttatggaacctagtgaccaattaggatactaacagaaagatcagtatagcaaggtggttaatagcatgcgctcttgatagtaaatgttagaatcctggttgcactaatagtagagtgactttgcctaatttagttgactttctgagccttcgtttcttcacatgcgaaagtggaataaaagtaatggcttaatcctagacttgacctgggattcagtgaattaacctgtgtaacgcgactgtaaatcagagtagatttggtctgtgactgctggacaataagcaccagagaaactgtttcacttttttttttttttttttttttgagacggagtcttgctctgtcacccaggctggaatgcaatggtgcagtctaggctcactgcaacctccgccttccgggttcaagcgattctcctgcctcagcgtcccgagtagctgggactacaggtgcgtgccaccacacctggctaatttttgtatttttagtagaaatggggtttcaccatgttggtcaggctggtctcaaacccctgacctcgtgatccgcccacctcagcctcccaaagtgctgggattacacgcatgagccaccccacctggcactgtttcactttcaaaataaaattaatgaagatgcaaagaaaatgcgagttttcatactctgtatgtttttattactgtagtatgaggtatgttatttggaaagcactgtttcaattacaaatatttgacactcttaattatattgtcaccttacatgtaggaattcgtcttttataagttgaaattgtcatctacaaagacagtttctttttacggattttgaaaaacataagaatttaaataaagaaactttagtatattcttcagctgctcttttctcttagtatctaagcttgttaaaattgctggatagttcaattaaaatcttttacagtgaaaattgtgtaattttgactgtcctgaaacctttactcaagaacaccattgtggttcccagtttggcagctttaataaatgcaaatttttacttttgtatccattaagctgtcatgaatataaaaatgggttgcaaaacaataatatatgtatatttgattgtttctttatatgttcctttgaagaaatatgactatatttcagatcctaagacaagtagtgtattagtagtttagaagagggatggcaaacgtgtttgtaaaggaacggatagtacatgtttttggctttgtgaaccagatggtctctgtggtaactacttagatctgctgtgaaagcggcaatagacagcatgatgtggctgccctggtttggtgactccttgctcagaacattgtaagaatccctgtagacagcagaaaatacagaacatggttttatgctaatttgttttgttagagtggggtatcctaaaaaatgagatcctctgaggggaaggtttccagaggcatgcatgggaggctcacagtgacagggtatcaaagttgatggactaggcaactcttgaacacagtatgttcacttccagcctatcgttctccccaccccaactctccaaccattaatgtcctaggagcttgtaagatacccagaatagtggtcctacatctactactacccttgactgttgtttgtcctaaaccctccacttcagtagtataaataccactgactttattttcattactttttaaaaacatctcctctgtaataggaatttatataactgataattggcttatttaaattatgattgaaggcatttaaatagtgatgactttaaaaactatgagtatggtcaaaccagttgctgtactcacttatgattatcagtagtctcttatctgattaatgtttaacttatcaaatttattttaataaaagtgttctttacaggtcctgagaagtatttctcgttttcattggagatcacagcatacaaaagccaatcgacaacgtgaaccaggattaggatttagttttggtatatgttcggttctatcttttgactttaaacttatacatatgaagctttatatgtttgtttggaatatgtttgtaaataaacttaataatgtctttcaatgagtagaaccagtccactgtccacagatagtttacaataactcacactccattcttcctgatctcattttcttcctcagtatactacactgtacattagatctgttttagcagcatacatacacttaaattccttcctttttttctgagtgtttagcccaaaataaatgagatttactgatatatatgaatagtcttcaacttacatatctgaatgccacaaatacattttaaaaacacttgttagattacaattctaggtgcctggtaataagctaaagcttgtttttgctataatatatccaaattgcaattttggtactattagatgaagttctcactcctgggaccagggagccatgattttttttcctctgccctctataaaatgaaaactacacacaaaaaatttgaaataatatctatctttggcattcttggccttctaaagtgcttcttcaaaatttttattttttctctagttaaaaaccatttactcaatttatttggtctcagaaaatagttaaaggcagctgcgataactcacagctaggtacaaatgacaatctcaaagctctccagagttattttttttattatttgttgtgttttttaaagatttttcccttttctttataaaggttttttttttttcttaccagaatttaatgaaatttttcttttctttttctttctttcttttttcttttttttttttttttttaagatgaggtttcattgtctcattatgttgcccaggccgatcttgaactcctaggctcaagcagtcctcttatttcagcctcccaaagtgctgggattataggcatgagctactgcacccagaccaaatgaaaagtttctgtgttttttttttttttttctgtgacttctagccaaagactggatgaaaattttctcttttcttttttttgagacagagtctcactctgtcacccaggctggtgtgcaagtggctcactgcaacctctacctcccaggatcaagcgattctcctgccccagcctcctgagtagctgggactacaggtgtgggtcatcatgcctggctaatttctatatttttagtagggatggggttttgccacgttggccaggctggtctcgaacagctgaagacaagtgatccacccacctctgcctcccaaagtgctgggattacaggcatgaaccactgtgcccaacctaaatgaaaattttttttcttttctctttctgtagccaaagactaaatgaaagttttcaagcactgtgaggatagccatttgggatggtggatttttttttttttttttttttttttttgagactgagtcttgctctgttgctcaggctggattgcagtagctccatctgggctcattgcaacctctgcctcctgggttcaagcgattctcctgcctcagccacccaagtagctgagattacaggtgtgggccaccatacctggctaatttttatattattagtagatatgaggtttcgccatgttggcaacgctggtctcgaactcctggcctcaagtgatccacccgtcttgtcctcccaaagtgggattatgggcattagccagcatgcccagccagggtagtggatcatactgagataattagcattaatttggtatgattgcttgtcactttaaatttctctctcagtagtaagagacttgcaggagaaatctatggtggttcactgagtgacagaggatgagttagatataattgtttgggagggagattgtgaagttcaatacgggtctattccttgaaccagttgcatctggttctttatctgtaaagtggaaataatatctataacacagaatttctatgaagattaaattatatgctgtatttaaagcccctagcacttagtgactggatcaaagtagtttctcaataaataatacataatacatacttgtcatttttccttttttttttttttaagagacagggtttcactctgtcacccaagctggatgcaaccttgacctctggggctccatggattctctggcctcagcttcctgagcagttaggacaataggtccatgtcaaccacacctagctgattttttaaatttttaaatgttttgttgagacaggatcttgctatattgctcaggctggccccaaactcctggcctcaaatggttcacctgcctcagcctcccaaaattctagaattataggcatgagctaccgtgcccagactttctctaccctctatctacctgcaagattgctatcaactggcaccaatcttagaagtaaagctgtgatagagagaacactggactgaaactcttaagtatacttctgctaattcattgtgagactgatactagaatttccttactctgcattagtttatcaataaaaagagagatttggctgggcgcagtggctcgggcctgtaatcccagcactttgggaggccgaggtgggcggatcacgaggtcagaagatcgagatcctggtgaaaccccgtctctactaaaaatacaaaaaaaaaaattagccgggcgcggtggcaggcacctgtagtcccagctgctcaggaggctgagacaggagaatggcgtgaacccgggaggcggagcttgcagtgagcctagattgcgccactgcactccagtctgggcgacagagcgagactccgtctcaaaaaaaaaaaaaaaaaaaaaaaaaagagatttgatcttatgctcttcaattcagcaccagaattcagcttttatgtattgtttctcacatccccatacaaatgattactgtagtcttaaacattcctctgtgcatttgctctcatttttcttgcttgaaataccctattatctcttaaattttacctaatctttgacgttagatgcaaccacattaaaacacaaggataccatggatttgaaaagatgcagttagcaattgactcctctcctcaatcaagccaccatactaatttcattaattttaaaacaatcccttattttatgtaaacaaattgttggacaccatttattagcattgcagcaggattttatgttattatcttttgaaaaacctttctaccacttttaccagttgctttgtgctaatttataagcttgtctgagtttaaaggagctgtaagcctaggcatggtgtctcatgcttgtaatcccagcactttaggagaccacggcaggaggattgcttgaggccacgagttcaagaccagcctggcatcatagtgagaccctgtctctgtgaaaacaaaaaaaatgaaatagatagggtgaggtggctcccagcactttgggaggccaagatgggagaatcatttgagcccaggagttctagacccatttgggcaacatggcaaaaccctgtatctacaaaaattacaaaaattagccagatatggtggcatgtgcctgtgatcccagctagttgagaagctgtggtgggaagatcatttaaggccaggaggtcgaggctacagtgagtcgtaattgcaccactgcactccagcctgagtgacaaaatgagactgtctcaaaaaaaaaaagcaaaattatgatattgatattcttatatgacactttgaaataagttttattgctttatgtcactgagtgtgtttcatctatttcgttagattgattcttgtcgtcagggagatgtcttgtatattagtttcacttcagtgttagcaaacatttgataaattggcttaggaactaataataagttaaacgttttttatatcaccaattggaaaagaaaaactcacttgagctctacaggttaatatctattactcatttgtaaaagttaaaaatcttacctatttcctttagcatttgtattgacataggtttatttatattgtgtagtgaactcttgattagtcaaaaaatgcactgtagtctgagtttctgataatcaaggatttaagtccccacaataaatacacatttctacatactgacttcataggacatttttccttgttatccagttttaacttttctaaataattttcccttagagttcaccgaacagcagaaagaatttcaagctactgctcgtaaatttgccagagaggaaatcatcccagtggctgcagaatatgataaaactggtgaagtaggtatatacattttaaagagggaaaaatcttttacattttttacaagattatgtaatcaaactatctggatttcaaaatatattttaactcagttctttttcttctagtatccagtccccctaattagaagagcctgggaacttggtttaatgaacacacacattccagagaactgtggtaagctttctttatatttttaatactggaatgcatatgagtaagaaaaattgtggaactctactcagtcatttttttcaaatatttcttgccattaaatgactttctacctttgtcttcctgctcagactacagtgtttgcccacttttggaagcttgcactctatacctagatgcgtttttccttcttctaactggttccaaccttaacttgcacctaaaccttggtaacttccgtttctagagttggtcaatttgttgtgttttattcctatcttctatattacattttattgagtcttttttgtgaaccatgattcttttcctcagacccagttttagagttgaattgagttttaacaaaatcaagttagaacaggaatacaggttcaaattacaaatagtaaaataattttttgaaaattttagagctttaagaaagtataatttcttattgtgccagccagaacacatgtagatattatattgcaaatttccttttaaaacaaattttggtcatattgaaagcaattaaaatagtttacctttatttctattgtgatgtactacatattacaatgtgttgaaacattttgatactgtaggaggtcttggacttggaacttttgatgcttgtttaattagtgaagaattggcttatggatgtacaggggttcagactgctattgaaggaaattctttgggggtaagtgacttagaaaattaactacctaactcagctcttgttaatgagatagttactcctgaagaagttggatttttagaagaaaaaaaaaggaaagtcagttactactaggtaaggttagtgggtacacacagttttctttaaagaggaacacaagattcagcagtgaagcctggagttctgatttcgaggcttgataactctggccttgtctctagtactcggagttctgactgtcctttggaggaaactgtatactttggctgcagcttcagtggcaattcttaggtaaagccaagggctaaatccagaattcaggagcaggattgggatggtttgctgccactatggcagtactgaaatttagcaagcaattcttttttttctcactctgtcgcccaggctggagtgtagtagcgcgatcttggctcactgcaacctgcacctcctgggttcaagcaattctcctgcctcagcctcctgagtagctgggattacaagtgcgcaccaccacgcccagctaatttttgtacttttgtttttttttttttttgagacggagtctcactctgttgcccaggctggagtgcagtggcgcgatctcagctcactgcaagctccgcctcccaggttcacgccattctcctgtctcagcctcccaagtaactgggactacaggcgcccgccaccatgcccggctaattttctttttttttttttgtatttttagtagagacggggtgtcaccctgttggccaggatggtctctatctcttgacctcgtaatccgcccacctcggcctcccaaagtgctgggattacaggcgtgagccactgcgcccggcctaacaagcaattcttaggcctgatcatacatactgtgtcacatattctaaacataattttttattagtgcatttcactatagtagattttcacagattataatgccacaggtcctacatataacctaattttatgaaaatacttagattagcagatttatttcctcattctaacttagaggcaaggtataggccagttctttggacttacctgttaggtgaaaaatagttattttttcattttgaattatagcatctctgaatttacatatccaataaaaatgacttgattttttaatgtcaattttcttcggtagcaaatgcctattattattgctggaaatgatcaacaaaagaagaagtatttggggagaatgactgaggagccattgatgtgtgtgagtatgtgtaactgccgctttatttcacacttaagaagggaacaaaggtgctatttctccttttcagtctatatgtatatattgggatatttagcattgaaacaaaacttagcaacatattattacaatgatgtgtcaaggatgccaagaaagtatcataataggccgagggcaatggctcgcacctgtaatcccagcactttgggaggcggaggcgggcagattacttgaggttaggagttcacagcctggctaacgtggtgaaaccccatctctactgaaaatacaaaaattaaccaggcgtgatggcgcctgcctataatcccagctgctcaggaggctgaggcataagaatcgcttgaacccgaaaagtggaagatgcagtgagcagagatcacaccactgcactgctacctgggcgacagagtgagtgagaccctgtctcaaaaaaaaaaaaaaaaaaaaaggtgtcatcataattttgttgcttatttccaggagaagagagatctacttgtgatgtttttgggatgtcaaaaagtgtcataataatcctcttacttcaggagagagagctctatttagtggagcattctacactttaagaactgagtcattgtgtcaggaagttcagattgaatgtagggcaatgtgtgtttgaactagtagtgttttgaattagtaaaaaattaatgttggctggtcgtggtggctcacgcctgtaatcccagcactttgagagtctgaggcaggtggatcacctgaggttaggagttcgagaccagcctagccaaaatggagaaaccccatctctactaaaaatacaaaaattagctggatgtggtggcgcttgccagctacttgggaggctgaggcatgagaatctcttgaacctgggaggcagaggttgctgagtaaagatggcggcactgcactccagcctgggcaacagagtgagactctgtctcaaaaaaaaaaaaaaagcaattaatgtgggctgggcatagtggctcacacctgtaatgtcagcactttgagaggctaaggcaggagaactgcttgagcccgggagttcaagaccagcctgggtaacacagtgagaccctgtctctaaataaataaataaatgaataaataaataaaaattaatgtgaacctgtaactgaagaaatagcaacttatttgttgaatgactgaatgacttgggaagaatagttgtagagtctatttacacctctgaaagcaactcatcacatctctaaatgagatcttttcaacaagataaatacacacacagacatacacacacacacacacacacacacacacacacacacacacacacacacacgctctattctgaaactgttgtttacctaaggatttttacttcttgtttactcaaacatatttcaatctaaggtgtggttgttatactgaaatacagtagatgtattagttttgagctaatgatgagaattcatcttaaagaacagaaaataatatttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccatatccatgagggaatagtttaggacctgttgccctccatatcaaaatttttggttgccaagtctgttatacaaaatgtacagttagccctttgtatctgtgggttttgctccacagttggttaaattccaaaattcgtggatgccaaaggcaaacttttaaaaaattaaaattttataacttttctaattataaaatactgagtatagaaaatttagaaatgttttaagtagaacaaaaatatctgtaatccctcagatatggagttaattagtattacttccttattgtagtgcctaccacatttttaaatatgtaattgtgtttttaacagttagcccccattatatacatgtagttttatgtacatctttatttaacaacatgaacattttcttatgccttccttctttttacatgctgtaacaatactgcataatttgctatctaatggatatgctataaattgtttcacttttctgtactgttgaatgtttaaactccttgggtttttactttggaaaataatgttatggtaaaaaataatacagaaaaaaaataaataaaaatgatcaaataagaagccaagaacaggccaggcatggtggctcatgcctgtaatcttaacactttgggaagccaaggcaggaggatcgcttgaggccaggagttcaagaccagcctggacaacgttgagagactgccaccacacacacacacaaattatatatatatatatatatatatatatatatatatatatatatatgaaaccaaaaagaagaaaagaagacaaaaacaactctgaggaaccagtagtgacaagccattttgtatagaaaaaaacaggctcatttacttcacaggctctaaaaacttcactgtattatgaaacagacagatgtctaatagcatatttcagggaaaaaaataccttaaaggtggttaaaacaaaattttggtacttaaaaggggcatcttttatggacaactccttaatttgtcatgatgctgaatacatcaaatctccaggtagcagagtaatctagttcagttaacttgagtgacacctgaatcccctctacagaatccctgtcaaaagaccatctggctgacatgtttttatacctcaggtgcctgggaatcaacaccttctgaaacagcatcatttgcgagcatctgttatcattagaaaaatattttggattacataatgcttaagcacagaacctgtcatttttttttttataattttaccagttcatactgtaataggtgttcaataaatgttagagtgatttcactgtacttttctttggctatattgcccttcagatgtttgagtatagttatatttatttatttatttattttttgagacggagtctcgctctgttgcccaggtcggagtgcagtggtgtgatcttggcccactgcaacctctgcctcccaggttcaagcgattctcctgcctcagcctcccaagcagctgggactacaggtgcgtgccaccacgcctgcctaattttttgtatgtttagtagagacaagatttcactgtgttagccaggatggtctctatctcctgacctcatgatctgcccaccttggcctcccaaggtgctggaattacaggtgtgagccaccatgcccagccaagtattgttattattttttttttctgaaatggagtctcgctctgttgcctaggctggagtgcagtggcaccatctcggctcactgcaacctccacctcccaggttcaagcaattcttcctcagcctcccaagtagctgggattacaggcgcccgccaccaagcctggctaagtttttgtatttttagtagagacagggtttcaccatgttggccaggctggtctcgaactcctaacctcaggtgacccacctgcctcggcctcccaaagtgctgggattacaaacctgaagcctcagccaccacgcccggccctaagtaatcatttctagtgcccctatatatgcttactactttgaattaaaatgtatatagtttctttcttttttgttgtatatttttaaaaaataaattgacatgggttctcggcatgttgaccaggctggtcttgaactcctggtctcaagcgatcctcccatctcagcctcacaaaatgctaggattacaggtggggggccaccatgctcggcccagtttctttcttctttggactgtaagtaccttaagggcaagtaacttgtttctttagtatccacagtaccggccactcttgaattaacttgcactaacacttgccttctaccacccccttttatccattactgcttgtgtcttgtcactcctctgtttaagagctctaagaggctcccctgtttctaccagataaaattttaaatttgtaatgtgatataaaagattctcgtcgaccatttccttcctttctttccagactcatgtcttaccattcccttacatgcacagaatttacatactgtggaactctggtactttcagcattagaaacactgggtaactctgtttcttatcttagtgtcatagcatatgccattacttgtacctggaatgcatattcttcctctttttccctcctcgcaaagaagccattttcctttttgagacttaatttaaacatcctctgccctgggaaactagtttctcaagccccttgtctgactttcacacatagagttgcagtatagttatttatcttcactgttacattgtgaaaatctctaggactgaatgtcttttacctctggtttccccatatcctaatttacatcgtggtacatagtagatattcaatacatgtttgcatgaatgaatacatgtgaaattgaatttaatgaacttgtttaaagctatctaacattttcactttttattaaatatatgatttgttgatatacctatgcctaatttgaattatatattaagtgtttttaggccaggcactgtggctcatacctgtagtcccagcactttgggaggctgaggcagaggattgcctgagcccaggaggttgagaccagcctaggcaacacagtgagatgccatgtctacaaaaaatttaaaattagctgggcatggtgatgtgtgcttgcagtctcagctattatacacgggaggctgaggcgggaggatttcctgagtccaggaagccaagactgcattgagcctctgcattccagcctgggcaagagagtgagaccctgtctcttacaaacaaaacagaaaagtttttacatttgagtggtttctttgattttgtaagaacattttaattttagatatttaaaaatatttaaaatacagcttaaaaaataaaacaatcctgtttccaaacagtcaaaatttaatcactaacatttaatttcatttctcttgtttttatatattcaaggcttattgtgtaacagaacctggagcaggctctgatgtagctggtataaagaccaaagcagaaaagaaaggagatgagtatattattaatggtcagaagatgtggataaccaacggaggaaaagctaattggtatgttgttcaaaacatctttgtatattttttcttaattgttttatcttcaaatctctctttctttctgtatatttttaaaccactacagttaaggtatgtttgtggaactggaaggcctaaaggagattataaacagttcagtgattttcaaaaactaattttaagcccctgcactgttttttcaaattaactctcagaagtttaatgtgtaaaataaaatacaaatgcgtgctctgtttgaatctgattaggaaggctagcactctgtctacttggcttattatctccactcctcatctcctataccagccgctccttggaatccctaaaaccctaaggaaaaaggagaacctttggtatagtgcctgtctccagatgtcagaaataaacagagtcagtcttaaaacaggttatctattagagaagacagaatttgactttaataaaatctgaaattttctaatatatggtcaaaaaatatgaagttcaacaaaggatcaaaaataatttgtataaatataaaatactaaaaaaaaacactcgattatttgttgataaaagatgaggaaagttcaataactgttaagttcaataagaatcaatagtatgagcctttaaaaagccaatgtaattttaagccaaagtaatagaagtacagcatcaaatagagaaaaaatggtgacagttctgggcaacacattttaaaacatgtattgaaaaacttgactaaatctagaagcatgtaagtatcttgcattaggaggagcctacaaaacatgttctgaaaagcaaagccttggttattttggaagaatcttgaagtttttcaaatattattacacagaaagatgatcaggcttatatgtttacttcaggatgccagcttagaattaatgagtgaaagttagaaaaatgtagaatttagcttaacataaggacaggctttctatcagcagtgctgttaagttgtcatgggaaatactgtatttacccatcactacaagtatatagagagtttctagaataactttttattgattggaataatgtactaaatgacctgtctctctttgtaaaaaattcagattcaatatatttgtgtgccatatactacagttttctagcaaataaaacatcattttttttcagagtgagcctactaaaaagttacttagattaaacatatcagtcaattccttatgagcatcctaaatatattcagtattatggagtgctatatctttacctttaaccaattcctggtaatatcagcaactaataaaaagtgaagaaactattaaaatttaacaagttgagagaaatctaacaatgcagtttgaagttttcgtaattttaaaaacggattagccaggtgcaatcactcacgtctacaatcccagcagttttggaggctgaggcaggaggattgcttgagcccaggggttcaagaccagcttgggcaacataacgagaccccatctttacaaaattaaaacaaaaagaaagaactgattacaactgttcactgttcatatagtaaggcaaattaggtaatatatgaaaccagataacaatttttacgattttgttactattattaaataaaactatagaatgagtggtaatgtattggttttaaccaaagaaaataagtttgtgttgtttagggaagaatatacctttttaaaagaatttttcgtgtaccaggatatatagaacatgaattagacagatgcttggatatttgcatttttttcttatgttgcacttcaagatctttctgagaaattcttctgtaggaaaaaatcagcaaatattcataataactcagctataacaaaaacactgacttgctgcataaagaaacagtagttggaacatatgggtctccattttatttatttatttttttgagaacatctgccctttaatttgcatttaaaatcagtttctttaaatactttagttacaagttctgaatagtgaagacagagtagtagatgctgcaggcactcagtattggctcccaccccttcccccctccccacccccaggcctcacttcttggctcaagatacaaaaaggcactctctactggccctagtgtcaaatgtcagcagcctcaggcctggatgcagttggatacaaagccatgaatcccagtagctccaaggaattccaatgattgtgcccagatccaccggcaacacatcttagaaatgacctcatccattacaccactatctactaacaccctcagggtggtttcctaccccagtccacgtcctccaaatctgtgtcctgcagaggaagagacaaggccccactataacgcaggaaggaacaagaactgcctcctcagcccacgggcttacagcaacttacttgaaaagctcaaggcaatctgagtctagaggagacctcccttccctaatctctaccaggctctggcccttcttcgggactacgcttggttccactgccatgatgtgctagaatctgctctaagtaagaacaaggtgctagaatgaggcccagcaaccaggaaagggttgctacagccccagctgtgtgagattgtgccaagatgagtcttcttggtgtgagcctatgatggagagcgtgagggcagacctgggctctccttctatgatgattacaacacgtgacctcagggaacctctgctctctcctcccattcacacacccagatcccctggcctgtgcttcctggtagaggtagaagaggcatcttgaagtcaatgacaatggagaatgaaggtgccattgaagaaggaaagcagcacctctttgcctgtgttcaatccctccatacaagtggaatcgagaatgtgcacagccaggacagaggctgctctgagcttgggaggcacagcatcctcctagatgtctctgcagaacaaactttcaaaagataggaacttaatcacatggtcctcgggggtttctctatagtataccagcactagggagaagcaaaatcatctttgcagagagctgatggaagaaaggcaggaatatgaatgagcatccattaaggctctctctcaagcctaaggaattaagatattcgagggtatgagacaggtgcagagagggagagagccaggcaggaacaccaagaaaaaagctgtgactgctggttacatagtgctctgcttccttgcttgaggccaacagcatgtgcctgtcaccaggctaacctgggacccatgaggggacagggagaagactggttttcagttcctgcatgatcaatttgtagggtgtgtgggttcctcctaaagatcaaagaggaggactctgggatcctctaccgctgccttgattttgcggaggaaagtcacagcctctctgccatcaatcagccggtgatcataggtcagtgccacgtacatcatgggctgcacctctaccttgcctcctatagccactggcttgtcaaagatgccatgcatccccaggatggcagacaggggggttgataatgggtgttcaaagagtgagccaaaaacacctccattgctaatggtgaaggtaccaccatccatatcttcaatggcaaattcattctttcgggccttctctcccagttcagtgatggtctgttcaatatctgcataattcatagcttccacattcctgatgactggaaccaccagaccctgtggggtggccactgcaacactgatgtcaatataatccctatataccacctctttggttatatcatcaatcactgcgtttacaacaggctgttcctgcaaggcaaaggctgaggccttcacagatgccgacatgaagcctagtttgaggttatgtttcttcaaaaaagcctctttgtgccgagccctcatcttctggatgttactcacatcaatctcattaaaaattgtcagcattggcacatgtattctgggcctccttcagacgctgagcaatgcactgccgcatcctgttcattttctcctgatgttctgaatgcagacctttgccagctcctggctcagctagtggtgggacagcagtgggttttactgcagacacaggtttgctagaaggaggttgtgagggcgagggcactggtggcatcgagtgggtatgggtgctgcatggggaggaactgccgctgctataggttctgcttttggggctgcagcagcaggagcttcagccggcttggccttagcaggagcagcaccagttttcctgagtgtgaaaagcggagtgcctccttcgacttttcccccatcaggtacgaaaagagcttcaatcatgccatttgctggtgatggaacctgcaccaatgtcttgtcagtttcaatctcacaaaccacttcatcttctgcaactgtgtctccaacagctttctcccacctgacatctccctctgtgacaggttctgcaaacgctggggttttgactgtaaccaagtcatacttgcatacagttgtagttctgaagaagcgaacactgaagacactgttgttaatgacaaccttcctgctgttagggtaacctggtccctggcataaggagaccccaggcagggaatgtctccctagagggcagttccccttctggaaggcagagagcgagtggctgaacgcccgggacacagtgggaccgggacagcatcacggcggccgggtctccgttttatattattccttttcacaggcagctctatttgccctccttttcaagatagcatgccccttaaagaataaaattagttttgggaaagaaaaagtgccagtttcaacaggcatagactgtcttgttgtaataataatactataccaggaatttttacttgcaactcatattactaaaagaaagttaaatagcatactatagtccctccttatccttgcaggatacattccaggacccctaatggatgcctgaaacctcagaaataccaaaccctgtatatactatgtttttttcctacacatatatacttattataaagtttaatctataaagtgggcccagcaagagattaacaacaactaataaaatagaactataacaatgtattgtaataagttatgtaaatgtaggccaggcatggtggctcacacctgtaatcccagcactttagaaggcccacgtgggaagatcccttgagtccaagagtttgagaccagcctgggaaaggtagtgagacttcatccctacaaaaaataaacaaaaaattagctaggcatggtggcacatgcccatagtaccagtgactcagaagaggtggaaggatggcttgagctggggaagtcgagactgcagtgagccaagatcatgccactgtactccagcctgcgcaacagagtgagatcttgtctaaaaaaaaaaagttatgtaaatgtcctctttgtctttcaaaatatcatatatatactgtactgcgggtaactgaaaccacagaaagtgaaaccccatggaatgggggagggcctactgtgttattaagacatagacctcaaatactagctcttccatatactaggtacgtgactaggcaagtttttaaacctgattatttatttcctcatttgtaaaatgtaggtaataataattgggattgttaagagaattaactgagagagcaatcaccatgtgttatttgccgatattatcaccattatccggtatgtgtatctcttaggtattttttattggcacgttctgatccagatcctaaagctcctgctaataaagcctttactggattcattgtggaagcagataccccaggaattcagattgggagaaaggtaaagtatttattaatgattagggccccaaatattattttaattataaattgcaaaattacttaactttcctttaataaaaacatttgtttgtattaagttggagtaaaaataaagctatgttttgatgatattagatcaaatagtctatatactactgaagattttgtgaacagtcatttcaagtcattttgaaagagtagtaccaacctgtggagaaggctaataacagctgtgaggaataatgaagtaaaatcaagctatcatttatattacctgaccaataataagaattctggatatttcaagggactttcccactcttttccccattggatcctcacagcaaccttttggtaggataagtggcattatgcccattttacagataaaaacaatgtgacataactgagattttactaggtcatacaacactaagaaaaaagtctatgcctgaaaagagtgtagaaaatagcaaatagccttgaatatggaaaggcaagaaaatcttacttaaataagaaaaggtaatttaacatatttgaaaaggtttgtattctgaatatgtggagataaatttggcatttaaagtagactaaagagaaaagagtttaaaattttataaatcacaatttaaaattataaattttataaagaaggaaagaaatgaagtcaataaagtaattttttttttttttttttgagacagcgtctcgctctgttgcccaggctggagtgcagtggcaggatctcagctcactgcaacctctgcctcctgggctcaaacaatcatcccacctcagcctcctgagtggctaggattattggcatgcaccaccacacctggctaatttttgtattttttgtagagacagggttgtgctgtgttgcccaggctggtctcagactcctgggctcaagcaatcctcccaccttggccccctaaagtgctgggattacaggcatgagccactgcgcccaaccaaagtcccaaagttagaggcagagttgaaatcaatatgaaggtatcctaggaccttacccagtatagtttctgatactgtattgtgctatattttcaatcagatattaaaggtagactgcacttgacaaaacagatgatactgttgtatgtaacaaaatataagaattaaaaattattgtgcttttcccaagaaattgttttttatttgtataacagatcatgtttctgtcttagggatagttgctagcaaacttggccaaatgtatggcccatctttagaaagtataaaggacctaacagcttatactttttttagtagtaaactcactcctgattttatcttgctatttctagtttttttctttgcctaattttctcacttaaaaaaaaatctacttcaataaatatttatgtagtgcatactatatacagtattctatctattagggatacagtatggatcaaaatagacaaaaatccctggccttaggtaaattactttctggtgagtgatagagataattatattgtgtatatttaagcctccttaaatctttattgaaacaaatggatatttacaaatttgtgaaatttaatgttttcaggccaggtttggtggttcatgactgtaatcctagcactttgggaggttgaggtgggagaactatttgaacccaggagttcaggaccagcctgggcaacatattgagactttacctctacaaaaaaatttgaaaattagccagtggcagtggcgcacacctgtagtcccagctacttggaaggctgaagtgggaggatcacctaagcccaggaagtcaaggctgcagtgagccatgctcctgttgctgtctgtactgcagcctggatgacagagtgagacctaatgttttcaaatcttttgtgttttagaaattatatggtttgagatgagcccaggaagcattttggttttaaatgttgtggggtttgggataaatctggtagggtgttttctcattatatatgcatggtggtccaagattctagtttattaacttttaaagacaaaataaagggatgttggcttctttctaggtcaaactatcgttattatttcttcaaactcagaagcagactattaaaaccagcaaattaaagggttagtttatagctctttgtttccattgctcctgtttcttattctgcttattaaacatgagatcaagtttttttccttattaagagttatgtctgcaacttcctctcatgatttagcataacactaatagtcatatacaaagagaaagagaaataaaaaataaagcaaatgtatcaaaatgttaacaattggtgaatctattatagatgaagggtgtataagtacttacatgcctgttacaactcctccattggtttgaaaatttttaaaacaaaaagttgagggaatgtagctagtttagtagtttcttataaagtcaaacatacacttatcacataaccagtgcccttaaataaatacccaagagaaatgaaaataaagacctatatacaaatgtttattgtaattttattaatgattgctaaaaaggaggggagtatccgtcaactagtgaaaagataatggatatatggtacatccaagagtgggatactacttagcagtaaaataaatgaattattgatcatgcagcaacatggatgaatctcagaagcactatactaagtgaaaagtcagacacagaaagcggactttattatttcacttaaatgacattctggaaaaggaaagactacgcggagagaaatcacacagtggttgccaggggataagtgtagaataaggaaattgactataaagggagaacaaggtaactttttggggttctaaagtactctgtatcttgagcatggtggtggttacacacatatacatttgtcagagctattagaaatgtatacataaaaatggtgacttttctacatgtaaattatacctcagtaaacctaattttaacagagtcaaaggaaaacaaaatcaatttttattcagtagattattttactagctctattaagattaaaggtctcaaatcagattgtgtttactaaatgttttttctgacatggtaaaatagatagctttcaaacatataatgagatttgtctttgttgataagatgtacttgtagacctttagactagtgttggtttcaaaatttgtgaaacattgttttagattatggttggcaaatttttttgtaaagatccaaattataaatatttcaggctttgcaggccatatctctgtcacaactactcagttctgccattgtagcaagaaagtaactgtagatgatatatgaacaaataggcgtgactgtattccaatcaggctttctttgcaaaacaggcattgcagactacagtttgttgatccctgttttaggtaattgcagaaagtcatgaaacagtgattaaagcaaaaattgatgctggctcaaaaaaaattccttaaaatatatcaattttcttattaggaattaaacatgggccagcgatgttcagatactagaggaattgtcttcgaagatgtgaaagtgcctaaagaaaatgttttaattggtgacggagctggtttcaaagttgcaatgggagcttttgataaaaccagacctgtagtaagtaatatgggttcataatctttataggatcttttatttattacattaaataagtatttttactttaaaattgtatgttcagtgtgtttctctttttaatatctgcttattttattaaggatataggaaaaatactgttacttttctttcttttttttttttttttttgagacagagtctcactctgtcaccaggatggagtgcagtggtgcaatctcagctcattgcaaccttcacgtcctgggttcaagagattctcctgccttagcctcatgagtagctgggactacaggtgcacaccactctgcccagctaatttttgtatttttagtagagatggggtttcatgatgttggccaggatggtctcgatctcttgacctcgtgatctgcctacctcggcctcccaaagtgctgggattacaggcgtgagccaccgcgcctgaccatattgttacttttcttaattttttaaataattcttcaagttttcttactatacattatagaaattattttagcaactgcaaaattactgtagttggtgctagatttagagaggcagtccaccctaaatatgatcatcctgttaatatgtactcattttctgtttttactcattaagaacatttcccctagtaagatttctcttgttaaacaaaagcaatgacttttttctagagtatgatactatgcctaacaaatgcctcttactacctttaattaacaaataatataaacttacgtgcctattccctgttccccaccagtttcttgttgctgtacatcaccttctctttgtacactccctaacatagacacttaggcagatattgtgtgttttaaagataacatgaacttttgctttataatatcttaaaatactaggtagctgctggtgctgttggattagcacaaagagctttggatgaagctaccaagtatgccctggaaaggaaaactttcggaaagctacttgtagaggtaattttaatactgcttgctttgttcaaatgtaaagacactcattttcatttaatatttagaaatgatttttaaaccacaaactaatcaatttctactttgatagcaagaagataatgtggttttatcaagatgagtttcaaagacatttctttttagagtgtgccactattggttacttctgaacctgacactgtgctatgcatttttttttttttttgagatggagtctcgctctgttgctcaggctagagtgcagtggcacaatctcggttcaccacagtctccgcctcccgagttcgagtaattctcctgcctcagcctcccaagtagtgggaactacaggtgcgcaccactatgcctggctaatttttgtatttttagtagagatggggtttcactatgttggccaggctggtctcgatctgcccgcctcagcctcccatagtgctgggattacaggcatgagccactgggcccggccttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccagcctgggcaacagagtgagactccgtctcaaaaaagaaaatatatatatattttctgattctctcagtaacccttttttgggtggtgttatctcttttaaggatcaagaaactgaagctcagaggtattaaatgatttgtccaaggccacacaatttataagtcacagatccaggatccttgcttttttttttttgcggggggtgggagacaaagtcttgctctgtcgtccaagctgaagtacagtggcatgatctgggctcactgaaacccccacctcctgtgttcaagtgattctcctgcctcagcctcccgagtcgctgggactacaggcacacaccaccacacccagcaaattttgatatttttagtagagatggggttcccttatgttggccaggctggtgttgaactcctggcctcaagtgatctgcctgcctcggcctcccaaagtgctaggattacagacctgaaccactgcgcctggcctatgttatactcttaattcttgttacttcccatgtcctcttgagtatcagataattttagtactataaagagtcgtgtcttccatgaatttccagggtaattcttaactcttacccctttaaatattgatgctcccccattatctgtattctttcctgcaactcactatgagttgtatagtgaacctcctatttctctttttttttttttttttgagacagggtcttggttgcccaaatgcgagtgcaatggtgcagtcatggcttattgcagcctcttgggatcaagcaatcctcccacctcagcctcctaaataactggaactataggggcacactaccatgcctgcctaatttttttatttttgtagagatggggtctcactatgttgcccagactggtctcaaacacctgagctcaagcaatctttccacctcagccccccatgagcctcctattcctatctccatttgtcagtggttctcaaactatttgtggtgaaagaccagtttgttttaatttccagttaatgtggaccattatttttgtaaaatataagaatgtcacaacaatgttaaattgctgtaaaagtgtctaaatgcttattctcatcttctgtaccatcaaccagtaacagtttgtgaattggcactgtggacaaacttggattagcactgctctgtgtcccttaaccttagtttcataatgtatctttctacactatattctagataattttttcagatctgctttctagttctcttatcttgtgcctaatctatttaatctgttgattttttattaatgactacttttcatttccagaagttatatttggttttttccattataccttctgttcaacatcataccgccttttccttttttctcattaatcatgtaaaaattcttcatttataatcaatttcagatttttttgttatcttcaattctttgggtgctaatctttcaaggtgtattgtgtcttctaactcttttatggtcaattattttgcttttattttttatttgtaaacaacttacctgcaggaagtactctatttctcagagcattatggaagcattttagaaattggcttttgtacttttttggcacttttgttaggtactccagagatttcaccattctaagagctgttattttacattaatttcttgacttggagaatcctgtatcacagagctcgtacattgatctcacacattaagaaactccgtacattccagtctgggcaacagtgtgagaccctgtctcaaaacaacaacaataacaaaagtccttttttttcttgttctttttttaaccctcctgggcaagagatcagcttctttgtggccctcctatgctgatgagcccagacttttaattgcccctttggaaagcaaagcttttacatgcagtgattctcagttttagccccttagattgttcatgctcacatcgaaatctcctgttcttatgtgtttcttaaaactctggttcctatcctgctgagcccaaatctgagtctgatttttcttttcctccatgttatctcttctcaggatttaaattcctttttagaggcacttagagatttctgtttctttcctatgagctttttttttttcttaaccaagtatttctttgttaactccttcatgttgccagaactacatatgtacattttactaaatgttagtttatcttattcataaacaaatttcaacctaatgcttttcagtgaagatctgtcatcgtcttccaggtcctccttacccaagtatctgatgataactgtatttttggctttcaactcaatatagaatcttctccttttatgttctctttcttataaattctaaagatttttttcttattaaatattgaaaaatcttagtttttccttactgcttaactcaaaatagtcttttatcatttgatttctactgaagatttgcttatcttttaagcactctgcaaaatgctgatagcttcttttttttttttttttttgagacagggtctcactctattgcccaggctggagtgcaatggtgtgatctcagctcactgcaaccactgcctcctggcttaagtgatcctcctaccttagcctcctgagtagctggaactataggtgtgagccaccatgctcagcttttttttttttttttgtagaaatggggttttgccatgttacctaggctggtctcgaactcctgagcttgagtaatccgcccatcttggtctcccaaagtgctgggattacaggcatgagtgactgcgcctggcctagtttttcatttttaattggtaggtacagtgatatgacactgtaattccttgtcactcctttgctaggtgtctctcaacccatttgtgtgccctttgaaacttcagttttttgttttttttttttttttgagacggagtcttactctgttgcccaggctggagtgcagtggtgcgatctctgctccctgcaacctctgcccccggggttcaagtgattctcctgcctcagcctcccgagtagctgggtttacaggcgcccgcaactgcacccggctaattttcttttgtacttttagtagagatgaggtttcaccatcttggccaggctggtcttaaactcctgaccttgtgatccacccaccttggcctcccagtgttgggattacaggcgtgagccaccgtgtccagccacttgtctttcagtctgtgtactctatgtatagcattatgaatgaaaagggtcaggttattcttggaatccacaattaaataattgtttagccatttcatgtgtggtattagaaaatatacaatgatctgcccaagggttccaagatggctgaataggaacaactccagtctacaggtcccagcgtgagtgacgcagaagacgggtgatttctgcatttccagctgaggtaccgggttcatctcactgggatttgtcgtacagtgggcgcagcccacagagcatgagccgaagcagggcaggtcatcacctcacccaggaagcgcaaggggtcggggaattccctttcctagctaagggaaactgtgacagatggtacctggaaaactaggacactcccaccctaatactgcgcttttccaacagtcttagcaaacaacacaccaggagattatatcctgcgcctggcttggagggtcccacacccatggaacctcacccactgctagcacagcagtctgagatgaaactacaaggcggcagcaaggctgagggaggggcatccgccattgctgaggcttgagtaggtaaacaaagtggccgggaagctcgaactgggtggagcccactgcagctcaaggaggcctgcttgttgctgtagactcccctctgggggcagggcatagctgaacaaaaggcagcagaaacttctgcagacttaaacctccctgtctgaaagctttgaagagagtagtggtcctcccagaatggagtttgagatctgagaacagacagactgcctcctcaagtgggtccctgacccctgagtagcctaactgggagagacctcccagtaggggccgattgacacctcatacgtccgggtgcccctctgagacgaagcttccagaggaacaatcaggcagcaatgtttgccattctgcaatatttgcagttctgcagcctctgctggtgatacccaggcaaagagggtctggagtggacctccagcaaactccaacagacctgcagctgagggtcctgactgatagaaggaaaactaacaaacagaaaggacattcacaccaaaaccgcatctgtacgtcaccatcaccaaagaccaaaggtagataaacccacaaagatggggagaaaccagagcagaaaagctgaaaattctacaaatcaagagtgcctcttctcctccaaaggaatgcagctcctcgccagcaacggaagaaagctggatggagaatgacgagttgagagaagaaggcttcagatgattggtaataacaaacttctccgagctaaaggaggatactggcaaactgaatccagcagcacatcaaaaagcttatccaccacgatcaagtcagctttctccctgggatgcaaggctgattcaacataccttgaatcaataaatgtaatccatcacatacagaaccaacgacaaaaacttatgattatctcaatagatgcagaaaaggccttcagcaaaattcaacagttcttcatgctaaaaactcaataaactaggtattgatggaatgtatctcaaaataatagctatttatgacaaacccacagccaatatcatactgaatgggcaaaatctggaagaattccctttgaaaactggcacaagacagggataccttctctcaccactcctcttcaacatagtgttggaagctctggccagggcagtcaggcaagagaaggaaataaagggtattcagttaggaaaagaggaagtcaaattgtccctgtttgcacatgtcatgattgtttatttagaaaaccccatcatatcatcccaaaatctccttaagcagataagcaacttcagcaaagtctctggatacaaaatcaatgtgcaaaaatcacaagcattcctatacaccaacaacacacagagagccaaatcatgagtgaactcccattcacaattgcttcaaagagaataaaatacctaggaatacaacttacaagggatgtgaaggacctcttcaaggagaaccacaaaccaccactcaatgaaataaaagaggacacaaacaagtggaagaacattccatgctcatgggtaggaagaatcaatatcgtgaaaatggccatattgcccaaggtaatttatagattcagtgccatccccttcaagctaccaatgactttcttcacagaattggaaaaaactactttaaagttcatatggaaccaaaaaagcccacattgcccagacaatcctaagccaaaacaacaaagatggatgcatcatgctacctgacttcaaactatactacaaggctacagtaaccaaaacagcatggtactggtaccaaaacagatatatagacaaatggaacagaatagagcccttggaaataataccacatgtctacaaccatctgatctttgacaaacctgacaaacacaagaaatgggggaaggattccctatttaataaatggtgctgggaaaactggctagccatatgtagaaagctgaaactggatcccttccttaccttatataaaaattaattcaagatggattaaagacttaaatgttagacctaaaaccataagaaccctagaagaaaacctaggcagtaccattcaggacatagacatgggcaaggacttcatgtctaaaacaccagaagcaatggaaacaaaagccaaaattgacaattgggatctaattaaactcaagagtttctgcacagcaaaagaaactaccatcagagtgaacaggcaacctacagaatgggagaaaatttttataatctacccatctgacaaagggctaatatccagaatctacaatgaactcaaacaaatttacaagaaaaaaatcaaccctatcaaaaagtgggtgaaggatatgaacagacacttctcaaaagaagacatttatgcatccaacagacacatgaaaaaatgctcatcatcactggccatcagagaaatgcaaatcaaaaccacaatgagataccatctcatatcatttagaatggcaatcattaaaaagtcaggaaacaacaggtgctggagaggatgtggagaaataggaatacttttacactgttggtgggactgtaaactagttcaaccattgtggaagacagtgtggcaatttctcaaggatctagaactagaaatgccatttgacccagcaatcccattactgggtatatacccaaaggattataaatcatgctgctataaagacttctatgaccaaagatgtaggaggatttcccacccacaccaagcaacagacactagctgggtatcctccaacttagttctgacactacctacccagagatagcatcagatcccacaggcttagtctcacaagactgccccttcttttcccctagttgcaagtcctggactccagaacttctggctgactggcttcaagttggggttcccatgacctcatctgtgaattccagtaatttgctaaagcagctcacagaactcagggaaacacatttaccagtttattaggaaggatatctaatttttttactttttttttaattattatttttttcatacagagtctccctcttgttgcccaggctggagtgtaatggcgtaatcttggctcactgcaacctctgcctcctgggttcaattgattctcctccctcagcctcccacatagctgggattacaggcacctgccaccatgcctggcctttttttgtttgtttgttttttaagtagagacagggtttcatcatgttggccaggctggtctcaaactcctgacctcaggtgatccacccaccttggcgtcccaaagtgctgggattacaggtgtgagccaccacgcccagccaggaaggatattttaaaggatacagatgaagagatgtgcagggtaaggtatgagggaagatgcatatggcttccatgctctccctgggaatctcaccctgtaggaacctctggaagctctccaaaccctgtcctcttgagaggtgaagccagctggacttcctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgtgtaaaaatgcacgaatcagcgctctgtgtctagctaaaggattgtaaatgcaccagtcagcactctgtaaaatggaccaaccagcactctgtaaaatggaccaatcagcaggatatgggtggggacaaataagggaataaaaactggccaccccagcctgcagcggcaacctgctttggtccctttccacgctgtggaagctttgttcttttgctcttcacaataaatcttgctgctgcttactctttgggtccacaccacctttaagagctgtaacacttgccacggaggtccgcggcttcattcctgaagtcagcaagaccacgaacccactggaaggaagaaactctggacacatctgaaggaacaaactccagacacaccatctttaagagctgtaacaccgcgaaggtctgtggcttcattcttgaagtcagcaagaccaagaacccactggaaggaaccaactctggacacactcttgggtgttcatggaggcttcattacataggcatgattaattaaaccattggtcattgatgatttaacttgacttgtagcccctctcccctccctggaggttgtagggttggggctgaaactcccaaccctctaatcctgccatcgtctttccagtgaccagcaccacgctgaacctagcagacaaaagacagcacgttggagatcccaaggaatttaggagttgtatgccagggaacaggaacatatttccatcctataacatatcttggccatataactaactcatagagcacttactatcccttattgaaagtatttgttttatgtcttctatttaattctgagcctctagagtctaagaagcatcttttagttgtcctttcctctgtcttggtatctgatacagtgccacattatttttctctatctgtagcaactttctttttttttttttttttttttttgagacagagttttgcttttgttgcccaggctggagtgcaatggtgtgatcttggctcaccacaacctccacctcccaggtttaagcgattcttctgcctcagcctcctgagtagctggtattacaagcatgtgccaccatgcctggctaattttgtatttttagtagagacggggtttatccatgttggtcaggctcgtctcaaactcccaacctcaggtgatctgcccgcctcggcctctcaaagtgctgggattacaggtgtaagcccctgtgcccagccagcaatttcttctagaaagtcccagcagaggctgggtatggtgaatcacacctgtaatcctagcattttgggaggccgaggtgggtggatcccttgagcccaggagtttgagaacagcctggaacagcctgggcaacatagggagggacctcatctctatttaaaaagaaaaaaaagaggccgagtgcggtggctcacacctgtaatcctagcactttgggaggctgaggcgggtggatcacctgcgatcaggagtttgagcagcctggccaacatggtgaaaccctgtctctactaaaaatacaaaaaaaaaaaaaaaaaaagcctggtgtggtggcacacgcccagctactcgggaggctgaggcaggaaaatcgcttgaacctggggggcagaggttgcagtgagccgataacgcaccacttcaccccagcctgggcaaaagagtgaaactttgtctcagaaaaaaaaaaagtcccagctactttgggggctgaggcgggagggtcgttgaggctgcagtgatctgagatcatgccattgcattccagcctggaaaacaaagtgagaccctgtctcaaaaaaaaaaaaaaaaaaaaaaaaaaaaaaaaaaaatcaggcaaactgaaattgaaggacattttacataaaataaccaatcaacattcttcagaagtgcaaagacgtaaaagataaggaaggattgaggaattataatagcctgggaaagaataagaagaaataactaaattcaacgtataatggtggaaaaagaacattagtagaaaacttgaccagatttgagtaaggcttatagtttagttgttaatactataccagtgttaatgtcctgttctcgatcatggcactatggtttggtaatatgttaacattagaggaagctgggtgtaacttctataaacctaaaattcgttaatgaaaagtttaaaaaataaaaaggtcaggcacagtggctcacgcctgtaatctcagcactttgagaggcctaagtaggaggattgcttgaggccaggagttgcagaccagcctgggcaacatagcaagaccccgtcactataaaaatgaaaaagccccaggaaaaaacttttaagttttctcaataaatatcctttaatttttttctttttaattctagcaccaagcaatatcatttatgctggctgaaatggcaatgaaagttgaactagctagaatgagttaccagagagcagcttgggaggttgattctggtcgtcgaaatacctattatgcttctattgcaaaggcatttgctggagatattgcaaatcagttagctactgatgctgtgcagatacttggaggcaatggatttaatacagaatatcctgtagaaaaactaatgagggatgccaaaatctatcaggtaaggttaaagatgatttttttggtttgcaaggagagagaatattcataaatgacaacgtggatttctgattatttagaaattttatgtccctagtagcaataaatgactgtcatatatggctgtgagccagtttttggaattaattaatagaaagaagaatgttatttgtgattaagtataagtctgaagagagaataggctaaaaaaaatggtacagacatgtgtattacgtttggattagatttctttgagttttaacagattggctaattgtaacccaaacttttctctccaaaaagtatgcatgtcatttaaaattaattattttgatttgaatcttgcctgacaactatttaatttattgtaactatacttggagtcaaaaaccaacatcaggagacagtgatgtagattaattccaaattaaattggtagtcaaaaaaacttaggaggaattcagtaaaaggaaatataaatgtgcatgttctctacatgtggcttaagtaattacttaataattaccacattcttgctcctcagtatctcttcccttgttccccctacacctagcaaattatttgactcatccagtcattggaaatactgagttcgaatcaaaatgctggagtgagaaggaatgttacacgtagtgcagcctctccatgtagacatgaaaaaactgaggtccagaatttgtgccttatccaaagtcacaggtttatgtggtgatactcttcctctcctagagcctttaattataattattactattattatcatcaacagtttagcttttctctgccatctgagaagatgaactaacgaatggctaaagttagaagtttagaatggaaataaggtctgactcttgaaatccttccagcatctttttctttagcaactctgttccacaggcagtgggagaaaaaaaaaaaattaagggtaagaataaaagactgaaggagacagctagctaagaacagttcagaaaattagacaaatattttggccacattaaactttagttttcccaaactttctgaaatgtaaatatcttttctttttttatattttgaagactcttctccaaaattttgataaatggctttttataataacttaaccaatctttagagaattccatattttcagactttcacaaaatcaggttttggaatctgtagaggctacagaccctatatatggtttgattcggttttatattacaacacagcttatgctactgtctaaaatgttgaataaatcaaagtatttatgtactaaagatatttaacctacacttatatttttcttgcagatttatgaaggtacttcacaaattcaaagacttattgtagcccgtgaacacattgacaagtacaaaaattaaaaaaattactgtagaaatattgaataactagaacacaagccactgtttcagctccagaaaaaagaaagggctttaacgttttttccagtgaaaacaaatcctcttatattaaatctaagcaactgcttattatagtagtttatacttttgcttaactctgttatgtctcttaagcaggtttggtttttattaaaatgatgtgttttctttagtaccactttacttgaattacattaacctagaaaactacataggttattttgatctcttaagattaatgtagcagaaatttcttggaattttatttttgtaatgacagaaaagtgggcttagaaagtattcaagatgttacaaaatttacatttagaaaatattgtagtatttgaatactgtcaacttgacagtaactttgtagacttaatggtattattaaagttctttttattgcagtttggaaagcatttgtgaaactttctgtttggcacagaaacagtcaaaattttgacattcatattctcctattttacagctacaagaactttcttgaaaatcttatttaattctgagcccatatttcacttaccttatttaaaataaatcaataaagcttgccttaaattatttttatatgactgttggtctctaggtagcctttggtctattgtacacaatctcatttcatatgtttgcattttggcaaagaacttaataaaattgttcagtgcttattatcatatctttctgtattttttccaggaaatttcattacttcgtgtaatagtgtatatttcttgtatttactatgatgaaaaaaggtcgttttaattttgaattgaataaagttacctgttcattttttattagatattttaaagacctcagaaaatataaatatgaaataatttaagaacccaaatctctgaatttaatatttctttgtaattctaaatatcgaatactgctaaactgtgttatactaaatggagtgctttctgacatcacatctcattctctagttctttgacatcaactgtgtcctacattttaattctgttctgacactatgcagcagagttagggtcaaccccataaggctgccctcacttcagaggccagtcacaagtcctgactccccaagctacccatactctgtccaacatggctacaaattcaggtattcccatgaccctgccctcagggtcgataatttgccagaatagctcacagaactcaggaaaacacttaacttacatttacctgtttatatcagaaagggtacaactaggaacaattaatgaagaggtgcatagggaaaggtatggagggagaagggaggtgcagagcttccatgccttcttccagcatattaccttccctgcatgtctctgtattcctcaacgtggaagctccccagctcaaattcaatagtttccatggagctcaatctccagtcctccactcctccccagaggaccaaggtgaaagctggaagctcccaactgtattagtctcctagggctgtcataaaaaatacactggagacttggtagcttaaataaatttattttctcacagttctggaagctagaatttcaagatcaaggtgccatttgggttgtttctagtgaggcctctcttcctgccttatagactgccaccttctgtgtccttacatgtcctcttctctgtgcatcatgaagggttgggttagggggagctcttgtgtctttttctcctcttctaaggacactagccctgtgagattagagtcctatcctcatgaccttaattaactccctaaaagatcctatcttcaagtacagtcacattgggagttaaggcttcaacataggaattttggagggacacaactcagtccataacatcaccctctaattacttagtccttctggtgaccagattcctcctgagattatctaggggccccaccctaagtcatctcatgccaaattcaggtatgattgaaaaggtttataaggaataacagaagataactccaagaactcaagaaattccaagggttttaggagctctgtgccaggaacaaagacctgggaacaaagaccaaataaatttcttataccacattaaattaccaaaataatcgaatttcttacaaatataaaatatttaaatgacatttccttcatgctcaatgatgaaattttatttaaatgatacaacttgagattggtaaggagatttagagaattcttaattgggtattatgtagaaatgagaagttaaatagaatgtatatatttcaaatgcaaatttgaatttgcagtacagaggcccaaccatttctaaacataaagcttctagacatgggctgggcatggtggctcgtgcctataatcccaacactttgggaggttctgaggtgggaggatcactgagggcaggaatttgaggcttcagtgaactgtgatggcaccatttatactccatcctgggtgacagagtgagaccctaaaaagaaaaaaaaggtccaggcaaggtggctcatgcctgtaatcccagcactttgggatgccgaggcgggcagatcacaaggtcaggagtttgagaccagcctggccaacataatgaaacccggtctctactaaaaatacaaaaaattagccgggcgtggtggtgagcacctgtaattcgagctacttaggaggtgaggcaggagaaacgcttgaacccgggaggccgaggttgcagtga

SEQ ID NO: 13580 - DNA, 11200 bp, Human
caggacccagcgcaatcccagtgatagtaggcatggggtgtttgtgtcaccccactcccagctccaggtagctcagcagagagagagagacagagacagagagagagagagagagagagagagagaggggagagagagactgactctgtttgagagaaagcaagggaagagagcaagagtctctgcctggtaatccagataaatcttctggatcttatctaagaccactaagatagtacctctatgagtttgcaagaaccacagcattaatgggcttggggagccccctaatgcagacatggcttagatcacaacacccaagtacttttgaatacctggaaagcctccccaaaaaggacaggtacaaacaagccttgtctgcaaagactacaataaatacctaacatggccaggcatggtggctcatgtctaatcccagcattttgggaggctgaagcaggaagatcacctgaggtcaggagtttgagaccaggctagacaacatggtgaaaccctgtctcttctaaaaatacaaaaattagctgggtgtaggctgggtgcggtggctcatgcctgtaatcccagcactttgggaggccgaggcaggtggatcacctgaggtcaggagttcgagaccagcctgaccaatatgatgaaaccctgtctttactaaaaatacaaaaactagctggcatgcgcctataatcccagctacttgggaggctgagacaggacaatcgcttgaactcaggaggcagaggttgcagtgagccaagatggcgccattacactccagcctaggcaataagagtgaaactccatctcaaaaaaaaaaaaaaatttagccagggtggtatcgggtgcctgtagtcccagctactcgggaggctgaggcagaattacttgcacctgggaggcagaggttgcagtgagctgagatcacaccattgcactgcagcttgggcaacaagagcaaaactccatctaaataaataaataaataaataaataaataaataaataaataactcatcaatgcccagccaccaatgaacatctataagcatcaaggccatccagaataaatgaccttaccaaacaaatcaaataagccaccaaggaccaatccttgaagaaacagagatatgtgacctttccgacagagaatttaaaatagctgttttgaggaaactcaaagaaattcaagctaacacacagaaggaattcagattccatcacataaatttaacaaagagattgaaataattgagaatcagctgggtgcagtggctcacgcctgtaatcccagcactttaggaggctgaggcgggcggatcacctgaggtcgggagttctagaccagcctgaccaacatggagaaaccctgtctctactaaaactacaaaattagtggggcgtggttgcgcatgcctgtaatcccagcctgggcaacaagagtgaaactcggtctcaaaaaaaaaaaaaccaaaaaacaaaaacaaaaacaaacaaacaaaaaacaatacccaatgatctgttgtcaacaagaaacatacttcacctacaaataaaacagtaagagactgggtcctgaaatgcgggcccacttcatatgtgagggcaggtgtctaatcatgtcctttctcccttcccccaggcccttcacagatacctgctggtctctcccacttggccaaggaaacacttgtggttaataagtctcagaaaagttatgtgaaagttaaaagtaaaactgacagcagctgaaggatgggggggtgggaggtggtgacggtggaggagaccccaccaccactgccacccaagtagggagtgaggagcaccaggagcacaggatgctacttctgccaaccctacaaaaatactctgcacaaatcttcaaaaaacatccttgtcccactgcgtcacctgcggacagatttcatgtcctggtctccttctaaacctggaggtggggcatgaacagggtggagtcacaggggaaagaaaatgaggccccaggacacctgggttcacacccaggtccccagcgatgtctccaccaccgctgctgcaacccctgctgctgctgctgcctctgctgaatgtggagccttccggggccacactgatccggtatggtgaccccatctaccaccccaaccttaggagggattctctgcctcttgccctttaagtctaggactcccagttcagtgatccccaaacttggcacccaggatccctagagcttctttctcagctttccagatctctaaaccaggctgtcacccctaagggctccactctgacatctcttaagaccagatttcttttttttgagatggagtctcactctgttgcccaggctggagtgcaatggcatgatctcagctcactgaaacctctgcctcctgggttcaagcgattctcctgcctcagcttcccaagtagctgggattacaggctcgcgccaccatgctcagctaatttttgtatttttagtagagacggggtttcaccatgttggccaggctggtctggaacccctgacctcgtgatccgctcacctcggcctcccaaagtgctgggattacaggcgtgagccaccgcgcctggctgaccagagcccttttattattattattattattattattatttattattattattattatttgagacagagtcttgctctgttacccaggctggagtgcagtggggcgatctcagctcactgcaacctctgcctcccgggttcaagtgattctcctgcctcagcctcccaagtagctgggactacaggcacatgccaccacgcccggctaatttttgtatttttagtagagatggggtttcgccatgtttgccaggctgtcttgaactcctgacctcaagtgatctttccgcctcagcctccaaaagtgctgtggttacagctgtgagcccccgcgtccggtcccagagcccttttaagtcccagatcttacaacactgagactctagattgaggacccctccccctcctctcaggactttttttttttttttttttttgagactgagtctcactctgttgcccaggctggagtgcagtggcgcaatcttggctcactgcaagctctgtcccccgggttcacatcattctcctgcctcagcctcccaagcagctgggactacaggcacccgccaccacgcccggctaattttttgtatttttagtagagatggggtttcacagtgttagccaggatggtctcgatctcctgacctcgtgatccacccacctcagcctcgcaaagtgctgggattacaggcgtaagccaccgcgcctggcctttttttttttttttttttgagacggagtcttgccctgtcgcccaggctggagtgcaatggcgcgatctcagctcactgcaacctccacctcccaggctgacaccattctcctgcctctgaaagtgctgggattacaggcgtgagtcaccatgcccggctaattttttttgtatctttagtagagatgaggtttcaccatgttggccaagctggtcttgaactcctgacttcgtgatctgcctgcctcagcctcccaaagtgctgggattacaggcgtgagccactgcgcctggccaggacatgtttttgagaggtctctgcagaccctactatgagctctgatgattaggtactgtggtttccagacctgtgacacactcctcccatcttcgagccccagatatgtgacatttaaactgagactcccccacatcacgcccatcaaactggcctgaagaagtcatgtttttggccagagacatggctcacacctgtaacccagcactttggaagtccaaggtgggaagcttgtttgaggccaagagttttgagaccagcctgggcaacatggccagactccacctctacaaaaaatacaaaaattagctcagtgtggtggtgcacacccatggtcccagctagttcaggagggtgaggaaggaggattgcttgagcccagtagttcgagggggcagtgggctatgatcctgctactgcactccaggctgggcaacagggtgacaccttgtctaaaaaaaaaattaataaataaaataaaataaaataaaaagccaggtgtggtggtgtgcccatagtctcagctactccagaggctgaggtgggagaatcacttgagccctggagatcaaggctgcagtgagccctgactgcactactgcactccagcctgggtgacagagggagaccctgtttcaaataaaaagtttaaaagaagaaaaagaaatccaatcttggggaccctatgcaagaagtcttcccactaccttacctctgatgtcccctccccgcccccatctctctttttctcctctcttgtcttcattccctggaactcttggtagggggaggggtgtacacttccaggaagagttttccccacttcacattctcgtgcctctcaaagactgactcatggggggtgacgggaaaggtgtgagtgatgtgacaagtgcttcaaggagtgactaaaggcaggaacgaagatattaccgcacatggtgcttgttaacctgctttttgaacctaatgtctcatggccattttctaagtcaatgcaaagaaaatgagtctccaaatgttgtatcaacagcatcgtcatgacctgggaacttgttagaaatccaaattctcggctccatcctagacctacttaattagcaactaagatacctgaattgtaattggccctctaagtcaagggttgcaaacactcagcttaagggccaaatcctgtttgcctcctgcttttgcaaatacagtttaaaggaacccggacagggcatagtggctctcctctgtaatcccagcactttaggaggctgaggccaggagtttgagatcagcacgggcaacacagcaagacaattaagatttgacgcttacatttttctcctcaagggtggggaaaatagtccctaacctcacgaactgaagcatgcaggggccaccacccaagggcttttgcaaaggttaggttttctgttagggtcttgggaaatctttaagaatgtcaattccttgggaatagcttattttaagggatttggacatggaaaggtctgtttgggatggtttgctcttgtaaagtctttggggatatttgtcatcatggcatctttgatgggcttttctggaggttgttattgcagggtttctggtactgactactattgtagtgccttggagatgttgaatttgtcatcatatcctatttgggtaagtctatttagaggttctccaagaagggcagcttcctgtcaatatcctctttccctacagcatccctcttcatcgagtccaacctggacgcaggatcctgaacctactgaggggatggagagaaccagcagagctccccaagttgggggccccatcccctggggacaagcccatcttcgtacctctctcgaactacagggatgtgagtcacagccccacacagccctcacccctgcgcccttgagccaaactcttcgtttactctcctcttttgctatcaggtgcagtattttggggaaattgggctgggaacgcctccacaaaacttcactgttgcctttgacactggctcctccaatctctgggtcccgtccaggagatgccacttcttcagtgtgccctgctgtgagcttctatgtgggagaataaggctgaatgggggtgaagggaggaggcggggctggacctcagcttctcagaggcttttgaggaactgttcttttatcatgccctcacaggtcagaaagtcaaaggggcagtaggcactggggagattccctcccccatgacacctttctgacctctaacctagggttacaccaccgatttgatcccaaagcctctagctccttccaggccaatgggaccaagtttgccattcaatatggaactgggcgggtagatggaatcctgagcgaggacaagctgactgtgagtggcctttgactctcagaagtcttgagcctgggagaaccccattgtctaagatcatctggcttaggaagaggctcgaggaggagcttcccaagccaatggatggggcttttcaagtggggaggagggcctgcctttcagagtgaagggatggtgcgtcacaaggagggggaggggcttcctgggtgaagaggtggggcttctcaagcaggggggaggagcttccaaggttaagaggtggggcttctcaagcagggaggaggagcttcctgggtgaagaggtggggcttctcaagcaggggaggagcttcctgggtgaagaggtggggcttctcaaggagaagaaaggggttcctgggtgaaggggtggggcttctcaagaggcatagtttcctaggaagttggggcttgcatccagaagtccccagacctaggattcatgccttggtttgggagacctcaggacatgtggttattgtcctcccaaaagtaactggtcacatctcaatctacccctagattggtggaatcaagggtgcatcagtgattttcggggaggctctctgggagcccagcctggtcttcgcttttgcccattttgatgggatattgggcctcggttttcccattctgtctgtggaaggagttcggcccccgatggatgtactggtggagcaggggctattggataagcctgtcttctccttttacctcaacaggtactgggaagtgtgcacctatctatgagtcctatccccaagaaggaagagagtcttccttcaggaagtcactgacccaatgcaggaattctcattctcagagtcacccacttacactgtccattcaggaagtcagccattcaatacaagaagttgcatcctccatgcaggaagtcacctgccctataaagaaacacctcaaccctattcgaagtcccagagcttaaatgacaacttaagacatactaaggaaacccaccatcagttcagaatgctccatgtttcaaaatcaaactaggaaattccatgccccacccaacaaaatactcaggagctttctcttcctcacaaagaatgctcaaatcccatttgagaacactgaccagaagtcaggaattgcccgatttaatccaggaagtcccactcacctgctaggaagttcagtattatgctcagaagtcccacccaacatccaagaagtttccaagaagtctccactttccctcccagaggcctgtcacacacagtcagaaaatcctatgcccactcagttaccctgacatccaacccactctagcagttctaccaaccacctagcagatcctgctctcctccaccttccaggaagtctccatccctgttcccatcgctctcagccaactcaggaagtctaacacctctctagatatcacaacaggcaattcagaaattctcttctcctactcaggaagccaccccacccctgcacaagtcacaccttcaagagccaattccaagacaccactgctctacttggttactatgatattcagctcaggaaattccccaaaactctaccttccacagccaaatgaagtctcgtcttcacttcaggaagttctagcttccaccaagaaaagcatcatgcttttcttgcccggcttccagtcccaacatctaggcccttcctgcatcccattaccccgtaggaactccagaaacaacccagttggtgggaagtgccattcctggcaatacctagggctgagggagggccagtgacactgacatctacactctctacactctgcccctgcagggaccctgaagagcctgatggaggagagctggtcctggggggctcggacccggcacactacatcccacccctcaccttcgtgccagtcacggtccccgcctactggcagatccacatggagcggtgagggacttggtctcctggctctggagctggaggctgggggcctggactcctaggaccctgcctctgatgactgcctccttccccctcagtgtgaaggtgggcccagggctgactctctgtgccaagggctgtgctgccatcctggatacgggcacgtccctcatcacaggacccactgaggagatccgggccctgcatgcagccattgggggaatccccttgctggctggggaggtgaggtcccagtctggtgggtacgggctgggaaggctgatggcagtttgacagtgaacatcaaagggcctgagggtgggaggcaagtatttaaggggctttccagggcagcaggcactggacttcgtgacagatagtctggagggtggtggaggaattgaggacactttccacgtgtctacactgcgactctgcggatggtggccgggtggagggagacgatcatgcaggtttgcttgggactgcgtaagtctaggcggcagggcctctgcacacaggacgctgagtacccaggtgctcaatagggaaattaccctatggcactggggagccacggaagggactgaacagagcaggaatctctcatcttcactagttcctcttctcccccagtacatcatcctgtgctcggaaatcccaaagctccccgcagtctccttccttcttgggggggtctggtttaacctcacggcccatgattacgtcatccaggtaggtggccatcaccatgacgccatagtgacgtcatatgacggtttgagagggtagagctgagagacgtcactaggaagggaaggggccacagaaacatttcttttccctgtgatggcagtttgttggcgaacatcaaagaacccgagggtgggggggatggacgggctcccaggcaaatggccgtccttgtggccgcgacacccagttgtcgtcttgttgccttgcagactactcgaaatggcgtccgcctctgcttgtccggtttccaggccctggatgtccctccgcctgcagggcccttctggatcctcggtgacgtcttcttggggacgtatgtggccgtcttcgaccgcggggacatgaagagcagcgcccgggtgggcctggcgcgcgctcgcactcgcggagcggacctcggatggggagagactgcgcaggcgcagttccccgggtgacgcccaagtgaagcgcatgcgcagcgggtggtcgcggaggtcctgctacccagtaaaaatccactatttccattgagcgaacctgcctgggttgcttcttttcagagcgtactttttaacgagaaagctttgtgaccgggcgcggtgtctcacgcccgtaatcccagaactttgggaggtcgaggcgggtggatcacctgaggtcaggagttcgagaccaacctggccaacatggtgaaaccccgtctctactaaaaatacaaaaaaaattatccgggagtggtggcgcatgcctgtaatcccagctactcgggaggctgaggcaggcgaatggcttgaacttgggaggccgaggttgcagtgagccaagaccgcaccattgcactccagcctgggcaacaacgaaactccatctcaaaaataataatagaaaactttgtgcctgtacccatggagttgaggaagagggaggcgaagggtatcaccccttttctccaggacgcaccctggtgaggggttttgtaatacgagtcccatgaagcccctcgcctacgctaccttccgtcaaaagctcccggcgccgtggagcatcacggtcgttgtaatccacgccgtggtcacgccctgacgggggcgggcgcagccacaacatgggtgggaggcgacaggttgcgacggcagcgacaggtggcagtgggggttggccgtaattggtaagggtttaccagttcctgttcaagggggcaaggataccattcccccggatctcatctcctgtttctcctctctccctccggattcctagacccctggggagctcgaggcccccgggttcggggagcggtgctgccccacccgcggaggtgacgtcactctcccctcctcagcctcttgctacccagaactaaatgattcgacaaaacgaccggtcgaaaaatctggcaatcctttaatcgcatcccgaggcttctggaagaattgtgttgagcgattctggggaccccgaaaagagtcaggcctgagccccatctcgagagtgtgctgctctgatggtggaggccgacctgatcacaaaccgctaaactactaaacacggggagattcaggtcccagtaagctcgggcaggagagtcagggaggaagcctctgttctgctccttttcccgtgggatgcagagagcgagcaagtcggcattccaggccggtgggaaccgctagggcggaagcagggaagctagaaagagcctggtgttccaggggtccagctctagaaacgggtggcggctgggaaaacaggcccacacctccaccttgtggccaattgggaatttgcaggcacggcctctcagaaactacttaagggcgctttgggtgaagttggatggggtgctgcagacggaaagcatgaggggcgagttgaaagggcccagatcgagtgctctgactgagaaaaacaaagcgggggtggtggtggtggtggtgagagttatcatagagacactgtccactgtttcagaaaaattccccagagcaaggagtgcacaaagtggatctttactattattattattattttattattgttattattattgagacagggactcactctgtcgcccaagctggagtgcagtggcgcggtaatggctcactgtagcctcgaactccccggagaaagcgatcctcctgcctcagcctcacgtgtagccgggaccacaggcgtgggccaccatgcttgactaatttttaaatattttgtggagattttttttttttgagagggagttttgctcttgttgcccaggctggagtgcagtggcaccatcttggctcactgcaacctctgcctcctgggttccagcgattctcctgcctcaacctcccgagtagctgggattacaggcatgtgccaccacgcccggctaatttttgtatttttagtagggacggggtttctctatgttggtcaggccagtcttgaactccagacctcaggtggtccgcccgccttggcctcccaaagtgctgggattacaggtgtgagccaccacgcccggtggagacggggttttgccatg

SEQ ID NO: 13581 - DNA, 6384 bp, Human
ccccacatacgcattatttcttgaggtctgtagctcctggtgaggggccccaggttcccgatgggcacctgagaggcccaggctctgaggcagggagcagtctgcccaaggtcacagtgccctcgatgtaccaggatttcttggaaaacggaaggctggaggcactgatttccaaggcccctcctggggctcccggcagccgagggcagatgccctgctcttggagccagaaaccttggctagctgccgccacactggtgacctccagcaggctatgctgtttcagagcctcggtctcctcctttgaagagcaggcccagtgatccttggctggtgtgccccatgcttgttggcaccaccagccaggcctgggcgggaaaagccctgcatgactcatgggcctgacatagaggggcatggcatggcattgttcttccttgcctccaagcctctctcccactgccctcaccacctctacctaccctgccaccaccaccctgggaacttgggtgccagcaaaccaaagaggtgaagcttccaggcctttgaccccaccaggaacggctaccctctcgcccactcaacaggttgattgaacacctactatgtgctaggtaggccttgtgctaggagatgcatcagtgcataaaaatccctgctttcattggcagggaacagacataaacaaacaagatcatgccagtcttgattataccaaaaagatgaaatggggcattttaataaagtaacttgcggaatagataaggtggttggggaagacctcctggagctgagacctcgatgatgagaaggagctggggaaagaggcttctagaaggaggaaagggctagtgcaaatgctctgaggttgtaatcagcttagtatttggggatgagccaagaggccagggaaggtggaggctgggggtgggtgaagggagtgggggtgatgaggctgcagaggtgcaaagggttcttccttcccagcccccagcatggtaggctgcgctgaggactgaggcccgggcttggcttccctcctgcttatgatgggaaggtgggggagcaggggagtggggagtgatgtgatctgatttatggtttggaaggattgctttggctgcggcaagcagccgggattggaggggctcaggaggaaggagggggagggcgagactgcagtggtccaggctgaaatgaggtggcttgctgaatgctcagagctccttgagcacacaacctagcgtctgtcgatttcacctcctggagaaaccttccctgactgctccgccagactcctcaccctctcccatctccagccccctcatccccggagctatctggctgctggtctgcaagcagctggagtccccagcatcacccagcccacagcctggcctgcaggaggcttctagtaaagtggccaattaatccccgagccccgtcttccagggtcatgcacacagtcacacgcgtgctcttcacatgtgtcaccctgcccccacacacactcacttggatctccagacaagggcttggagggtaggatgggcaatctagggggcaggaggggccctggagtctcctccattgagtgtgcaggcgatggtggccacagggtaataacaacctcagcgagatcctgaggtctgcccctccttaggaatggccaggcagggaagaagggagcagtgctcggtcccagcatcccaccactgccgagatggttctgagcgggttcctgggctgaggccggggcctgtgttttccaagattccttggagagccagctccatcctcttcctgattatctgatctttgggctacagcagaaggaaagagcagggcggaagcgagctctggaaagtggaaagaggagggtgtgcgaggagacccaaggcgggatctaggctttggaacgttggaggtttccggccacagaggcagggcctccggggagccaagaggggcggggagagacacacagagagaagcagaggagaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaaggtgagctctggagtgtcagggagctatgggtggtgaactgtgggtctgggagggggtattgcaaggttagggaaatggacaatgaggagcgattgggatagtctcagaggagtgggagggtgatgggctcagagacaggactcaggcagcagagaatgagttatgagttggaaaggggtgaatggggcatcttggtggcaggctggggctcaccacccctcccctgccccagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatccgtgagtaaccagaagccctcacccccaaactcctaggccgccgcggtcactttcgcaaaaatgaagggtcggttcactgccaagtggcctttcagttgtccattgcccagcccagagcccccacacccctaggagccccaggtccacggccatgcctcctaaaggcctgggccactcgaccctaccttccaggagtccggggtgccccccccaccgccaccccgccctcaggagccctagatcccagttctccaggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcccggccgcttggcagggtgcagtccgcggcgcgcggggtggcacaccccctgcagcactcatctgggcccagccatgggcactggttgcaccaggtgcaccctaggtgtccggggcgggcagcagttcgggcagcagctgctgtgtgctcacggcacggggttcgcgcagctgggcggctgcacatgccgggcgcgggtgggcactccagacccgcgcggcacccgcactggggccgcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgaaaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaaggcagtcttggactttatctcctgcaggggaagccgggaagggccagaccctggtctttgggcgcgtgtcctggcctttggatgcctgttctgctttttacagatgtcatttgagccccagatggagtgatggagaaacacaggtgcatatgtacacacggtcatctgttctgtgcacagatggccggagtacacgcgtacaaacgctgtagacaccttcacctccatcgtgccctctctctcggcctttgggacccagggcctgccagttgtcccaggccttggtcttggtcctggtcaaagagatttgggaaacgtgaaggggctaaaggctctgacaagtccggcaggaaagagcccgtttaatttgtttaagtggcgtgtccaatttgtttccccagatgatatggtttcatggacttgttgggatgatatattgagacatggacttaaggactcacccaaccctgaagcttagacttcctcccaattttccctcctctgcttcctgccaatgaggccaggagccagtcccttcccctctgtgagcctcgggtttttcatctgaacgtgggcacaatccctcctactttgtgcggctcttgggatgttcaggtgagaccaggacagtgtgcatttggtggtggctgaacttgagccacacactaccttccgtcctcacctttttttttccttttttgagacacggtcttgctctttcgcccaggctggagtgcagtggtacaatcatggcttactgcagcctcaatcttctgggttcaagcagtcctcccaccttagccccccaagtagctgggactacaggcacgccccaccacacctggctaatttttgtatttttttatagaggttggttttcgccacgttgctcaggctggtcttgaactcctgagctcaagcaatctgccctcctgggcctcccaaagggctgggaatacaggcatgagccacagtgcctggctctccctcaccatttttcatacctttactccctgggggcagtgaagacacccaggagtccgccagccggggcctcagcatagtggccagctctgtctagaggagaggctctttggaaatcaccctagtacctcccccaaggttggcatcatgggcgtgaccctgacatcagggagcctaggaatggggatgtgaccctgtctgtccttaccactctgccccttcccttccttcagccattgcaccactgcctaaagggtcaccattggatccacacatgggaggagcaagccatcactgtcagcttggatagaggggagatcacccacccttctcccttcaggagacatttctcagccccacatccccagaggaatacagaataggagagtgggggtgtggcctggagtcagccttccatcagaaattcttctcatgctgagcttcagtttccccggggagggataggcagccctagatcttatagccaaccagaggtcagattaggcagacaatgatgagtatctattatttcccagaggggtctctgccctggcagagcttccattctggaaagtatttgggcatggtacaccatggctacccgcccagattctagagccagatggcccaggttccaatcctacctcagccacttatcttctgggagaacctgagtgagacataaccttgctacttctcagtgtctccatctgtactgtggggataataacagtattgatctagaatagtaccagacacagaggggtctttgcagttcccagatctgagcttcaccagggcaattcaacctcaccttcatctctctgtactctctcctgacactgtgcttttgtatatgcaaagatctccatcctccctcctctctagggtaaacacccacttccaagaattggataacacatcaccccaacaaccagcccttcccccagccccttgcggggttagggatcccctttggtatccacaaaccccttgttcct

SEQ ID NO: 13582 - DNA, 9813 bp, Human
ttgtgttgggttgatgggttgggcttgtgggtgatgtggttggattgggctgtgttaaattggtttgggtcaggttttggttgaggttatcatggggatgaggatatgcttgggacactggattcaggtggttctcattcaagctgaggcaaatttcctttcagacggtcattccagggaacgagtggttgtgtgggggaaatcaggccactggctgtgaatatccctctatcctggtcttgaattgtgattatctatgtccacttctgtctccttcactgtacttggaattgatctggtcattcagctggaaatgggggaagattttgtcaaattcttgagacacagctgggtctggatcagcgtaagctgctctggttttattgaacagatgaaatcacattttttttttcaaaatcaaagaaatcttatagagttaacagtggactcttataataagagttaacaccaggactcttattcttgattcttttctgagacaccaaaatgagatttctcaatgccaccctaattctttttttttttttttttttttttgagacacagtctgggtcttttgctctgtcactcaggctggagcgcagtggtgtgatcatagctcactgaacccttgacctcctggacttaagggatcctcctgcttcagcctcctgagtagatggggctacaggtgcttgccaccacacctggctaattaaattttttttttttttttgtagagaaagggtctcactttgttgccctggctgatcttgaacttctgacttcaagtgattcttcagccttggactcccaaagcactgggattgctggcatgagccactcaccgtgcctggcttgcagcttaatcttggagtgtataaacctggctcctgatagctagacatttcagtgagaaggaggcattggattttgcatgaggacaattctgacctaggagggcaggtcaacaggaatccccgctgtacctgtacgttgtacaggcatggagaatgaggagtgaggagccaccggaaccccatattgtttagtggacattggattttgaaataatagggaacttggtctgggagagtcatatttctggattggacaatatgtggtatcacaaggttttatgatgagggagaaatgtatgtggggaaccattttctgagtgtggaagtgcaagaatcagagagtactgaatgccaacgcttctatttcaggaacatggtaagttggaggtccagcttctgggctcagacgggtatagggaccaggaagtctcacaatccgatcattctgatatttcagggcatattaggtttggggtgcaaaggaagtacttgggacttaggcacatgagactttgtattgaaaatcaatgattggggctggccgtggtggctcacgcctgtaatctcatcactttgggagaccgaagtgggaggatggcttgagcccaggagttggagaccagcctaggcaacatagccagaccctctctctacaaaaaaattaaaaattagctggatgtggtggtgcatgcttgtggtctcagctatcctggaggctgagacaggagaatcggttgagtctgggagttcaaggctacagggagctgcgatcacgccgctgcactccagcctgggaaacagagtgagactgtctcagaatttttttaaaaaagaatcagtgatcatcccaacccctgttgctgttcatcctgagcctgccttctctggctttgttccctagatcacatctccatgatccataggccctgcccaatctgacctcacaccgtgggaatgcctccagactgatctagtatgtgtggaacagcaagtgctggctctccctccccttccacagctctgggtgtgggagggggttgtccagcctccagcagcatggggagggccttggtcagcatctaggtgccaacagggcaagggcggggtcctggagaatgaaggctttatagggctcctcagggaggccccccagccccaaactcaccacctggccgtggacacctgtgtcagcatgtgggacctggttctctccatcgccttgtctgtggggtgcactggtgagattggggggataaaggaaggggggcgggttctgactcttatgctgaagcccttttcctcccacccagtgccccagcctcgtcccttcagcccacagttcagcccagacaatgtgcccctgactcttccacattgcaatagtcctcatgcccacactaggtccccgctccctcccacttacctcagacctttctctccattgcccagccaaatccctgctcccagctgctttactaaagagcaagttcctgggcatctctgtgtttctctttatggggttcaaaacctttcaaggacctctctccatgccactggttccttggaccctatcactgggctgcctcctgagcccctcagtcctaccacagtctactgacttttcccattcagctgtgagcattcaaccctgtcccctggaccttgacacctggctccccaaccctgtcccaggaaacccagattccaccagacacttccttcttccccccgaggctatctggcctgagacaacaaatgctgcctcccaccctgagtctggcactgggactttcagaactcctccttccctgactctttgccccagacccgtcattcaatggctagctttttccatgggaaaaacacgagcacccccaaccacaacggccagttctctgattccctaaatccgcacccttttcaaaacctcaaaaacaaaacaaaacaaaacaaaacaaagcaagaaacaactcaggcagaactgtttgcttaaccttggacatggtaaaccatccaaaaccttcctctcccagcaactaaacctctccactgggcacttatccttggtttctggaacctcttattctcttagaacccacagctgccaccacagtgtcccttctcccagtgtaagaccccaaatcactccaaatgacccaacccccaacccgatgcctgcttcagatgtttcccatgtcccctactctgatctctggggtcagctccgttctcagagcatgaagcctcccgacctggtccagccaccaacccgctaacgcagggaatagctacagaattgccagccctcccaggaccccttgcttgtgtcctggactcccagtcctggtcctctgcccccatgtctcttcaaacccacagctcagctccctcccctatccaattcttttgggtctgatccccctgacccagcaccccctccgcaggtgccgtgcccctcatccagtctcggattgtgggaggctgggagtgtgagaagcattcccaaccctggcaggtggctgtgtacagtcatggatgggcacactgtgggggtgtcctggtgcacccccagtgggtgctcacagctgcccattgcctaaagaagtaagtaggaccctgggatctggggagggaatggctgtgtcccacaggaataacagcgggatgcttcccccagggtcacttctcaggtgaggcttcagactaaaggagagagggaaggtcctggcccaggtcgcacccggaggcagagctggggctggaccactctccccatggctgcctgggtttctctctgtgtctgatctcgctgtgtctcttggtatctggctctggttgtgtctgtatgactgtgttttggtctctatgtccctctctcttttctgtctccctgtgtctgtgtctcccccgtctctgtctctgggtctctctgtggccatctctgtcaccgtgtgtctcaccctgcatctctttgcctgtctttctctctgggtctctgcctcagcccttcctcatcactactgaacacaccccgtgagggtgggtggggagcacccagaaaaaggaaggactttaagctcaatgtgtgtgcatgtgagggggtgcctgtcattgcacagcactctctgcaggacatccctccaccctggggagacacagggagggctggtttcagctgtagctgggtgcacaattgaggagggaggaaggagaaggggaaacaagaaaggaggggaaggtggccgggcacggtggcccacgcctgtaatcccagcactttgggaggccgaggtgggtggatcatctgaggtcaggagtttgaaaccagcctggccaacatggcaaaaccccgtctctactaaaaatacaaaaagtagccaggcgtggtgctgcgcgcctgtaatcccaattactagggaggctgaggcaggagaatcgcttgaacccgggaggcagaggttgcagtgagccgagatcgtgccactgcactccagcctgggtgacagagcaagactccatctcagaaaaaacaaacaaacaaacaaacaacaaaaaaaatcgaaaggaggggaagggagctggagagagaaagggggacgtggccctgagctgtgggccgggccacccgccactacagagccctcactccagccccagctgcaggtgagccaccctcatgcctctcctcctccccctgctactccacactcctcagatgcccccgtggcctccctcctttttctctcccacactgtatcacccctggcttcctctctgctgtttctccttctctctctgacttcccgcatccttttctcatttgtctatttctcactcccttcctggttctgttctttctcccttcctcttccccatgtctatttcttgctgtctctgtctcttctttgctcatcctaattctcactgttctcccttctgtttttgtcattcctctgccattttatgctctctcttttccacttcgtttctttcagtttctgtctctgcctctcacatgatcacactcctgttttctaactcactgtctgtatttcaccacgactatatctccccgacccctgtgcttttctcactgtttctttttcttccctttggagtctcccttatcctcccctgccccatctacctttccccattttctctctcctcatgcatccacccccttcctccccaggaatagccaggtctggctgggtcggcacaacctgtttgagcctgaagacacaggccagagggtccctgtcagccacagcttcccacacccgctctacaatatgagccttctgaagcatcaaagccttagaccagatgaagactccagccatgacctcatgctgctccgcctgtcagagcctgccaagatcacagatgttgtgaaggtcctgggcctgcccacccaggagccagcactggggaccacctgctacgcctcaggctggggcagcatcgaaccagaggagtgtacgcctgggccagatggtgtagctgggagcccagatgcctgggtctgagggaagtggggccaaagaaccaggtggggtccggccacagcccagtttttctctgacccatagtcttgcgccccaggagtcttcagtgtgtgagcctccatctcctgtccaatgacatgtgtgctagagcttactctgagaaggtgacagagttcatgttgtgtgctgggctctggacaggtggtaaagacacttgtggggtgagtcatccctactcccaacatctggaggggaaaggtgagtgaagaccctaattctgggctgcaatctgaaagctaaccagacatctgcctcccctgctccccagctatagccacgccccctccccatgcctcatctgccgccctccttcccccttccctgactccctcaacacaagaggtgattctcacagcataattcacccattcctgtgttgagcacatgcttactgggcacctgctacgtgaccagcattgccgtagaccctgggaagcagcagtgaacaggtagagagcagcctctccctcctgcagcccccatgctggtgaggggcactggcaggaacagtggacccaacatggaaatgctggagggtgtcaggaagtgatcgggctctggggcagggaggaggggtggggagtgtcactgggaggggacatcctgcagaaggtaggagtgagcaaacacccgctgcaggggaggggagagccctgcggcacctgggggagcagagggagcagcacctgcccaggcctgggaggaggggccgggagggcgtgaggaggagcgagggggctgcatggctggagtgagggatcaggggcagggcgcgagatggcctcacacagggaagagagggcccctcctgcagggcctcacctgggccacaggaggacactgcttttcctctgaggagtcaggagctgtggatggtgctggacagaagaaggacagggcctggctcaggtgtccagaggctgtcgctggcttccctttgggatcagactgcagggagggagggcggcagggttgtggggggagtgacgatgaggatgacctgggggtggctccaggccttgcccctgcctgggccctcacccagcctccctcacagtctcctggccctcagtctctcccctccactccatcctccatctggcctcagtgggtcattctgatcactgaactgaccatacccagccctgcccacggccctccatggctccccaatgccctggagaggggacatctagtcagagagtagtcctgaagaggtggcctctgcgatgtgcctgtgggggcagcatcctgcagatggtcccggccctcatcctgctgacctgtctgcagggactgtcctcctggaccttgccccttgtgcaggagctggaccctgaagtcccctccccataggccaagactggagccttgttccctctgttggactccctgcccatattcttgtgggagtgggttctggagacatttctgtctgttcctgagagctgggaattgctctcagtcatctgcctgcgcggttctgagagatggagttgcctaggcagttattggggccaatctttctcactgtgtctctcctcctttacccttagggtgattctgggggtccacttgtctgtaatggtgtgcttcaaggtatcacatcatggggccctgagccatgtgccctgcctgaaaagcctgctgtgtacaccaaggtggtgcattaccggaagtggatcaaggacaccatcgcagccaacccctgagtgcccctgtcccacccctacctctagtaaatttaagtccacctcacgttctggcatcacttggcctttctggatgctggacacctgaagcttggaactcacctggccgaagctcgagcctcctgagtcctactgacctgtgctttctggtgtggagtccagggctgctaggaaaaggaatgggcagacacaggtgtatgccaatgtttctgaaatgggtataatttcgtcctctccttcggaacactggctgtctctgaagacttctcgctcagtttcagtgaggacacacacaaagacgtgggtgaccatgttgtttgtggggtgcagagatgggaggggtggggcccaccctggaagagtggacagtgacacaaggtggacactctctacagatcactgaggataagctggagccacaatgcatgaggcacacacacagcaaggatgacgctgtaaacatagcccacgctgtcctgggggcactgggaagcctagataaggccgtgagcagaaagaaggggaggatcctcctatgttgttgaaggagggactagggggagaaactgaaagctgattaattacaggaggtttgttcaggtcccccaaaccaccgtcagatttgatgatttcctagcaggacttacagaaataaagagctatcatgctgtggtttattatggtttgttacattgataggatacatactgaaatcagcaaacaaaacagatgtatagattagagtgtggagaaaacagaggaaaacttgcagttacgaagactggcaacttggctttactaagttttcagactggcaggaagtcaaacctattaggctgaggaccttgtggagtgtagctgatccagctgatagaggaactagccaggtgggggcctttccctttggatggggggcatatctgacagttattctctccaagtggagacttacggacagcatataattctccctgcaaggatgtatgataatatgtacaaagtaattccaactgaggaagctcacctgatccttagtgtccagggtttttactgggggtctgtaggacgagtatggagtacttgaataattgacctgaagtcctcagacctgaggttccctagagttcaaacagatacagcatggtccagagtcccagatgtacaaaaacagggattcatcacaaatcccatctttagcatgaagggtctggcatggcccaaggccccaagtatatcaaggcacttgggcagaacatgccaaggaatcaaatgtcatctcccaggagttattcaagggtgagccctttacttgggatgtacaggctttgagcagtgcagggctgctgagtcaaccttttattgtacaggggatgagggaaagggagaggatgaggaagcccccctggggatttggtttggtcttgtgatcaggtggtctatggggctatccctacaaagaagaatccagaaataggggcacattgaggaatgatactgagcccaaagagcattcaatcattgttttatttgccttcttttcacaccattggtgagggagggattaccaccctggggttatgaagatggttgaacaccccacacatagcaccggagatatgagatcaacagtttcttagccatagagattcacagcccagagcaggaggacgctgcacaccatgcaggatgacatgggggatgcgctcgggattggtgtgaagaagcaaggactgttagaggcaggctttatagtaacaagacggtggggcaaactctgatttccgtgggggaatgtcatggtcttgctttactaagttttgagactggcaggtagtgaaactcattaggctgagaaccttgtggaatgcagctgacccagctgatagaggaagtagccaggtgggagcctttcccagtgggtgtgggacatatctggcaagattttgtggcactcctggttacagatactggggcagcaaataaaactgaatcttgttttcagaccttatactgtgtaattgtaagtggacatttagtaatgtacagggggtcagggaaagacgggggatagtgaatgcacctgtgggactggtttggttttgtgattgagtaacccatggagttatctctgcaatgatgaattgtttgaaagaaacctgattgattttatactgaattagaagttaataagcatgctgaaaaataagagaacatattaggaatattgagcaagactaacatacataaaatatgagaaaaaggtaggaaatattaggtgggaaaaatatgataattggaaaaagtaaaaaaaatggattaatagaattgagtagaggtgaagaacgcaatagtgacattttagactagattgaagaaaaatgtcaaagaaatactgaatgatgtgagtgctggcagtgcagatactgaacactaaagactcaggaagagagaaaaataggaaaggaggaaacacatgactaaacactgaaggcaggttttttttttttttttttttttcgcagagtttcactcttatcgcccaggctggagtgcaatggctcagtctcggctcactgcaacccctgcctcccagttcaagtgattctcctgcttcagcctccccagtagctgggattacaggtgcacaccaccacacctggctaattttgc

SEQ ID NO: 13583 - DNA, 10818 bp, Human
tgactgtgtgctgcttgcaggcgattatgtgattgtggctgagtgtgacgttatggatgcccgtatttgtgaccgtgtgactacctgaagctctgtgtaggggtgactgtatgtgactgtgtgtgtctgtgtgaggccgtgtaaatgctactgtatgtgtgatggtgcagctgtgtgtctggagtttctgtctctgcctggagggatagagggtgcaggggtagctatctctgggagatgggtgccaggtgactgacttgcagtgtgtgcctgtgtgcagaagagtatgtggcagtctgaacatctgtgcacacacggcatctgtgcgtggcactgagacactgtggatgagggtgtgcgatcccgctaggctgcccgggagcgtgtgtacctggagacagagctgtatgttagctgcacctgtggaggcaacatgggcgtgtctgcagaactgcgtgcgtgcttggctgttactgctgttgtgcgcgtggttcttggggtgagttcgtgaatgatggtggtgccagggccatcagcaagggtaagaaccaggccgggcgcggtggctcacgcctgtaatcccagccctttgggaggccgaggcaggcggatcacctgaggtcgggagatcgaggccagcctgaccaacatggagaaccccgtctctactaaaaatacaaaaaattagctggtgtggtggcgcgtgcctgtaatcccagctactcgggagactggggcagaaaaatcgcttgaacccgggaggtggaggttgcggtgagccgagatcgcgccattgcactccagcctgggcaacaagagcgaaactccgtctcgaaagaaaaaaagaaaaaaaaaagggtaagaaccagtgaatgggcacgggaggactgatgatggagtggggcatgcatgtagtctgtaggtctgtgtgtgagaggaggagattgacaggattgagaaggcatgttttcatctgagaattcagaaacctaggcctgctcttcccctccatgtggccccctaagctgagcccttctttcctggtcctgctttcggaaccctagctccgcccatgagctctgaccccacctcctttcctcaaccacgcccctaggccagactctagtggaccccgcctaaggccacacccctttgggccaggctccaccccctattctgtgggtaccttctagaacccccttcaaagtcagagcttttttttttttttttttggagacagtcttgctctctctcccaggctggagtgcagtggcgtgatctcggctcactgcaacctctgcctcccaggttcaagtgattctcgtgcctccacctcctgagtagctgggattacaggtgcgcgccaccacgcctggctaatttttgtgtctttagtagagacagggtttcaccttgttggccaggctggtctcaaactcccaacctcaggtgatccgcccacctcggcctcccagagtgctggggttacaggcgtgagccaccgcccccagcccaaagtcagagctctttataggagactctaacatgtaaccctgaccctggccctaactaagtcaattccaaaccccttcctgcctccagccctgaccccactcactgaggcctgaccccacttcttgagaccagttccatccctaaagccctggtctccctcccatccccaggctccagcccccacagctttggcactacccctgagcttgtccaggaatcctgtacccaattttaccctcacatgtagttctagccaattccaggaatctgtgaggtccagttagagtccagtaaccctacctgagcctgggctctgtccttgagcttgagcctgggcttgagaggtgccactcttattctccaggccctgcccctgccccctcagcatgtcagacacccaccctctagctggtctggcctcttgagtctgaaacccacccccagcccaagccccgcctctgagccccgcccaacccattttccgttcccagagcatgttctcgccaacaatgatgtttcctgtgaccacccctctaacaccgtgccctctgggagcaaccaggacctgggagctggggccggggaagacgcccggtcggatgacagcagcagccgcatcatcaatggatccgactgcgatatgcacacccagccgtggcaggccgcgctgttgctaaggcccaaccagctctactgcggggcggtgttggtgcatccacagtggctgctcacggccgcccactgcaggaagaagtgagtgggagttccaagaggagggttggtggggacggggaagtgggggtgggggtggggaagtgggggtgggggtgtcatggaggtgagggctggtggggacggggaagtggggttgggggtgtcatggaaggtgagggttggtggggatgggttggggatgtgggagcaggaggaggtcgagttggggataggactaaggatggagttttgcgggggagcaaggtgggaggatgaggttggagaggggagagtgttgtggtagggaatgggaaggagccaaggatgggttggatttggggttaggagcatatatttgttgaatggtttgggatggaggtggaattgggattggctttagaattgggggtgggtgaaaatcgggctggggtggaaatgaagatagcatggagatagggttgagattgggagcagatatagaatgaaggatggggattggagttttgggtggggttggagatggttggatttgggcttgagaatgcatatggtgatggcttctgggtagggaaagaattagggttgggaatgggatgggtttggaattgtgactgggatggggacaggcatgggattggagaccaagagggagttgaggatggtttggggaccgggggtggggatgggggtggggctggggctgggtgtggggttgggattggcgttggacgtggagatagagatcagggttggtggtgacctgccccatcttcctcagagttttcagagtccgtctcggccactactccctgtcaccagtttatgaatctgggcagcagatgttccagggggtcaaatccatcccccaccctggctactcccaccctggccactctaacgacctcatgctcatcaaactgaacagaagaattcgtcccactaaagatgtcagacccatcaacgtctcctctcattgtccctctgctgggacaaagtgcttggtgtctggctgggggacaaccaagagcccccaaggtgagtgtccaggttcttcttgataccgacccatctctgccgccttccatctttctccacttctcattgtgttcctgtttgacagtgcacttccctaaggtcctccagtgcttgaatatcagcgtgctaagtcagaaaaggtgcgaggatgcttacccgagacagatagatgacaccatgttctgcgccggtgacaaagcaggtagagactcctgccaggtgaggacacctctctttattcagcagatacacactgagtgccaactcggtaacatggagcgttgccaaattctgagaatccagcaattgccaagacagtcaggacccctgttctcacagagctcataccctagagtagtggtgtttagtagaaataatgctgagctgcttatgtcatttccagttttttagtagccacattaaaacaggtaaaaaaggctgggcgcagtggctcacacctgtaatcccagcactttgggaggctgaggcaggcagatcacctttggtcaggagtttgagactagcctggccaacatggcgaaactctgtctctaaaaaaaaatacaaaaattagcctggcatggtggcgggcgcctgtaatctcagctgctcaggaggccgagacacaagaatcacttaaacccaggaggtggaggttgcagtgagctgagatcgtgccactcactccaacctgggagacagagtgacacttttgtctcaaaaagaaaaaaaaaaacaagtaaaaaagaaacaggtgaagttaactttaataacccaatgtatcccaaatacaatcatttcaaagtgtaattaatataaaacaattatgaatgagatactttacattcttttcttgttttcatattaagtctttgaaagtgagtatatatgttatgctgacagcacatctcaatttggactagctacatttcaggtgctcagtagccacatgtggctagcagttactgtattggatggcacggatctagagggaaagatcagggctgttttgtatggttgggcaggttgtgcactgcataaagataccatatctaataggggcactccgtgttacagatgtcagttttggcagttttcaggcgtgtggtagttaagtgtcttgtttcaacaaaatctgtaatatgacagttttctagcaagtgctggtaaaatatcttgaggaaggaaaagagaaatctggtaggtatttttacaagagaatatttaatacaggggattaattgcaaagctgctggaagggctggaggaacaaagttaaaaaataaaaaactctgtggtcaagaatctgcataaatagggcaatttcagagagtggtaaaggttaaccccaaaataaaacatggttttaggatagtaaacaataagggccaatattcaaaaaggtggtcaggggagcctccttggagaggtggcatctgagcagagaatggatgacacaaagaagctaaactcgtgaagtttaaggggaaagaaaaggcacgtgcaaaggccctgaggcagtaaggaatttggctgattcaaagaagaagaggaaaccaatgcaactggagaacaaaagtgggggcaacagtagaaagtgacgctggaggtgtaggcaggggcgaatgctctgcaagtatttcttggtcaccaacacagagcttccctatgttctaatggaagctgtatctgttgaggaagacagaatttaaaatcaaactgttacatcaaccagcacccttctctgtattcaggctcccaagggatctagaaggacgtaagttaacaagctctcattagcagggtgtgtgtttcaacagtagttaggaagctggggattcaggagtactccagtcccatggctatgaaaagctccccccaaattgtacaaacctgacaaatgcaacacctccccagctctccccatttcttctctgtgccctgggtgtgggggggtgggttgcgagggggaaaacttttaacagaagaaagcacatctcggccgggcgtggtggctcacacctgtaatcccaacactttgggaggccgaggcgggtggatcactaggtcaggagatggagaccatcctggctgacacggtgaaaccctgtctctactaaaaacacaaaaaattagccgggcgtggtggcaggcgcctgtagtcccagctactcgggaggctgaggcaggagaatggcctgaacccgggaggcggaacttgcagtgagccgaggttgcaccactgcactccagcctgggcaacacagtgagactccgtctcaaaaaaaaaaaaagaaaagaaaagaaatcacatctcattcaagtggtggcatttaaaactatttagcctttctgtaggcaaggttagtatcttgtttttccagacctcaaggtgtttttttgtttgttttttcataccggtgtgtggtctgggtgtggccactaaaagctacaagcaagaaataataacaactacaacaatactaataccaatagtataaaaataatagcatctggctaattgctggacactgttttaagtggtttgcatgcctcagctcattaactcatttacctgttattattggccctattttacaaacaaggagccaaggctcagagcagttaactaacagcctctcaaaagaaactctgcagagatattaaatttaaaaaataatgagagaaattaaaccacaagaaagttgaaatttagaggtacaggcagctaagcttgtttgctttgaaacagtgtctgctactgggaaaaaggcaagtcttggctttcctaataattgataccaggactctgtaattcatattttgcatgcatgtaagtaagaaatgaagccgggtgcaatggcacatgccagtaatcccagcactctgggagactgaagtgggaagatcacttgagctcaggagttcaagaccagcctgggcaactaaaaattaaaaaaataaaaatactaattgtttttattttagtagattttattcataccacttacatcattattgtagtatgtacatatttatttcttttcttttcttttcttttcttttttgagacggagtctcgctctgtcacccaggctggagtgcaatggcaccatatcagctcactgcagcatgcgcctcctgggttcaagcatttcttccacctcagcctcccaagtagctgggataacaggcacccaccaccatgcctggctatttttttttttccgtagagatggggttccaccatgttggccaggctggtcttgaactcctgacctccagtgatctgcctgcctcggcctcccaaattgctggtattacaggtgtgagccaccgtgcccaggtgggagatagacatttctctctacctcaaacagaggtccactcaagctacttttcattttcttcataaatattagccgagtggctattttgcaccaggaatggttccaggtgctgtggatatggcatcaggcaaaacagaccaaaaacttcctgccgcgtggacctcatgttccccaagtggaagacaggcaataaagagatagataaatatgtagtaaattaaaaaaaaaaaattagccgggtgtggtggcttgcacctgtagttccagctacttgggaggctgaggtgggagaattgcttgagcccaaacgtttgaggctgcggtaagccatgactgcactgctgcactccagacagcagcctgggtgacaaagcaagacgtttttgtcagaaagaaaaaaaaaagagacgaagggaggaaggagagagaaaggaaggaaggaaggagaaagaaaggaaggaaggagaaagaaaggaaggaaggaaggagaaagaaaggaagaaagagaaagaaagaaaaagaaagaaagaaagaagaaagaaaagagagaggaaggaaggaaagaaggaaaagagggaaaaaaatgactgttgaagagcagtgagtattattataggagggtaattatagggaggtatggggaattgaagacaggaaacacaaattagtccaagcgaatggatttctattgggagtgattctgcccctagaagacactggcaataccaggagacatttttggttgtcacaactatatggaggggcattactggcaactaatggatagatgccaagtgtgctgttcaacatgctatgatgcacacggcaggcctccacaacaaaccattatccagcttcagatgcccacagtgcccagatcgaggaaccctcatccaggggctgagaaccgtatttttgcagaagggaggtataaggatgggttggtggagaatggggaaggaaggtgtgtgtccagtaagagaaataaggcctgcacaggctggaggggagagtgagagagaaagggaggcggagagatacacgatgagggagacaggctggaacagaaagtagagacgaagattcgagatgtggagaggaagggtcacagacccccccgaaatgatgtgtggacaacaggaatctggaagaggaagatggagtggagagtgacaaatggggtctaaaggttgaacttggaggccaggcatggtggctcacgcctgtaatcccaacactttggaggctgaggtgggcgaatcacttgaggccaggagttcgagaccagcctggccaacatggtgaaaccccgtctctacaaaaaaaatacaaaaaattagccgggtgtggtgatggacacctgtagtcacagctacttgggaggctgaggcaggagaattgcttgaacctgggagatggaggctgcagtgagctgaggtcaggccactgcgctccaacctgggcaacagagtaagactccatctcaaaaaaaaaaaagctggatttggagtgaaatattaataacattctccctctctctccttttgcctgtgtctccatctctgtctttttctgcatttcttcatctctgtactttccatctctgtgtgtctgttcccatctgcttctccatctatgggcatctctgggtctctcatgtctccttctgcccactttgccacatctctgcctctctcgtgcccccctttctctcctgcagggtgattctggggggcctgtggtctgcaatggctccctgcagggactcgtgtcctggggagattacccttgtgcccggcccaacagaccgggtgtctacacgaacctctgcaagttcaccaagtggatccaggaaaccatccaggccaactcctgagtcatcccaggactcagcacaccggcatccccacctgctgcagggacagccctgacactcctttcagaccctcattccttcccagagatgttgagaatgttcatctctccagcccctgaccccatgtctcctggactcagggtctgcttcccccacattgggctgaccgtgtctctctagttgaaccctgggaacaatttccaaaactgtccagggcgggggttgcgtctcaatctccctggggcactttcatcctcaagctcagggcccatcccttctctgcagctctgacccaaatttagtcccagaaataaactgagaagtggaatcttcctgtgtctcctccctgtgcagggcggctgtgaacaagtcatatctccgcctccaggctcatgtgttttgtctatgaggtcacttgggttgtgagaaacagaggtccagtcagactacttttcaccttcttcataaatattggccaggtggctattttttattttcatttatttattattattatttttttttttttgcgatggagtctcactctgttaaccacactggagtgcagtggcacaatctcggctcactgcaacctccacctcccaggttcaagcgattctcctgcctcagcctcccaagcatctgggattacaggcgtccaccaccacgcccagctagtttttgtatttttagtagaaacagggtttcaccatgttggccaggctggtctcgaactcctgacctcaagtgatctgcccgcctcagcctcccaaagtgctgggattacaggcatgagccaccacacccgggcccatgtggctactttgcaccaggaatggttccatgtgctggggataaggcattgggccaaacagaccaaaaagttcctgccttgtagagctcacattccaggagtggaagacagacaataaagagagagataattgggaggccaaagcaggcgaatcacaagttcaggagatcgagaccatcctggccaacatggtgaaaccccctctctactaaaaatacaaaaattagctaggcatggtggcatgcacctgtaatcccagctactcaggagactgaggcaggagaattgcttgaacctgggaggtggagattacagtgagcagagatcacgccactgcactccagcctggcgacagtaagatgccagctcaaaaaaacaaaagagagagagagataaacttgtatgtgccatagtaattatgtaagtgacatgaacacaatgagagcagggcataaggcaagagaggaaatgtcgtgagttggtggggggggtctctacattggatgatcaaggagggcatgggaggcagcataatgcctccctcccacctcgaaacgccatcttaatttctggagcctgtgaatatgttaccttctatagcaagggggctttgctgatgtgattaagggtcttgagatggggagatgatcctggattatctgggtggacccaatataatcagaagggtccttataagagggaggcggaaagatcagaatgagagactggaagatgctatgctgctggctttgaagacagaggaagatgagcatggtggctcacgcctgtaatcccagcactttgggaggccaaggcaggggcatggcttgaggccaagagttcaagaccagcctgggcaacatagggagaccccatctctaaaaaaaaaaaaaatgttttttaatttgccaggtgtagtggtgtgtgcctacagtcccagctactcgggagactgaagtaggaggatcactgcactccagcctgagcaacagaacaagacccaatctctaacaatagtaataataataataataataataataataatgatgaaggtgaaggaaggggcatgagccaaggaatatgggcaacctctggaaggcaggaggacatgggaatggaccctcccctagagcctccagaaggaaccagccctgccgaccaccttgatttctgcccagtgagatctttaggacttctgacctcccaaactacaatagaataaatctgtgttgttttaagcaactagactctcagtgatttgttacagtagccactgtaacaaacacaaagggcctcgccgaggaggtaccatttgagactgagaggatagagtggccagccccaggcagggcgcagtggctcatgcctataaccccagcactttgggaggctgaggtaggtggttacttgaggtcaggagttcaagaccagcctggccaacatggtgaaaccctgtctctactaaaaatacaaaaactagctgggcgtggtgttgcacacctgtaatccca

SEQ ID NO: 13584 - DNA, 15252 bp, Human
ggacacttaaaaaatcttctgacttaaaaaaaaaagtatggtgattggaaaatgtaaatgtgcatgcgtgcttggcatcacatttcattggccaggacttccctggatgctaaaggtcctcaaatgccaggctggggggctgggacttggtcccaagggagatggggacccagggcacgtctgtgagaggaggggcaaggtcagcacaaggcacaggaaggtctctctggggcaagggatacagagaacagagggatcctggtccaggtgggagaggtgcagctctgagttggggttgagggtgtgggtacagagaggaagggaccccccagagagaggaggcagagggatagggcctggtcactgggttgtgcaacatcagacttgctgtctgtgaagatagcacgtcctgagaagaaggtgctgaggtcagtggggaccaaatgtgagagggagcacccggagagtatactgaataccgaagtagtcttcatccctggagtgatggggggtgcacaatgcaagatgacaattagattcaatgcaagacaaagaaaagggttggctgggaacagtggctcatgcctatggtcccagctcctgggaagactgaggcgggagggtcgcttgagcccaggagggttgaggctgccacgagcaaggatcgtgccactgcactccagcctaggcgacagaacaagaccttgtctcaaaagaaaaaagaactttttttttaagttacctgtagtgcccagcccaagcaggtgctgagccagacttcattcctatcattgtccttattacgcagtgacttccccctcctcatttctctccactctgccacgcacacaccctcaccctccagcccataccaaccaccccaaccactgcctgtggtttcccatgtgcacccaggccaggcattttcacggcctttcctcctgacctacgcctggctcagctttctaggcccaagttcaaagacacctccctaaatcttcccagatccctctgctactgcccagcaccaccatcttatcacagccccacgtcgttcccaagtgctctccgatttctgcttaactccatgcctctcgctgtgtgtccgcatctcatcaataagtcctcaagtcctcttccatcctgctagcttcctcatcgctcgggaatcatccccgctacttcctggggaaactgactcccttctgggcacacacagtgctacccccggggaaatctaagaagagacccaggagaagataagcacggagagtcagagaatcaaggggaaagaaagggagagaggccgggcacagtggctcacacctgtaatccagcactttgggaggccaaggtgggtggatcacctgaggtcaggagtttgagaccagcctggccaacatggtgaaacctcttccctactaaaaatacaaaaaacatttagccgggcgtggtggtgggtgcctgtaatcccagctacttgggaagctgaggcaggagaactgcttgaactcaggaggcggaggttgcagtgaactgagatcacaccactgcactccagcctgagtgacagagcaagactccgtcaaaaaaaaagaaagaaagaaagaaaagaaggaaggaaagaaagaaggaaggaaggaagggaggaagggagagaggaagggagagaggaagggagagagagaaaaaaagagggagagagacacaaatacagagactgagatgggagagagagagagatggaagctccctcccctccatggccagggagacagatggagcaagagacctcaggggtgggcagacttggaggagaaggaccaggaggatgtggagtgccgaaatctccagtcagggccaggtgggcagtcagagactgcaaaggaggactgtcagacagggacaaaaggaagccattgatgtaaccgccctcccgcctgcccgccggaagagaggttgaggccggagctgctgggagcatggcactggggtgctgggggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcaggtgtgtgagtcaccccaaccgcactgaacctgggcaggctgcttcccagtgccggagggctctagagcccggagtgagggcctgcaggtccctgggtggcacagagagtgctgggggtgcagggaggcctggggcaccatctgcttgccccagaggccggaatttgtcttcagacactttctttctccaaaacccggaggtctaaggactgagccgactagaacttcctctgcctcagattcaggccccagcccctcctccctcagacccaggagtttaggtcctagcccctcctccctcagacccaggagtccaagttcccacctcctccctcagactcaggagtccaggcccccagcccctcctccctcagacccaggagtccaagttctcacctcctccctcagacccaggagtccaggccccaagcccctcctccctcagacgcaagggtccaggcccccagcccctcctccctcagactcaggagtccaggcccccaagcccctcctccctcagacccaggagtccaggccctcactgcactcagggaccagtgctcccttccctggaggcctggtcaggggtcaccaagagcagagcgtgggggcgggaggaatgtgtgtgggaggcctgggtaaggaggaaaagggtgtagccagtctcctggctcagggacctgagagacaggggttaaaaggacgttccagaagcatctggggacagaaccagcctcttccagggaggcctgggagctgggggtgtgtgtctggcagtccctgcagccctgggctctgcggcccctgcgtcctccgcttggctctgccactgcatctgagtgtcttctctcctcacggctccccgcatttctaactctttctgcctcctcgtctcaaagctgttccttcccccgactcaagaatccccggaggcccggaggcctgcagcaggtgagatcacagacatcacagaacctgccgggtgggcggggtgggtggccattgcgcacagagccaggctccgaggaaaactcccatacagaggaagaacgctagggccccctagggtaaccctctcctgtcgacaggaaggcaaatcagtgcccaagaaagtagaaagatctaatcagaatctcaccatgggttactggaccagtggacgtagttctgaattctctttggcactgttttcgtgggatcctctgatggaagatgtgggctgaggaagaataaatcaggaggctagatgggaaggacagaggtcaaggcaggagaccatagcaggccaggaaggaaggagaggatgcagagggagcagacagagggatggggggagggtcgaggcagtgactaatggaccatgtggcttcccctctcaggagcggccatgaagaagctgatggtggtgctgagtctgattgctgcaggtggggaaagggcatttggatgggggaggcttgcagacagggttgggcttgttgatggagaagaggctggtattggggatggggatatgcacagggttggggtgggggagctttgaaatgaggaagacgttggggattaggctaagggtggggaatacagatagggagggtggtgggaggtgggtttgaagatatgagggtttggggtggggttggctttagggatggggatctaaacatagaagaggtaggaggtaggttggaaagttggagagagcccgggaataggggatacagttgggtttgtaatgggaatggggtaagtttgggagtggaaatacagagaagctttttttttttgagacagggtctcactctgtcacccaggctggagtgtagtggcatgatccatagttcactgcagacttgaactcttgggtctcaagtgaccctcccacctcagcctcccaagtagctgggactacaggcgtatgccaccataccctgctaatttgtgtgtgtgtgtgtgtgtgtgtgtgtgtgtgtgtgtgtggagatgaggtctcactgtgttaccgaggctggtctcaaactcctgggctcaagcgatcctcctgcctcagctgggattacaggcataagccactgcacctgaccaatcttgactggagttcatgttgagggggatgcgcttggtttctccagaactcctctctgactcagatcttctctccctcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgtgagtctacactgtaaatgaacagcagatgcgactgaaccctgagggtgtcttatagatgtcaggcaggaggtgacataggcatcccccccatcccagcacgaggccatctgatagccaggtgcattcggctgttgcttaattgagtacttaatgtgtgccaggccctgcgggcatagcagtggaaaagaaaataaaaaaaagaaaacaaaaaaaaacaagcaaaattgctgttttcctgaacttactttctaatgggggaattggatcatttggggacctgcagggcgtgatgggcatttggatttaattctgagcacagtaggaagccactgggcagttttgtttttgttgtttgtttgttttttgagacacagtctcgctctgtcacccaggctggagtgtagtggcatgatctcagctcactgcaacctctgcctcccaggttccagcgattctcctgcctcagcaccccaagtagctgagattacaggtgtgcaccaccttgcctggctaatttttgtatgtttggtagagacggggtttcaccatgttggccaggctggtctcgaactcctgacctcaggtgatccgcccgcctcgccctcccaaagagctgggattacaggcatgagccaccaccacacccagcctgatttacatttttacaagcaccctggctaccacgtggaacgtggtctgggcaagagagagggagggaggcccacgtgggggctgttgctttcatccggcgacataggagggtggcttgaacccaggcggtcgcagtggggatggagggatgttgaatatcttgggatgtggaattctgagactgagccagcagaatctggcaacgaggaacaggagggagaggaagaagcacggctggcttccgtgtatttgtcctgaacaactgggtgttttgccacgtctttctctgagttgtgggagagggaaagagaaacaggccgggtgtaggcaggggagcatctgacattttgctttagccacgatgagttggagatgccggggagatgtcccagcagggaggccagggaggactctggagctcagaggagaggtcagggctggaggttaaaatgaaggcatcgtcagcaaacaggtgtatttaaagccatgggactagatgagatcatccaaaaagctggcatagttggaggagctggagggcccaggacaaaaaccctgggcgctgatcctcactagtcagattcacgacagctgccacttgtttgatgctaactaccaatcaggtgctgagtgaaaccatgtacacacctttcctggaatgcccaccacaagggactcttggcaccattttgcaaatgaggaaactgaggtgcagggaaatagcaagtgacaatccctggggtggttcccctgaccccaaggagaccttggatgactctcaccaccatcattcattcctttgatgtacattgactaagagcacctgctaagtgccacattcgagttgggcagtggagattcagcaatggatgggacacacacgtcatccctgccctcgggagcacaaggacagaaaggtgcagacaagcaaagtgagggctgggcatggtggctcacgcctgtaatcccagcactttgggaggccgaggtgggtggattacctgagttcgagaccagcttggccaacatggctcaaccctgtctctactgaaaatacaaaaaattagccaggcgtggtggtgggcttctgtaattccagcaacttgggaggctaaggcaggagaattgcttgaacgtgggaggcggaggttgcagtgagccgagatcgcgccactgcactccagcctgaaccacagagcgagactctgtctaaaaaaaaaaaaaggaaagaaagaagcagcaaattgggctggccgtggtggctcatgcctgtaatcccagcactttgggaggccgaggcgggtggatcactcgagcccaggagtacaaagctgcagtgagctgtgatctacagaacaccactgcagatccagcctgggtgacagagcgagaccctgtctcaaaaaaacaaacaaacaaaagaagcaaacccttcaaaaccccatataattacaaattatgaaggaaaagaatacgggtacctactttagatggaggagggtcaggaaggactttctaatgagataaaatccaagcggaggcatgaagatgggaaaaggaatgttcagggcagaggaaaggctgtgataacacccctgaggtgagaaccgtcttgagtattctcagaaaataaaatttcccgttcactggggggcagaaggtgctgggagataaggttggaaagtgactacagccagatcacacaggggctccagtgccaagtggaggagcccaggctttattcttaggacaatggggagccatgggtgatgtctgagcaagggagtgactctctgtttcaggaatatgtatcaaacacctatcctgtgccaggtgctgatcaacgcactggagatactatatctgaatagaacaaaaatccccatcttgacatcctagagctgcactgtctaatatggtagccatcagccacatatagcaaattacattgaaattaatgaaatggaaaatccacaagccacatttcaagtactcagcagccacctgtagcttgtggttcccccagccacctctggacagtgcagatcgagatcatggcatcgtagcatttagtggacagcattgctctgcaaggaggagaaataacacaatgagtaaatatttaacaataaatatatagcaggtcggatgattgtgataggttctctggtggaacagaaagcaggggagggagataggaattgcctactaacaggtatttgtattttaattgggcaactaaggaaggcttccctgagaggcgacatttaaaggaagtgagggagtgagctatgcagatacttggaggacagacttgctggcagagggaacagcagtgcaaaggccctgaggtgggaagatcactattgtgttcaaggcaagacagggaagccagcgtttggctggagcagagggagagaaggggagagtgggaggagaagatgtctgtgagatgatggggcagtgcttgcaaggcctggtgtgccacgttgagaactttggctttgattctgagtgagatgggagtcataggaggggctgagcagaggaggcacaggaccaacttacattgttaaaatatctctggttgctttgtggaggatggactgtgggggaccagagacagagcagggagcccagtgaggaggctactgctctagttcaggtaggaagtgaaaaggcagctcaaaccaagatggtagccgtgggaaaggtgagatgtggccagattctggatatgcttcagagaggcaaaaggaattctggacagcttggatgtagggcatgaaataaagagagtgaagaatagcccccaagattattctgaaaggatggaattgccatttacccagctggggaagactgtgggaggagcaggccagcgattcatgacttcccagccctctctgaagcctcaactgcagcccaagggctccaggtgagacccagccctcttccttcccaggaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtcagtagtgggaggctggtggggagcaggctactggctacttggggaagtgtgccaaaggatggggagtgggaaaattggtgaggggccatgggaagatgggctaatggtgaggaccaatgggacagggtttcaatgggagaaaggtcaagggggagggagagtgaatttgggagctgggccagtgagtgaacagccaatggaaaatgtagaccaatgggtgaatagcatgggagagatggaacataagatgaaggttcaataaagagggaaggtcagtggggagatgctaatcaggaaggatgtcaaaggtcaaaggggactgatcaggattcattgaacagcaggaaggaataatggagaaggaactgatggaagaagagaaaccaataaagcacaaaagccaactgaaggatgtgaattgagacagtgaatgggggtatagctgatggaagagggactaaggggaaaggatcaatggtccagaggagtcactagaggaaaaaacaggtccaatagatcagcaggatccatgaaggtgggcctgtgtgtgaagggccaataagaaaggtgaaccattggatgaagggccagtgggaaggcagagacaatgggggaggatgcggcaagttagaaaaggaccaatgagggaggtggaccattggatgaagggctaataggaagggagagccagtgggggatggtgaggccagttagaaaaggaccaaggagggaagcagaccaataggaagagagagccaatgagggagggcagggccagttaggaaaggaccaatgaggaaggtagaccattggaggaagggccaatagaaagggaggatccatgagggagggtggggacagttagaaaaggaccaatgatggaggtggaccattggatgaagaaccaatagaaaggaagaaccaatgggagagggcatggccagttaggaaaagaccaatggtcacagagtgaccaatcaagatgaatcaatgggcaggaagtgtccaatgaagaatggactactgatcaggaggggtacagtagaggagggcgtaacagaggaagagtcctccaggtcaactgaaactactgaagaaggtgggaccagtggaagagagaaaagtggaggagggacctaagagaaaaggaaaaccaataggaaatgaggactcctggagaagagactattaatgaggaagacagccaatgggggggaagaatgatagaaagagggaccaattaggaggcagggacgatggtaatgagatgtaagaatgagagacaaacaggaagaggggtgccaatagaaaagagggaccaatagaggatggaggacttataggggttggggggtgactggggaggatgaggggagtgcaaggcctgggctgagtctggcccatctctcccctaacaggtgatttccctgacaccatccagtgtgcatacatccacctggtgtcccgtgaggagtgtgagcatgcctaccctggccagatcacccagaacatgttgtgtgctggggatgagaagtacgggaaggattcctgccaggtgaggtgacccggatctgccacttacacagccagggacaggacgaagtcacaaaaacatggccagacacaggaagagagagacacaggccaaaagagagctttacagagacagatagagacaggctgagggagaacccaagccttgaaaagaagagacttagttcaacacacagagacacagtcagggatatgcagagatataaagacacagccagcagagacaggaagtgcagagacaaggatggaggccgcgggatcaagaaccagagaggccaggagcagcggctcatgcctgtaatcccggcactttgggaggccgaagcaggaggatcacctagggtcaggagttcgagaccagcctgatcaacatggtgaaaccctatctctactaaaaatacaaaaattaggatgggcacagtggctcatgcctgtaatcccagcaccttgggaggccgaagcaggaggatcacctggggtcaggagttcgagaccagcctgatcaacatggtgaaaccctatctctactaaaaatacaaaaattaggatgggcacagtggctcatgcctgtaatcccagcaccttgggaggccgaagcaggaggatcacctggggtcaggagttcgagaccagcctgatcaacatggtgaaaccctatctctactaaaaatacaaaaattaggatgggcacagtggctcatgcctgtaatcccagcaccttgggaggccgaggtgggtgaataaccaggtcaagagattgagaccagcctggccgatatggggaaacctcatctctactaaaaatacaaaaattagctgggcgtggtggcaggcgcctgtagtcccagctactcaggaggctgtggcaggagaatcacttgaacctggaggcggaggttgttgcagtgagtcgagatcatgctactgcactccagcctggcaacagagcaagattccgtctcaaaaaaaaaccaaaaaacaaaaattacgcaagcatggtgggacacacctgtagtcccagctactcgggaggctgaggctggagaattgcttaaacccaggaggcagaggctgcagtgagctgagatcacgccactgcactccagcctggggacagagccagactctgtctaaaaacaaaaagaaccaaagagaagtagtaaggaagcagatggtgtgaggggactgtccttcctcaaacagagcccccacgagtcctgctcagaaacgaccaggctctggaggagggagacactagctggggaaaggggactccctcccgaatactttaacttgggtttcctccattgtcatccatccaggctctcctctttatgccagaatgactaatgcactgagggatgtgcagagaccaaccaagggggagacacaggcagaaacggagacacaggcagaaacagggacagagacagggaaagcgatacatagcaagttggacgcaaagaaagggcaggtgggcgagactgtcctcaagacacgaggtggagaggtgtccctggacagaatagtgccaggcatatctctccctgggccctccctacctctcccacctgggtcttatcgtctcctcctccccctcctccccctccccatcctcctccccctctccatcctcctccccctccccatcctcctccccctcctcctccccctcctcctcccccctcctctccctcctcctcctcgtcttccccctcctcctcctccttctcctcttccttctcctcttcctcctcctcgttctcctcttcctcctcctcctcttcctcctcccccttttcctcctcctccttttcctcctcttctcctcctcttccttctcctcttcctcctcctcctcttcctccttctcctcttcctcctcctcttcctcttcttccccctccccctcctcctgccctcttccccctcctccccctcctcccctcctcctcctcctccccctcctcctcttcctcattttctcctcctcctcttattcatcttcttttcctcctcctccttcttcctcttcctcttcatcttccactgcctcttctcctcttcctcctcctccctctccctctccccctccccctcctccctctccttcccctcctcccccctccttcttcctcttcctcttccactccctcttttcctcctcctcttcctcctcctccatctccctgaccccctccccctcccctcctccctctccttcccctcttccctctcctccccttcctccttctcctccttcgtcttcatcttcttcttttctctctctctccatcggtctctacacctctgcctctctccacacctctcagtctccattcttaaattgtttctctttcttgctctctatgttcctctgcatcttggcattcctatctctgtgtctttgagtctcctttattctctctctaccattctctctctgtgcctttgtgtgtcttactgtctctctctctgtctctctgtccctgagtctttctctccatctttcagtaagtacctctgtccctttctacctctctctctgtcacacacacacacacacacacacacacacacacacacacacacacagtctctgggtttctatctgtatctgactttctccctctttcctgcagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccataaggcagtggctgttggaaagatttaaggtttcacacctatgacatacatggaatagcacctgggccaccatgcactcaataaagaatgaattttattatgagtggggctttttgctttgatttgacgtccacctttctgaaatctagatattctcagttctcctttacagccaatttgatttttcctcccctccaggaaggcactcttgatgcctccaccttgtgctatacctcaaagatggcttttgcccctaaatttttttttccctccccaagatggagtcttgctctgtcacccaagctggagtgcagtggcgccatctcggctcactgcaaccttcgcctcccgggttcaagcgattctcctccctcagcctcctgagtagctgggattacaggtacgtgccaccatgcccggctagtttttgtatttttagtagagacggggtgtcaacatgttggccaggctggtctcgaactcctgacctcatgatccacccacctcggcctcccaaagtgctgggattacaggtgtgagccaccgcgcccagcctaaacttttgtcacagccaaaccaggaaggtgggagggtaggaagaccaccatgcatgggtaacggtgatgggagaggagggcagggatcagatccccaaggatctcagatgccagcatgagaggctgaaaccttctcctgagggcactggggagccatggaaagtctgtgagctggggcagccctagggccatgtgcaggatgaaccagaggggagaccctggaggctggggctggggaggaggttgaggtgatgatgcagggagagaagatgagagttgaggtggggctgggcccaggaggggtggaaaggaaggctggatatgaggtcaccctttggagaagttcgggtgggtggcattctcacagaaggaacaacatgtagacaatcctgggggtgtgaggacacctgtgaatcgtcctggatggtggaggctggcgtttgaggtgggagaaatgaatgatatggctggaaatgtaggtcagcggaagatgatgccactgagcgccaggcagaagaacttggacctgatcccgagggcctggagaaaaggaaggacgtggtcggatctgggctttagaaagaccctatgatctttgccttaagaatcagagaaatgcaacattctatcatggggacgtgatggaaggaagtggctgactttgtgacttgatggaattatgaagtcatgtgaatgacctgggccccccttgagcaaccttctccggaaaagccgtgaaattcaccagggtcaccaagaggaacccagccaatgacggtccagaccaaaatcagctgcagttaattgagagaaaattgactttctttttttctttttgagacagagtctcagagtctcactctgtcacccagggtggagtgcaatggcacgatctcggctcactgcaacctctgcctcccgggctcaagcagttctcctgcctcagcctctgaagtagctgggattacagctgtgtgccagcacacccagttaattttttttttttttttttttttttttttttttttttttttttttagtacagacagggtttcaccgtgttgaccaggctggtctcaaacttccgacctcaagtgatccatgaatctcagaatcccaaaatgttgggatagcaggcgtgagccattcagaaagaaattgactttctgaatggataataagaataatgatagtcatgacaacagtaataataataatttaaaatatactgattagcacttaccaggtactattctaagtgccttacatatattaactcatttgatcctcatcacaagcctgtgaggtggataccattattgttcccattttacagacagggaaaccaaggcacagagggggtccatggtgtgatcaaagcctcacagctagtagatggctacaccagaatttaaatgctaggggctggttccacagtttgggctcctaaccactcttctgtgctgaagtcttcttgtaattctgagatgttttggaactgagcattaaaatgtttagacatccaacccttcttatgaa

SEQ ID NO: 13585 - DNA, 15206 bp, Human
aaaaaaggcagacactggatagagatttggcagccttgggaagcgaagaaaaacaaaaaaacaaacaaacaaacataaaaagacccaaagtaatgctgatctcacctcatagagatcagttcgctctccctctccaagagtgtgatactgtgcttaataaactgctgcttcttgctttgctgtctgtgtgtgtctcatccaattctttgtttaagacaccaagagcctggaactgcatggcaccatccggtaacacttctgcccactgagatactgcaaatatccttatggggagagagtggctgggcaaggaggaggcgcccaggaggcagattggtctgcaggatgagatactagctgcaaatgcagggattggaggtgagggcggggagtggcttcggacgcccaaacccagcatcttcctctctcaatcgttacagccaaatgatctctaggttatggacaattaggggacagtgtgggctgagcagatcaatgcagttgtatggaagaaaacagactgggattttctatgtatacaacatcttcaggaaaacctacgtgaagttagaattttcaaggcagcatgtgccgatgataaaactacatagaacagcaggaagactattatcattaaagtgaggctaggggctccttcaggagggagcgggggcatggccaataggaaaggggaatgtaagggtgaatgaattaataaaatctctttcttcatttcaagggacagacttgacagttcttttgtgttctagttcttcaagggtgcttattttgtgtgaatcactgagttggtttttaggggacacttttatgtacatgtcttgtgtttctccccgctcaaaaaaaactgtttcaagaaaagctggcctggatctaagggggctgcagcttgcaggatttttcccacatcctcccagcccagtcacacagtttaaaataatcttctgttgaagtcaggtgcgtgtttcttctctcagaaaatcgcgcccatcactgagggtggacgccccggggctggtgtctttgctccacgtctcctgttcacctgaacccctaggagcagttcctgcaggagcaaagccccagggccagcagacccctcacactctgcactaaccaggcctcatgagatagcagtggtgaagggaaatgtccttgtgctcagagagctgtgaggatgggaatagtgtctgctcttttcatattgatcctttcccttatgactttcctgtctaccaagccccacaatacaacaatcacagcctcagcttccccggcctcctgcaggctgggctcccctccgtgtccttggcgtgtatcaacaggcggaatcctcaccttcacagccccatgtccgtctgctcggtcctcctgagactgaacccccgacctaggggagagtgaccccaccctgcctgtgccccccactgaagctcctgtcatggggagctcaaacgtcaggagactcagtgtctccccaccacacagtgactccttggggacagtgtccggctctgctgtgttgacctcattgtgcagaaagggggtgcccacctcgtggctgctgagggagggatgagaggctgcctgttcaccccacctgcacccctgtctctcatggccccgagtcccacttctgagctacgcagacatccacagcctgtgactcaggggtctgggcagatgggagttattttcaccctgcagaaaatatcacctaaagggaaaggcattgagagggaggcaggaggtggggtgggccctgcatggggtgggaatctgggtgagtctgtctcccgctctggcctcagggacccaggagtgaatgtcgggtggtggacggtggatctcccagggctgacccagccctgacagtgtctgtgtgtgaagttcttcttctaaggaggtcactgttttgacctcaccaccgacttcctgtagggcctcttctaagtcttgagcccgcagttcctgagagaagaaccctgaggaacagacgttccctcgcggccctggcacctccaaccccagatatgctgctgctgctgctgctgcccctgctctgggggagggagagggtggaaggacagaagagtaaccggaaggattactcgctgacgatgcagagttccgtgaccgtgcaagagggcatgtgtgtccatgtgcgctgctccttctcctacccagtggacagccagactgactctgacccagttcatggctactggttccgggcagggaatgatataagctggaaggctccagtggccacaaacaacccagcttgggcagtgcaggaggaaactcgggaccgattccacctccttggggacccacagaccaaaaattgcaccctgagcatcagagatgccagaatgagtgatgcggggagatacttctttcgtatggagaaaggaaatataaaatggaattataaatatgaccagctctctgtgaacgtgacaggtaaggcacgggctccaagagaggccaaaggcaaatgtgatgagggctttagggcacggctgagacgggacacatgtcctgggagggggccgggggtgatggactcaggagaggagctggaccagagcctgagcttccccaggaccgcaccttggatgcccctcctgatcctgcaggcccctcccctcaccagccctgacccacaggcctgacatcctcatcctgcctctgacgctggcattgtggcatgtggggccttatgactccttgttttggggcctgtcctaggcatggccggggtttagcaccatcccaggcctctccccaccagatgccagaagcacccactccacccatgcagtgagacaataacaattatctccacacattgttaaacgtcctggggggttaagtcctccccagttgagagccttaggtctacacaaccccgtgactctctcaggccaggccagggaggaagcacttcctggcgcaaaccaagggcagcagaggcacctgagcctggacagggagactcagcacacggcccctccatctctcatgccctgaggtcctcggagatccacatttagatgctcaaaagacaggagggacctccacgatggtccagaggccgggagggcaggacctacgtgtctggtgcaggccctggtgctccagggaagcccggaggtaggaggtgggacacggtctcttctcctccctgggtgggtctctagggtctctgagcttcagggtttccttcactctgtgcagagggaaccagttcctatagcatgtgggtttgtagtttctctttcgtgctgggttgaggtctccagctcctctccagcccctctccagccccctgtgggtcccacagccctgcccctcctctccctcccacttctctgctcacacaaggagcccaggaaccctctgtctcagagatgctgctgcctctcttgtgggcaaacgaagagagggacagtcggggctgggctgagcctcatttccccacagcgtcccaggccccactgtcaagatacaggctggaggtgctggagttggtgatggtgcaggagggctagtgcgtctctgtgccctgcagtgtcctttaaccctattacaactgaactgactctagccctgtccatggatgctggtttaagaaagggatcaatatacaatggaataatccagtggccacaaacatcccaaatggaaaagtgcaggagacacggggccgattccacctccttggggacctgaagaccaacaactgctccctgagcatcagagatgccaggaagggggatttgaggaactactacttccaggtggagagaggacagataagatggaattacaaaacgaagcagctctctgtgaatgtgacagataaggcacaggctccaggagacaccacagggaaaggtcatgggggtggcagcgaaaggctgggatggggcccctgccctgggagagggctgagggtgaagcgagttgggctcagggcagaagctgaaccagagcctgagcttcccccagggctgtaccatggatcctctgtcctgatcctgagtccccctctcttcaccagccttgacccacaggcccaacatccttatccccggtaccctggagtctggctgcttccagaatctgacctgctctgtgccctgggcctgtgagcaggggacgccccctatgatctcctggatggggacctctgtgtcccccctgcacccctccaccacccgctcctcagtgctcaccctcatcccacagccccagcaccacggcaccagcctcacctgtcaggtgaccttgcctggggccggcgtgaccacgaacaggaccatccaactcaatgtgtcctgtgagtgctgagccaggacgccctggtccctgatgagggggggacgtccctgagggcagaggatggggtcagggctcgacactgggtgctgggtcccagaatctgggctggttgtgggatcaggaggacgctggctccgccttccccatttatgcagctcctggggagacagggccagtgtccccagccctcacagtgatgcaggtctccatgtctttctgtcccagaccctcctcagaacttgactgtgactgtcttccaaggagaaggcacaggtaggatggagccccctccctggggctgggggagcagggccttcagctcagggcagggccaggtccctcctcatcctggactcaccctggtgatatgagactcccttgtagttgaacccaggcctcctccccatccttagcctctgtggccacctgagcacctgtcctcttccccccactcccctcagactcttgcacacacaccctcctcagccctgcagccaggacagggggaaatacatatagcaggagcagcctttgggcctcttatcttccatctcctgaatatgccacctaactcgtctttttattttacccaatagttttgagctacgttcttttggatacatgctataatcacgtgggcaaaaattttaaattcacagtaaaatgtgtccccagaatcaaccagggtctgtccaggctgtcctgagccttggtttgtgcacctggaagatctcagaggtggtttgatgtcagcagtgagactgtttgcaccctcttctagggatgtgtgtgattccactgtctgaatagtctctgattttgtggcatctcctaatggaagatcatggcactaattttatcctacggcacgaacactgcaatgaataatgttgtatctactcccacaaggaatatctaagtgtataggataaattcctaaaagcacattttaccagtgtcatatgttctttctgattttgaaagatatggtgaagttgtcctcaaataaaggtgggcaagtttacattcccaacagtgagcggtgaacataagtatgtccctgcaccagcctacatcactctctgttccattccccagtctcattctgtatccttcctccctgtttcaatcactttgtctctttgaacctccaactttttctctacagcatccacagctctggggaacagctcatctctttcagtcctagagggccagtctctgcgcttggtctgtgctgttgacagcaatccccctgccaggctgagctggacctggaggagtctgaccctgtacccctcacagccctcaaaccctctggtactggagctgcaagtgcacctgggggatgaaggggaattcacctgtcgagctcagaactctctgggttcccagcacgtttccctgaacctctccctgcaacaggagtacacaggtgggtaagggaggggctggaggaggagaacacacctgccccaccctcatgggccacccactgcccctgagcttcaagggggagctcagctctggtctgtgctcagctgtgaggcctggaacttccctgcaacccagggcactgctgtcctcttcctgccaggaaaggtgtgtaaggcaggaagaggggaggagtgggtcttggaggggaggagctggggcctggacaggtgtgtttggggagacacgtgccttgctttccagtgcctggactagggtgacacaagcaaggcactcacttctgggcacacgactaaaaaacaaaaaataaaacaactcagcaagcaagtgaaataatattggatgtgattatctttattaaaaactaaaaattattgcaaaataatttgacagtgaatacaaatcaaaatttcaaatacaggcaggctgtgcttaccactctcatgcctcagtgacctcaggagttgtcccttcctcctccctcccattcttgccctttgtttctgggaagggggattagggtacccaagttgggggccttataggaagtgggaggagaagagacccagttcttggagttggatcaccaaaacaattccaatccatcctcaggcaaaatgaggcctgtatcaggagtgttgctgggggcggtcgggggagctggagccacagccctggtcttcctctccttctgtgtcatcttcattgtgtgagcactgaccctagggagggagggagagtcctgggggagggcggactgggagcaggatccctgaagccagagctggaagggactgcatgggtcaagagcttggggcaagaatgagctcacgggtgcgtggcaagaatttcaagagcgcccttgtctgtggggctccacatctgtggtgaaccttgggccccaccacccaggaggcaggagcctctgttttcaacactggggtctctgggactggaccaccctcctcccacctcagttacccctccagcgccccaacaggaaatacagggcaggggttggtctgcccactgcaccccgatctgaccacactgaaaggctctctggtctcttcactcagagtgaggtcctgcaggaagaaatcggcaaggccagcagcggacgtgggagacataggcatgaaggatgcaaacaccatcaggggctcagcctctcaggtgagtgatatgggcgtctccacacccagcatccagctgggacatctcccacaggatggcctccaggatttctctgcttatcatggccaaaattatctcctcatctcctcctccttcccaccatccagcttctcctgcaggattccccatcttgctgactgcatgacagtccctcctacctactttctctcgggccaggcatggaggaggagttatctcctctctgtcctccctttcttctctatagctccacattcaccaaatcttgtccatttttcctccctaagaatggctagcattgctcccacccccaccaatcctaaactctctcaatgctgaggcctgaggatctctgtcttggacttcctcacctccctgcctcttgtgtcccctgccctgatgggaggaatcattcagaagccatcactgatcagtttctttgcatctggacagctgttcccacccccaacactgtctagagcagaagccagaaaatactatctggaaaggccagataggaaatatttttggctttctggcctacacagtctcattgcagctcctcaactctactgatgtagcaggaaatcagccgtagaccatgtgtaaatgattagctggctgtgtgccagtaaaactttatttataaaaacaagctgtgggtagaatttgtcccaagggctctagtttgacaagccctaacctagagaaaaagcccaaacttcataactgcagccctgcacattctcgtctcttaaacatctacctctctagcagggctggaattagtgtgagatgagtgaggtcctggcctagcatgcaaaatttaagaaggtgccaaaaatctcagtaattgtgatagttttaaaaaaaactcttattttaggtttgggggtacatgtgcaggtttgttacatacataaactctggtcagaggggtttgtggtacagattattttgtcacccaggtcctaagcctagtaccccacagttatttttttctgttcctctctctcctcccaccctccaccttcaagtgggccccagtgtctgttgttctcttctttgtgttcatgagttctcatcatttagctctcactgataagtgagaacatgcagtatttggttttctgttcctgtgttcgtttgctaaggataatggcctccagctccatccatgttcccacaaaagacataatctcattcttttttatggctgcacagtattccatggtgtatttgtaccatattttctttatccattctgtcatggatgggcatttaggttaatttcatatatttgctattgtgaatagtactacaatgaacatttgcttgtatgtgtctttatggtagaatgatttttattactctgagtataaaaccagtaatgtgattgctatgtcaaatgatagttctgcttttagctcttcaggaaattaccatactgctttccacagtggttgaactaatttacactcctgccgacagtataagtgttcccttttctctgcagccttgccagcctctgtgattttttttactttttaaaagtagccattctgactggtgtgagatgatatttcattgtggttctgatttgcgtttctctagtgatcagcgataatgagctttttctcatatgtctgttggccaaaaatgtctgttcatgtcctttgctcactttttaatggggttgtttttctcttgtaaatttgtttaagttccttatagatgctggatattagacctttgcctaatgcatagtttgcaagtattttctcccattccggttgtttactctgttgatggtttattttgctgtgcaggagctcttaagtttaattagatcccatttgtcaatttttgcttttgttgtgattgctttggcatctttgtcaggaaatctttgcctgtttatccagaacgatattgcctacattgtcttccagagtttttatagttttgagttttacatttaagtttttaacccatctcgagttgatttttatatgtggtataaggaagcagtcccactcaatcttctgcatgtggctagacagttatcccagcaccatttattgaatcaggattcctttccccattgcttttttttgtcagctttgttgaagatcaaattgttgtaggtgtgtggctttatttctgggctctctattccgttccattggtctatgtgtctgtttttgtaccactaccatgctgttttggttactgtagacttgtaatatagtttaaatttgggtaacgtgatgcctccaggttttctttttgcttaggattgccttggctatttgggcacttttttggtttcatatgaattttaaaattgttttttctagttctgtgaagaatctcattggtagtttgatagaaatagcattgaatgtataaatttctttgggcagtatggccattttaatgattttgattctttttatccatgagcatagtatgtttttccatttgtgtcacctttgatttatttgagcagtgttttgtaattctcattgtagagttctttcacctccctggttagctgtatttctaaaaattttattctttttgtggcaattgtgaatgggattgtgttcctaatgtgactcttggcttggtagttcctgatgtatagaaatactagtgatttttctatattgattttgtatcctgaaactttgctgaagttatttatcatttaagaagcttttgggctgggactacgaggttttctagatatagaatcatgcatctgcaaagagggatagtttaaattcctctcttcctatttggatgctctttatttctttctcttgcctgattgctctggccagaatttccaatactacgttaaacaggagtggtgagagagggcatccttgtcttgtgctggctttcaaggggaatgctttcagcttttccatattcaatatgatgttggctctgcgttcaccatagatagctcttattattttgagatatgttcctttaatacctagtttactgagagtttttaacatgaagcgatgctgaattttatcaaaagccttttctgcatctattgagataatcatgtgtttttgtctttagttctgtttgtgtggtgaatcacatttattgatttgtgtatgttgaaccaacatgaagccgacttgatcatattggattaaccttctgatgtgctgatggattcagtttgcaagtattttgttgaggatttttgcatcaatgttcatcaaggatattggcccgaagttttcttcttttgttgtgtcttcgccagattttggtatcaggatgatactggcctcatagaatgagttagggaagagtcagtcttcctccgtatttgggaatagtttcagtaggaacagaaggaggctcagatctgacatttattgtgtgattgaagagccttccaggcagagggaggagcaaagcaaggcccaggcacaggaagaggaaaggagaggagccatgggacatctgtgtgattagacagagggaggcaggactgagagcaggaaatgactttggaggagttgagcctatgtgaattgtgtctgactgcacaggctactgtgagcatttggagagttttgagcagaaggacatgatcagacgagattgggtccgttcagggtggtatagctgtagaccagaagaacatgatcaactttcattttcatgggattcctctggccactgtgtgcagaagagaccgtgtgtgtggcaggggaaggagagagcataggaggtagacaggaggctggtgaacatcccaggcagaaggtggtgttggctggaaccaagatagcagcagtggtagacatgactgtctcccagatgaattctgcagtggaacctactgggatttgttaatgaattggaattagaatgtgagccacagaaagggagcaagaattacttccagatttttgccctgagcagtgggaagaatggaggtgccaatcattgaggctgagaagattgcagaagaaatggatttgggaaagaaaaggaggagttcagattgaataggttgagttttgtgtgtctttggacaagaacgcgggggtttgaattataccactggatcaaagactatagtcaggagaaaggagtgggctgggggtacagatttgggagtcattagcctattgatggcatgaagccaacacagtggataagatcacaaggcaaaggtaaagaagaaaagaacccggggctgctctgatatttaaggtcagggagacctgaagcaattggcaaagaggttgccaagaaggtgaggtggacccagaaaagcatgatgtcctatagttgagtcaagaaggccttctgtgtagggaaggtgagcagctgggtcctctgctgctgaaaagtccaggaaggagaagactgcaaggtggacatttagactcagccacttaagtggtagtcacagtgaccttgatagtagcagtgcttagacttggtatgtgtgtgaatattaatttgagtaatcaagagagaatctggcaagcaaaatcactgacagttccatggagcatcttctgcacaggggagcagcagggaagggctgcgatgaaggaggaccctcccagacagcctctgtcactctctgctgtgtgagtctgtattagtttcctgtggctgctgtgacaaattaccatgcatttcctggcttccaacaacacacatggattaaagttctgaaggtcacaaccccaaaatgggtgtcactgggccaaaatcaaggcattggcaggcagggctggttccttctggaggctccaggggaggatgcaatttctcaccctttctggcttctagaggcacctgcattccttggctcaagtcccttcctctgtttgcaaggcaagtagcctggcatcttccaatctctctaagccctcctcctttcacttgtaaggactcctgtcattccactgggcccacccaaataatccaggataacctccccatgtcaatatccttaacctagctccatctgtaaagtccctttagcaatgtaacgtaacagattcacaggtttcaggggattagggtatggacattttggggagcagttatacttcttatcagaggatataatttctttgactgagttgtcctccccataccaccgaactgtgagcttcctaagagcaggtgccccatccaaatcaaggccctgtaattctctctcacttagcctcttcctgcccatcttataattcacacatagatattcgtttgtttgacagtcatttttgccaaattccctcaattaaaaagtgagtttcaggaggtcagggccaacacctactgtgtccaccacagtccatccagcacccagatcagggcttcacacacagagggccccagcaggactccaggctttggggtcagaaggaagggactggattgggtcccggcataacagggagtttgggtacgctactttcttcatggagttgttgcgggaagttaataagattaataaacaccaaacaagttgctcaataagtgttaaatattgcaggaaagtataaatgaaggagatttctataaaatgaacgtgggatagaggcaggaactcatgaagtttaattctatacagagcaatatatccgaaccaaccaaccgatcaaacaacttgtgactctccctgccttatcctatttccactgctctgctctgactctcttctctctctccattcagggtaacctgactgagtcctgggcagatgataacccccgacaccatggcctggctgcccactcctcaggggaggaaagagagatccagtatgcacccctcagctttcataagggggagcctcaggacctatcaggtcaagaagccaccaacaatgagtactcagagatcaagatccccaagtaagaaaatgcagaggctcgggcttgtttgagggttcacgacccctccagcaaaggagtctgaggctgattccagtagaattagcagccctcaatgctgtgcaacaagacatcagaacttattcctcttgtctaactgaaaatgcatgcctgatgaccaaactctccctttccccatccaatcggtccacactccccgccctggcctctggtacccaccattctcctctgtacttctctaaggatgactactttagattccgaatatagtgagattgtaacgtgtttgtctctctgtgcctggcttatttcactcaacataacatcctctaagttcatctgtgttgtttccaatgacagagtaatgtactgaataattcaaaatagctaaaagagaggagtttaaatgttgtcaccaaaaaaaaaaaaaaaagataaaaatttgagctgatggatgtgctaatcatgctgacttgatcgttccatggtgcatcgaggtgcgggagcctcacgggggctgcgttcaggtcgctcaggtactcagggcaggactggaatttaatccctgcctgattctgaggtctcttctctcacccggcacccagcactgagtgaagcaaccactgactgggcaccccttagccataagtttgcagcatctccgttgactccatggcctctggtgaaggaatccgagaacctggacacacaggagctgagaaaggaggcgcctgaaattacagcccagctctgcgcatggcctgccccagcctgcatagctctgatcagcagatagagcttccaatggccatgctgcccatgatttcatccccagggccctggttgggtctgcagacctccgccaggagcccccatctccggaccttggtgtgactgggctgggtccctctcttgctggtcccctccagagggaccctggaccctttccagcctcacaggccctatggagaccccagcccttctccatcaccttctcctcacctgcttgcccctctggtcttgtcctcgggtctgaggacatgcagcctgatttgccctatggggagaaatcagggaagaagtcacatctcaggtccataaaaaacacgggagagtcctgggtagagaggtgaaggggcccaacttcctgccaagtccaagcccaagccctccccatgtgggaccctaggaggtagaggagatggtctgcggtcttcacctctccactgagagtcctcaacatcctcatacttttaaagatttccaagggcacaggaggcagacgccattgtgtgggggaaagaggccgggtgaagctgaggaaggagttgacactgttggcgcaattaccaggggtaagtaacaacaatgatggagttaataataataatttatttcacactgttatgtcatgccataagacgtgccatcaactctggaaattaggttagttattattacccctgggggcagggagagcagcttgtttatcttttgttattagaggcccaagaatcaagccaagagcttggtgaaatttgtggggagtagagatttgtcatggtcatggagctatgacaaaatcccgtcccatccctgcatctttctaattcctcatcttggagggagctgaggggaacagttgaggccacaggctgtgggttcggcctgcccgggcttgaatcccacctcttctgtgggttagcactgaagccttaaataaaatactcaaactccatggggcttagttttctcacctgtaaagtggaggtgaggctaatcacattcactttctccatagagagacagtgagggtcaagcaggttagaatggtggtgggcacatggtaagtgcacagctaatgtccaccactcttatcccccttatccccctgtgactcaccctgactctgatctgaggactccagaggattcatagaggaggcatctttggacccagacctgagaggactgggagatttcacccagaggttgtgagcatgtcatggcagggtggaggtggcactcctgagggtgggcactgcctagcagggcatggaggcagggagatgtgcagagcatgagcctggacgggagctgctgcactcacggggggcctggatcctgacgtccatgtacatgatcagctgtgtcacggggttttccacagtgcattggtaagtgcccatctgctaccaggccagactcaagagatacaactttgcatatgagaagtttaggaaggagctgttgtggatccagcagtacttgagatctgggaaag

SEQ ID NO: 13586 - DNA, 15206 bp, Human; identical to SEQ ID NO: 13585

SEQ ID NO: 13587 - DNA, 10321 bp, Human
attactatagctgaacaaatgaacatgtccatcatctcacatagttacccattttcctcccctgtggcaagagcagctataatctactcatttagcaaaaatccttggctgggcgcggtggctcaggcctgtaatcgcagtactttgggaggccgaggccggtggatcacctgaggtcaggagttggagagcagcctgaccaacatggtgaaaccccatctctactaaaaatacaaaaattagttgggcatggtggtgcacgcctgtaatccagctactcaggactctgaggcaggagaatcacttgaacacgggggagtggaggttgcagtgagccgagatcgtgccattgcactccagcctgggtgacagagccagagtccatcaaaaaaaaaaaaaaataagaaagattcttctctcctctatgtgtccatgcagtctcatcatttagctaccacttgtaagtaggaacatgccatatctggttttctgttcctgctttagtttgtaagggtaatggcctccagctccattcacgtccctacaaaggacatgatcgtgttcttttttatggctacgtagtattcaattgtgtatacgtaccacattttcttaatccagtctatcactgatggacatttaggttgattccctgtgtttgctgttgtcaatagttctacaatgaacgtacgtgtccatgtgtctttaaacagaatgatttatattcctttgggtacacacactggggcttatgagagggtggagagtgggaggaaggagaggatcagaaaaaaataactaatgggtactaggcttaatacctgggtgattaaataatctgtataacaaacccccatggcgcacgttcacctacgcaacaaacctgcacatcctgcacatgtacccccgaactgaaaagttaaaaaaagaaaaataaatatttgcttataaattaataaatgaagccctcaaaaatgttctattagataatgttaagtacagacatttttgttataaatacataatatacaaagaaatctatgtataacatgattaaaatgaccataagaacatagatcctaaacatggcaaatattagtggggtggggttagggaaagcgttgtttttaacttacacctctctgttagagttgggaatgggttcaggcgtaattacaggcacgactgggatcagcttggacaagttcccccaggcgggccagaattaggatgtagggtctaggccacccctgagagggggtgagggcaagaaaatggccccagaagccgggcgcagtggctcacgcctgtaatcccagcactttgcggggccgaggcgggcacatcatgaggtcaggagatcgagaccattctggccaacatagtgaaacccggtctctactaaaaatacaaaaattagctgggagtggtggtgcgtgcctgtaatcccaggtactcgggaggctgaggcaggagaatcacttgaacctgggaggcggagctggcagtgagccgagatcgcgccaccgcactccagcctggcgatagagagagactccatccaaaaaaaagaaaggaagggagggagggaggagggaagaaagaaagaaaaccgccccagagaaggacccgagccagagcctattctctgagctcagcgactgcttgaatcccgctcctgcccctcagacccagcgcaccgggtccctcccccgagagcagccaggagggactgtgggaccagaatgtgcgggggcgcaggagctgggcaccgcccgtccttcggagggagggtggagagagagtgcagtggtgccaattgctctcgctgcgtcagggttccagataaccagaaccgcaaatgcaggcgggggtgtcccagagtcggctccgcctgcaccccagggcgctggggccgggcatggggcggggggtgatataagaggacggcccagcagagggctgaagattttggagcccagctgtgtgccagcccaagtcggaacttggatcacatcagatcctctcgaggtgagaagaggcttcatcaagggtgcacctgtaggggagagggtgatgctggctccaagcctgactctgctctcgagaggtaggggctgcagcctagactcccggtcctgagcagtgagggcctggaagtctgcaatttggggccttttagggaaaaacgaactacagagtcagaagtttgggttccacagggaagggcaagatcggagcctagattcctgggtctctagggatctgaagaacaggaattttgggtctgagggaggaggggctggggttctggactcctgggtctgagggaggagggcctgggggcctggactcctgggtctgagggaggaggggctgggggtctcgactcctgggtctgagggaggaggggctgggggcctggactcctgggtctgagggaggaggggctggggcctggactcctgggcctgagggaggagggactgagacctggactcctaggtctgagggaggagggactgggacctggactcctgggtctgagggaggaggagctgggggcctggactcctgggtctgagggaggaggggctggggcctggactcctgggtctgagggaggaggggttggggcctggactcctgagcctgagggaggagggacttggacctggactcctaggtctgagggaggaggagctgggggcctggactcctaggtctgagggaggcggggctgggggcctggactcctgggtctgagggaggaggggttggggcctggactcctgagcctgagggaggagggacttggacctggactcctaggtctgagggaggaggagctgggggcctggactcctaggtctgagggaggaggggctgggggcctggactcctgggtctgagggaggaaggtgctagggtctggactcttgggtatgagggaggaggaggttaggggtctggacttctgagtgtaaggaaggagaggccagagaaaggaatttctgggtctgagggaggaggggctggggttctggacccctaggtctgagggaggaggggctggggcctggacccctgggtctgagggaggaggggctggggccggtactcctgggtctgtggggggaggggctggggcctggacccctgggtctgagtggggaggggctgggcctgaatgctttctccttctcagctccagcaggagaggcccttcctcgcctggcagcccctgagcggctcagcagggcaccatggcaagatcccttctcctgcccctgcagatcttactgctatccttagccttggaaactgcaggagaagaaggtgaaagctggactgggaagtctgacctcacctcagggcccccactgaccctctccaaggagtccctgagtcagaacccttccctcctcaaacagcttccatcctgggaggaccagactgtcggctgaagcccccgctcttcctgcttctgctgactcagggggtctctgtcccctccaggccctgcctcctgtgctcagggtctctctgtggttccccagatgagatgcgcctcctgggtttctgagtgggctccttctgtctgtctctatccctatctcttgctttctctgtatttctccacacattttcatctgtctctgtccatctctgactctgggaatccctgaggtgcagcctcagccttcccctaatgctagctacccacgtgctcctccatgtctccatccagcccagggtgacaagattattgatggcgccccatgtgcaagaggctcccacccatggcaggtggccctgctcagtggcaatcagctccactgcggaggcgtcctggtcaatgagcgctgggtgctcactgccgcccactgcaagatgaagtaggtgccgcccaagtctctgctggaggtgcaccagcgtctccagctcgctatgggggtggaagggcagtctttctgtgcctacggctctattctcctctctctgggtctctgtcctcctctctctgggcctctgtaccccctctccctggggctctgtccccctctctccctggctctctgtctccctctctctgggtctctgtccccctctctctggatctctgttcccctctctctgtgtctctgtcccccattctctctaggtctctgttccccctcctctctctctgggtctctgtccctctctctctggtctctgtccccctctctctctggatctctgtccccctctccctgggcctctgtaccccctctccctggggctctgtccccctctctctgggtctctgtctgcctttctctctggatctctgttcccctctgtgtctctgtccccctctctctctgggtctctgttccccctcctctctttctgggtctctgtccctctctctctgggtctctgtccccctctctctctggtctctgttccccctcctctctctctggtctctgtccctctctctctgggtctctgtcaccctctctctctgggtctctgtcaccctctctctctggtctctgttccccctcctctctctgtgggtctctgtccctctctctctgggtctctgttcccctctctctctggtctctgttccccctcctctctctctggatctctgtccccctctccctggggctctgtccccctctctccctggctctctgtcttcctctctctggggctctgtccccctctctctctggtctctgttcccctctctctgggtctctgtccctctctctctgggtctctgtccctctctctctggatctctgtccccctctctctctgggtctctgttcccctctctctgggtctctgtcccctctcctctctctgtgtctctctcccccctcctctctctgtgtctctgtcccccctcctatctctgtgtctctctcccccctcctctctctgggtctctgtccccccctctctgggtctctgtctccctctctctggggctctgtccccctctctctctggatctctgttcccctctctctgggtctctgtctcccctcctctctctgtgtctctgtcccccctcctctctctgggtctctgtccccaccccgtcccccaggtctttgcacaccctctctgtcacagtgtctcttctgaatctgtgaatgtcactcctcgcagtgagtacaccgtgcacctgggcagtgatacgctgggcgacaggagagctcagaggatcaaggcctcgaagtcattccgccaccccggctactccacacagacccatgttaatgacctcatgctcgtgaagctcaatagccaggccaggctgtcatccatggtgaagaaagtcaggctgccctcccgctgcgaaccccctggaaccacctgtactgtctccggctggggcactaccacgagcccagatggtaggtggcctcagtgacccaggagtgcaggccccagccctcctccctcagacccaggagtccaggcccccagcccctcctccctcagacccaggagtccaggcctcagcccctcctccctcagacccaggagtccaggcccccagcccctcctccctcagacccgggagtccagaccccagcccctcctccctcagacccagcagtcctgggccccagaccctcctccctcggaaccaggagcctgaacaacagcccttctggtcctcgcccccatcctctctgactgacagctctccctgctcctccctgcagtgacctttccctctgacctcatgtgcgtggatgtcaagctcatctccccccaggactgcacgaaggtttacaaggacttactggaaaattccatgctgtgcgctggcatccccgactccaagaaaaacgcctgcaatgtgagaccctcccccccaattcctccccagtcctgggtaccctgtctgcatgccccagggacagagcttgacccgagtgactgggtaccaagcccggccttgccctccccccaggcctggcctcctcagctttttccacctcattctctgcctaggtcaggggtgggagtttacttaggggccaatgtggccctggggatgagacagagagtttaataggggtgagaaagtgggggtgggaccagggaaggagactgaggtgctggcctcaggcccaaaccttaagggggcaccaaaaacctcagtgattgagataaatcataatgcaatatttaaaaataaaaataaaaactcatgcagaagtccatgatggacaaaatgtcacattttaaataaagagcaggtggatcttactgaattttcccttgccgtaagtactagcgtggctcagcacagcgctgtactggcactgtcttcatttaaaatgtggataccatgcccatcatgcagttttatgtattacatttgatttcgttaagtactgcattgaagtattgtgtattgcagttactgagattttgtgcctgaagctgatgactcactcacctgaccctggccctggtcccggggaaaacactctttctctccacctcctctctgttccctctttctggccttttgtcatcccctctgtttctgaacagtcttcccacatctctctttgtgacataatttcatttcattcttttcctctttgttttttctctgtgttgagctagcttgctctccctcccttgttctctctccatgccctcctctctgctctctgtcttctccctctttctcttgcttctctctctctcctcccctccctctctcctctccctgcccccctgctctctcttttttcctctctctctgtctcctctctggccctctcctctttctctctctcccccacttctctgtctctcttcatctctctccctcatctctccttgccccctcctttttactgtctctctctttctctttcttctatctctctcctctccccgccgctcccccatctctgtctttctttctctctctttattctcctcctctcttccagtctctctctcctctccccacccccaccccatctctctccccacaccttccccccctttctctttgtctctctcttctccctctttcttctccacccccatctctctctctcttctcttcccacaccctccccatctccctcatctctttgtctgtctctcttctccctccttcttttccacccccatctctctgtctctctctctccccataccctttccctcttcctcatctctctttgtctctctctcctttccctctttcttctccacctccaactctctctgtctctccacacccatcctccttgctcacatctgcaccttcagctgtcaggggatgtgggatggtgagtgttagggatagaggagatgggagagagatgactgtcctagagaatagggtgttccccttctcccctggtgagggccagtttcatgaatgtgcaagctctgcacggacacagagccccacactcagaagggtctcaaacttagtctaatgcattcctgctgttgtcttgaaattctcaataatttttgaacaaagggccctgcattttcgttttgcaccaagtcctgtaaattatgtaactggtcttcaccctggtctccgagaccatcgtgtccccctttcctgcgccacagggcacgcatccaccccttggagatgatgttccttctcccactagcttggagcagggtccttaacattggaaaataaagagtgctctgatcctggaagccccaccccttctctgcaattggtctcattggccaagggtcaaaccagtgtcttcaaaggacctagtgtgtccctagcactagctctcccattagtccccagagacaatgagtctcttctcattggctatggtggaagtccataatctgcaagacaaagaccgataactgaggaatgtatgagaatgagttgggctttgatctgaagccaaagttaatctccggctctattccctctagggtgactcagggggaccgttggtgtgcagaggtaccctgcaaggtctggtgtcctggggaactttcccttgcggccaacccaatgacccaggagtctacactcaagtgtgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatccaaaatgtagaacaagacttgaatttaccatgatattatttatcacagaaatgaagtgaaaccatcaaacatgttccaaaagtaccagatggcttaaataatagtctggcttggcacaacgatgttttttttctttgagacagagtctctgttgcttgggctgcaatgcagtgatgcaatcttggctcactgcaacctccgcctcctgggttcaagtgattctcgtgcttcagcctcccaagtacctgggactacaggtgtgcaccaccacaccaggctaattttttgtgtatttttactagagacagggtttcaccatgttggccagcgtggtcttgaacgcctgacctcagatgatccacccaccttggcctcccaaagtgctgggattacaggcatgagccaccacggccagcccacaatgatattacaaacctattaaaaatgatacttagacagaattgtcagtattattcaagaacatttaggctataggatgttaaatgacaaaaggaaggacaaaaatatatatgtatgtgaccctacccataaaaaatgaaatattcacagaatcagatctgaaaacacatgtcccagactgcatactggggtcgtcatgaggtgtctccttccttctgtgtacttttccttgaatgtgcacttttataacatgaaaaataaaggtggggaaaaaagtctgaagatctaagattggagagaggtgacctttcaggaagggagactagaaagaaatatgtgcctggttttgagccctggtcctgccggccctgttccagggcatatttccatttcccagatctcagtttttcctgtctgtaaaatgggagagagaggaaaggatggagagaggaagaaggaagggaggagggaggagagaacaggccaacttcatcagcgtgggaaggggtgtgaaagtgtttctgagcatctcacgagtgacaagtgaggagggaggctggcggttttcagagggattgggatgacagtagacaggacacaggggtcccacaggggtctgccagaagtaagcaaacagtgccggaggaagatggtggcacctgctccccaagaagggagggaaaggaacctcgggaagcgggtaggatgagggaggagtcctctgtgactcagagcctggccacagccccagccatctaacatcaaagatcctctgtgtggtcacacctcagacgctgctgaccgaggagccactccagcccaggacacgccctcctacctgttcttcctgtttttctcccagaattccctccccaccaagatcctccagatccttcccctccttatctcatctccctctgagtctctcctaacccaggcaccacagccctgtcatattgcagaaattctgcagccgctaattctgattctcccatataggaggctaacacagaaaacgcaggagtccaggcccccagcccctcctccctcagacccaggagtccagaccccccagcccctcctccctcagacccaggaatctagaccccccagcccctcctccctcagacccaggaatccagactccccccagcccctcctccctcagacccaggagtccagaaccccagcccctcctccctcagacccaggaatccagactccccccagcccctcctccctcagacccaggagtccagaccagccccagcccctcctccctcagacccaggagtgcaggcctgcccccacgagcccctcctccctcagacccaggaatccagactccccccagcccctcctccctcagacccaggagttcagaacccccccaccagcccctcctccctcagaccc

SEQ ID NO: 13588 - DNA, 9054 bp, Human
aaggccgaggtaggtggattgcctgaggtcaggagttcgataccagcctggcaaacatggtgaaaccccatctctactaaaaatagaaaaattagccggccgtggtggtgggcacctgtaatcccagctacaagggaggctgaggcaggagaatcgcttgaacccaggaggcggaagttgcagttagctgagatcgcggcactgcactccagcctgggcaacagagtgagactccatctcaaaaaaaaaaaagtaaaaataagcccggtgccgcagctcacgcctgtaatcccagcactttgggaggccgaggcaggcggatcatttgaagtcaggagttcgagaccagcctcgccaacatggggaaaccctgtctctactaaaaatacaaaaaaatgagccgggcgtggtggcacatgcctgtaatcccagttacttgggagggtgaggcaagagaatctcttgaacccaggacgcagaggctggagtgagctgagatcacaccactgcactccagtctggggtgacagagtgagacctctccaaataaataaataaaaataaataaaactaacaagcagcacgactccaaaatcagaaaacttgtaacgaccaaaaaagtgcaaacgtgccttaaatcagtcatgtgcgacaagcagctatagctagggtttggccgcaggctcagagaagcgcatgaatgagctaaagccacaaagcgcggggctggaggtttggctcccaagaagcgaggaaatgggttcggaactcttctgccaagtcccagtagatctacccggtaaacttccggtgagtttccaacttccgtgcggggcagcagcttcggctggtcctaagcggaccggaagttcgtcaagtttcacgctccgcccctcttccggacgtgacgcaagggcggggttgccggaagaagtggcgaagttacttttgagggtatttgagtagcggcggtgtgtcaggggctaaagaggaggacgaagaaaagcagagcaagggaacccaggtaggtgcacccgagagtggggagacgcaggaggagccccgaacccggggcttctcggcgctccccgcgtactccgctctgcccccttctctccttccatttcctcccctcggtaattcgcgcctcccgcggctgtttccagggcaacaggagtagttcactccgcgagaggccgtccacgagacccccgcgcgcagccatgagccccgccccccgctgttgcttggagaggggcgggacctggagagaggtgcgagggcggagcatgaatggaggaggcggggcggggcatgatgggaggtgatggggcgggacctgcagcgcggtgcgggggcggggcatgaagggaggaggcggggctgggggcggggcatgatgggaggagatgtggcggggcctggagcgaggttgtgggggtgcagtaggaagggaggaggcggggcgggggcggggcatgatgggaggggatggggacctggagcgaggttgtgggggtgaggcttggagggagggatgcatatggggcggggcaaggtgttgggaggcccatgatgggggctttaggggctgaacctggaaggttgagggcggagcatagtaggaggaggtggggtcagaatgagaaatagggatgcttggggcagaagtgaggtagagtcttaagaagaggaggtggggggaaactacatggcatggaggccgtgaaggcagagcatgattaaaggagaatgggccctacctagaaaaagcaggtggattggacctgagggggcggggcctacagcaggggcggggcttaagaccaagctgaaggctggcgtggaacagaagggggcaggtcttgttagaaggatggggagggtttgtaggctggcaggaaccagggttgtggctgagagtagggtctctggagagatggaaaaaaaagggaaagccctgtcaggacctgtaactgacctaacctaacccttcttagccccacaaggctctcaatcccctgtattctacaggctgctccgtgaccccaccatgtcctctcctaccacgagttccctggatacccccctgcctggtgagtgactctcttccccacccagcccttatcacacacgagcagaagctcactgtacctctcccggattccaccctcttccaggaaatggcccccctcagcctggcgccccttcttcttcacccactgtaaaggaggagggtccggagccgtggcccgggggtccggaccctgatgtcccaggcactgatgaggccagctcagcctgcagcacagactggggtgagacagggccctggagttgatgtgggggcttggggaggggtttaggaagggagaaagaaatagaaatgggaatgggaggccctgatctttgctttttgttcttgctttctccttaacatatacatctttctaaattgcaatttccctgaatgtgagcagcaactcctctctccctccatcctctggctctttgcctggggatctcctgtgggcccatctctctggttcctgtttctccttgtggctttctcatggcctctacctacccaccccagtcatcccagatcccgaagaggaaccagagcgcaagcgaaagaagggcccagccccgaagatgctgggccacgagctttgccgtgtctgtggggacaaggcctccggcttccactacaacgtgctcagctgcgaaggctgcaagggcttcttccggcgcagtgtggtccgtggtggggccaggcgctatgcctgccggggtggcggaacctgccagatggacgctttcatgcggcgcaagtgccagcagtgccggctgcgcaagtgcaaggaggcagggatgagggagcagtgtgagtgcagcgggagggggcggtgccggcctggccccccgcctagccctggggttctgctgaggcctgcatccccctacaggcgtcctttctgaagaacagatccggaagaagaagattcggaaacaacagcagcaggagtcacagtcacagtcgcagtcacctgtggggccgcagggcagcagcagctcagcctctgggcctggggcttcccctggtggatctgaggcaggcagccagggctccggggaaggcgagggtgtccagctaacagcggctcaagaactaatgatccagcagttggtggcggcccaactgcagtgcaacaaacgctccttctccgaccagcccaaagtcacggtactgccccctccacaaccttgagtgtgacggtcccaatggggtagagccagctgggccatcacccagggtgtgggagaatgaggctccagagggcaggggctttgggaagagggtcccccagggtgcaggcttggcctcaaggtggccacccagacttaggctcacaaagacctgggagtgaccctggtctcctgtgtcccagccctggcccctgggcgcagacccccagtcccgagatgcccgccagcaacgctttgcccacttcacggagctggccatcatctcagtccaggagatcgtggacttcgctaagcaagtgcctggtttcctgcagctgggccgggaggaccagatcgccctcctgaaggcatccactatcgaggtaatggtccatctgcccacaaggaaccccagagatagctccaggacagatgctgggagcagagttaaggaagaccagtgcttgccgttgtaggatgacattccacggcgaatagagtcttctatgagccaaggagagaaaggaaaaagggtctgaggctgagaaaattgaggatcaggctagaggcgctattgcagagaaaagttgccaaaaaggcttttcagaggagttagcatttgaatcaaagtagggataacatataagtattgagcacgtgctgtatgccaggctctattccaagtgttggcatatggggcaaagaacaaagcagatcaaaccccgtgccccaaaccttgtgctcacctggggaaagagtatcctaaggagatggggatgcagcatgtgcggaagcctgaagtggagaaagagctcgggctgtctcacgtgatggctgcacgctggtgtggctgagagaacaggggggaaggggacaagggataatcctggtgagattagacccccatttgggccaggaggggagggactagcagctgaagggtcacagggctcaagctccccctcccgctgccgcccttagatcatgctgctagagacagccaggcgctacaaccacgagacagagtgtatcaccttcttgaaggacttcacctacagcaaggacgacttccaccgtgcaggtagggcccaggggaggcttcggggaggcttggcgcccctgctggctggaagacctggggccaactcatccctgttggagtctctgtttctttatctccaaagttggggtgagggttgagccaaggtgagagtgaggtaagagtgcatgtgccacgtgtggtggtgcacgccaatagtcccagccactcgaggctgaggagggcagattgcttgaggctatagtgagccgtgattgtgcgacggcattccagcctggtgacagagaagaccgtgtctctattttttaaaaaaagcatgtattgagtgccgactctgtacattgggttgcagtggaagttgagatgggaggagccctgttaccacatcaggcatcttggtgggcattaggaaaagcattccccgcccccgccaaaacgtggtctcacccaagggaggcgggctggagctcggtccattgtgaagcgggcagccttctttactgtctaggggagcactgcttcctgccctctgagagcgctaacctgcgtgggtgggcttctggaagaaggcctgggcagtgagaggcactgcctaggaaaagggtgggaggagcattgctagtgctgcagagcatgcaccagggcctcgctccctcattgtcccacaatctctgggggacctctctgtatttcccgacatctgtccaaaccccaccctctccccttcctcttactccggccctttcaccacccgagacggtcccagtaacccttttagtatgagcttagcagggcagggctgcagggaagcgtttctggcagaggagattggcgattgcagaggccctgaggttggggagagctggtggtttggaggaactacagggaggcccaggcagctggagcacaaggagatggggtggagaggaggtcgggaatcccaccctaccccttcccagccgctcctctgccaccaccctggaacactgccagggtccccttgaggggccgcctgcctccacccctgcctgatggggctgctcacagcacaggcagaagggtcctgtcagcacttaaggctgcccacttccctcctccgctcagaaccctccgcggctcccgtctcactgggagaagagctagagtcctctctgtggcccacaaagccctttaggacctggcctcgctcactctctgccctcagctctcaccctctccccctgttccagccactctggcctcttactggcacccatccagcatgctgcagccaagggcctgtgtacttggagtttcctctgcccagaactagggggaccaactggtcctagtttgcccaggaccttcccagttttaacactgaaagtctcatggcctgggtagcccccgtcccaagtcatgggaacagcagacgttggtcaccctcacaatccctcatctccttcggattggtcactgctccagcgtcacccagagcgcagccttccctgcccgccttgtgtaaaatagaaccatggctcagcagggcccttcacacttctctgcactgcctggttccattgaactcacagccctctgacaggctgggcctcttcctaatgtgtttgtctatgaccggtcccctaggctctcaaatgtaagtgctggagcctggcacgtggcaggtactcagtgacatttgatgactgaatgaacaagtcagttttgggaatgagtttgggctttaccttgagcagtggaagccagcgctgggaccagcacgatgtgacctaggttttaaaagcttccctttgcctttgtgaaggggacaagaatagggactcgggaagctgcagccaccgcccaggtgggaagggagggtggtgataggatagtagaaaatactgaagaaacatgcaccctcattcattccttcactgggcagcatgtgtggcacacctactacatgccagcactcatgggcacggggcacaggtggacagaaatgacaagaacgctgtaattactgctgtgttcccagccccagagactgtgggcagcgccagggtccaggatgtggggcacggtttcgggctgagggagtcacgggctgcctcccgccccgcaggcctgcaggtggagttcatcaaccccatcttcgagttctcgcgggccatgcggcggctgggcctggacgacgctgagtacgccctgctcatcgccatcaacatcttctcggccgaccggcccaacgtgcaggagccgggccgcgtggaggcgttgcagcagccctacgtggaggcgctgctgtcctacacgcgcatcaagaggccgcaggtagggccccgcagagcctctgcgcagagccaactacgtcccgcggcccacgtggtccgttcaggctgggttctgccagccacactgccctcccctccgcagagtctttcctcaggccccaccctgctcgactgggagccaggtctagtccaagcacagaggcgggccccacgctggctcccacgcctggtcggggaggggccctcctttctgttggggtgggcctcccaaagcctggcagggcaggggctcagccagcgcccacctgcctcctccctcaggaccagctgcgcttcccgcgcatgctcatgaagctggtgagcctgcgcacgctgagctctgtgcactcggagcaggtcttcgccttgcggctccaggacaagaagctgccgcctctgctgtcggagatctgggacgtccacgagtgaggggctggccacccagccccacagccttgcctgaccaccctccagcagatagacgccggcaccccttcctcttcctagggtggaaggggccctgggccgagcctgtagacctatcggctctcatcccttgggataagccccagtccaggtccaggaggctccctccctgcccagcgagtcttccagaaggggtgaaagggttgcaggtcccgaccactgacccttcccggctgccctccctccccagcttacacctcaagcccagcacgcagtgcaccttgaacagagggaggggaggacccatggctctcccccctagcccgggagaccaggggccttcctcttcctctgcttttatttaataaaaactaaaaacagaaacaggaaaataaaatatgaatacaatccagcccggagctggagtgcaagatggagagggcgcgggcttctagggacctcagtgacactgggtgcccgaacctgattgagcaggtgggactgggtgtccccaggctgttgggaaaagggtggcacatagggtcccagtgttgggtggtgtgtcgcctgctgtgaaagttcaggacagaggcctcagcctcagggtcacctccctggacaaggtgaatcagaactcacccttgaaggataaacaggatttaagtgaatgaggggacctggacttctgtccgaacaacaagtgtttgctgaggcctcctgtgggccaggcactgggttggccattctagagatggagacattcacccaataaatgtttccagagcattaactacagttaggcacaattctaggcactggaaacatctgtgaacaagataaccatcctcctaccaagactcgggggatagggactttaatgagcgtggcactgtggtggggctagaggaaatcagggaaggtatcacaacagaggcaatcgctgggacctaaaacaagagcctgggggctgggcctccaagttgagggaacagcacgtgcaaagtttgaaaggagagacgccaggagttcggagcgaagcgacgaagttcctccaatccttcctgcccctgtgccagccctgaaggagctgaatgagcaattccaatcgagggcgaaaggggggttggatggagggatgcaacttaaaggtgtatttatttggggcggggaacagcggaagtgagagtagttaccaatgatcaccttatcctaagagtagtgtaccgggcgccccacaagtgtccctatcatgcgttgttgagtctaatttacgtatagggaaactgaagctaggatgaaggagaacagatcaagccaggactctaccgcttatcggccagcctctgcggggatcttgggcgtcaggtcaccagctggctgctgggcagcgacggggcagcgctccctacacggccccgggcgagaggcgggcggggggacgcggaggatgcgcgcgcaacacccgagggtgggaggagagagaacagaaccgcggcgcgcccagaccgcacgaggtcgtgaaggtagccgcgcggaggggcgtggcttcgggcagacaggtcatggggaggcggagttaagggaatttttcagcaagggggcgaggccacttcggaagctgagagagggggcggggcctgccctgcagtcgaacaagcggggcgtggccttgcccgcacttgggcaggcgggggcgtggcccgtctctgagcgccgcggctctgggcttgcgcgcgcgggagtcaggggtcacggcggcgtaggctgtggcgggaaacgctgtttgaagcgggtgagtagaggggaaaaagggagttcggggcagtgggcctggtagggaacggggcttgagcagccaggcacatagatctgagagacggttgcgagggcaccctttggcccgggggcgcgcaggagagggcaggggccaggggtttcctgggcgagggcgcggggacgagcaggaaaaggccggggtgggggtggaattcctcggcgggcagg

SEQ ID NO: 13589 - DNA, 12821 bp, Human
catgagaggaaatgtgtctactttacttggtccaaaacaagaaggaacatagatttttaagactgtagagtaatttaagaattttctaattctaaacccctgagaaccatattagagtggctttaggagaatttttcaaactatacacctagactttctccacactcctaatctctccctcttctctctcctggatttcctttggaggaagaagacttatggcacaaccacccccatattcaaaaattgagaatctgagaattgcaagattatctttctcaagtgtactgggatggaaaaaaattgagaaccccaacactctaaatcattcattttacatatgaggaaactgagactcagagaggtgacatatagcagataagtggtaaacccaagcttgcatatgggtctagaacagtacttttcaaacattaatatgcaaacgcatcaccttggaccttgttaaaaagcagattctgattcggtaagtatggagcagggctgaaatcctgcatttttaacaagtgcacagatggtgttgctgctgctgcactttgagtaacaacattctagaacattcactcagcttttggcactttccactgtccttaaaatttgtattctttcatcaagaaaatggagaatatgtaaaagtttgacagataagcatctgaacattaacgtgcctggtatgtaatagtaaaggaagatgtgaatggtaatggagatacagaggagggagcagagggactcatccagagaccaaacactttcctggctttgcaaggtaatcattgctttcaaaactcagaggaattttggtaaagaccagtggagagcatatgaatgactctcaagctgtctagttgctcatgtaatctgcttagggctgcaggttaagaacctctccctgtctagaaaggataaattgaccttctttctctgtaatgttatggagtgtaattttctaataggtaacaactggggaaagaacattgaaattcactggcaaggcatggaagtgaccagcaaacagacatcttggtctgtgtctgctttgatgtagtgcagcacaaagacaattgaatatgcaaggtacttccagatttgggccctgttcctggctccactattaattttatttgcagtcttgaataggtcacttaatctttctatgataaatttatcaaaagagcttactgataactaccatatgggttgagatctatttaaaatacaaaaagtattaatctattaataattaatactagtggatcaataaaataggaagactgagtcaaggagtctcagtaaattggattgtaccctagaccctacaccctgaaacatttaggtacggaagatccagcaatcgattctcaaataagtgtcctcagttaacaattcctagctgtcatttgggccctttctgtgtcagatatcagttttgactctgaggttccatctctctgaggaaattcgcacaataccagttagggagacatactgtgtgtttcccaatgtcactgcccgcatgttcaatgtccctgtatagcaggaggcactgtggctccctctcttctctccagttatctagagccccataagaattatgtcactgtgtatatgtgtgtgtgtgattgcgcacataggtgtgtgtttgtcagagaaagggaagaaatgggggtattgaaatctaaaggtaagaataaaaaaaagacagaagatattgaatcacaaactgaaatttacccttggatatcaacactttttgtgtttttgtgaatacaatacctatttattgactggaatgaacccaagtcagttttgaaagggcctctaattattggaaaactcctaagcctgtcccagcatcaacccatgttctcctaacttctttgcacctgggttgctgttctgagcttatgacggtgagattaggcagcatgagggtattacagagagataagtcaggatgcaaagatccttttgtcttttgcaaagaaggcagctgggcagctgataggaacaacattcagctccgtgagtacttctgaacttctggtgaatttgagcaggataattgaagggctttggggggttgatcaggttccaaaagaaaaattgcagaagaaaacatgttggacctgtgggcctgggctgtggctggggatgaaaatgggaaagaacatgaaggagatacatgcagaccttcttgttatgccatgggacaagcaaataagtgaaacttgattattacaaggtcactgcaaaacttgattactgaattcatttagaaggagcccaatagtgacctccctgtttgcagcttcatagtaaacagttttctgaagaaggaggaatctgtggcactaaataaccacagagaaaacagttctttactcccaggatgtgcctgcaaacttggcccaggatggtgtgagtgtgaggaaaaggagaaggggagctgagagcatgagaatgaccacagggcagggcaggtggctgagccttctccctttgaggtcaagtgtttgttccattctgaagcagggtgctggctggaattttggtaattttttttttatggctttggtttgggtcttgctttgcttttcaaattattgattttctctgcctcagcaggaccctgggtgatatttatgggctcaaccccagcagtacttcccttcccagctccttcctgcctctttctttgtccaccaacaatggactggtctacctgtctatagctttgctgagaaaaagagaactggaagtgtaaggtgataacagcagcatcagagagctgtctcaggaacctcctaaaactgcttttcagaggatcatcctctgtcactatatagagctgggctttgctgtataaagaaacagaagatgattttttgctttatacaaatctttaactttgttaagttgaccctaatcccagtcccctacaaaagtatgccttgaaatattactttgctgcatccacttatttctgcagaaaaacagtttgtaatcttcaaaaggggaagggctaacattgctttaaatacaggaaaatgttctggctcacaaaagaataaattgcctaatgcttttggaggaaaaaatatgaaacttctttcagctaaaatcaagtctgataatacatttaaggttactcagctccagatgcccttagaatttctagaaaggtgtggtcagcatgaggttagcctttggtgatgtttatggacaacaggactggcttccaatgcaggaaaaggtcagaggtgttctacccttcctaaaggttttgcagagagaattggagggtaaatctatgacagaaactgcatagggattagtcgaccgttccggttacctagtgcaaatcctgagcaccattaggatcaagggattaacctggcaactgttatgtaactctttctgaggaggcttctttcatataatgcatcatactcagacatgaacactttctaagcctagaggtgtaacttcaaaattatgtaaaaatgcaaaagaaacttgcaagaaaaaaggggatgtatcattggggaatatggatgtcacgtgtgatttttaaattcttcggggttgctgttggggtgtcaaaggaattcaaggaaagcttcttaagacagaattttaagaccagaaataagttaacagtcggggtgtttgaaggaagcagagaattacccagcgagggcagatgataattgcccctctggtgtatggcaagggcccttcagcagttggcccagaggaaggaggtgcagagtccaggtgaacaagtgtcataaccacagatttgtttgcatggctttcttttctctcagaaggtctagcatatatttgccctttttgaacactttgtaccactctacttatattgtcttcctaaaatttccccataactctaaaaggaaggtcttgtttgattcattttatagatggaataagacccacagaggattatgaaatttatcctaagtcacgtagccagttctgtggagtaggaacttaaaactatatcagtttgattctaaagagtgtactctctaccgtgttaccatcaaaggacaatttgacaaatgagggtcactttaggcccttacattatagaactctggatccaactcaattggatcttattagggctgccagataaaaatgaaggatgccagttcaatttgaattccagaaaaaaaatgactttttaaagtataaatatgtaccatgaaacagctgagatatactttactaaaaaaaattatttctttgtaattcaaattgaactgggtgtcttgtaattttttttttttggcttaatctggcaattctaaccctaatagattctttagatgagagaaaagaaactttttgatttcttctaccttgaaaatcctgggcagttcaaaaaccttgatctgagagcaattctctagctgccctctgtgactctggcagggctgggatgtgtcagttactggtggtccactctgagcacagcgcagatcttggctgctcaccagctattcccagggtcccaaccacacttgggacagacacaaggtttgcctgtctaccgggggtagagagggcccacagaacgggaactgaatttagtgagcagaggaactggcagtgcatttcctaaagcctgaaagctaatgacttctctgtgctctgatggagaagtcaaagggtcaggatctcatgaccaaggtttacagtatttgttcaatttcttttgtttttttttttttgttttttttttggagacggggtcttgccctgtcgcccaggctggagtgcagtggcacaatctcagctcactgcaaactccacctcctgggttcacaccattctcctgcctcagcctcccaagtagctgggactacaggcgcccgccaccacacctggctaatcttttgtatttttagtagagatggggtttcaccgtgttagccaggatggtcttgatctcctgacctcgtgatccgcccgcctcggcctcccaaagtgctgggattacaggcgtgagccaccgtgcctggcctgttcaatttctaaattaatttattaactcatttgacaaatataatatatatggcatgattactgtacaccatgcactgttgtaggttctgagactggaaggacagcctcatgaagctagtccagtaggggataaaggaaggaatcacagcatgagcaggtggtccagggtcctggccaatctcaccatccctggtactggcaagggtaataatttagtaataatcagaatttaaataagagaaaaatcttggaggcgaggataataattgcaacccaattgtcaaggaaataagaaaacagtatggactggaagttatagaatatgaggtttcaggaatatgcagtgtggccagtaaagagagtcattgttagcacgagccaaagactgtcagggaggtttgcagttaacagtattagcataggctggtgtgatgggtcatgcctgtaaacctagcacttcgggaggctgaggcgggagggtcacttgagcccaggagtttgaggctgtagtgagctatgattgcaattgcaccactgcactacagcctggctgatggagcaagaacttgtctctcttaaaaaaaaagaaaaaagaatattagcataaatctgtaatgggtgaaataaggaatcttatggagacaaagcccccacacactagattttatagaggagactgtctcagggtaagaggcaaaagcaatttggagttctctggggcttttcaggatcttccttccaagagcaagttttgttaactcttacgaaagaaaggaagaaagaaaataacgtcatccaaaatgacacattaattgcttaaatttatctttttcaataattttctttgatttgtatttgaagaatggcaatgtgcatttctgtagccaaattaaagtctgagaacaccatattggataggtccgtggtgtggatagaagaaggcattgaagatttgtgaaaagtgggggctgaagaaccttatgtctcgacgtagagttgaagcacaaacgtattacttaattatccttcattaacttctgtatgtgcgtgtgtattaagatgtgttgaatatattcatgggtgttggtattcctgcttcagaggtcctcctgtccagacaactacactgtcatctcccagaactaagagagaagtttctggttcatgtgaggattaaacaaaataatcctatcttaaactataaggacatgaaggactataaaaaaacagaggccataaaaaatgctcaataaacatttagagtcaggttattttacagctggatggaagaatatgtaaagcttaaagaaattgcagatgctgtaaaagactatagatatcactgagtccattttcctctcttcgtaactgacagaactggtagtcacagagaagtacagcatcataataaattcacgtagaatgcttgtggcaaatctattttatttatttatttttaaattttaatttgttatacctaatgtgaagctttaatttaatttatttatttaaaaattgttttcagtggcagatccatgggaacagcatagctacctagatttctgagttttaaaatctatcaattgtccgtttacacaactgatagattgtgtaagtaatgtagcagaaggtaagtttccattccattccattaagtgcctgcattgatttatactctgttttcttaaagatcccttttaaagatgataacttctccccttttgtgtcaacacaaaatactgagctttcttgttgaagtacttttcttctccagcctgaaataaagatctaataaccaatggtccccatgacttgaaagatcttcttttttttatctttcactgtctaaggaggctgaaagggaaacatcagccgcccggggggagttaaaatgagtgacaacactactctgcctgctccagcttcaaaccagggtcctaccaccccacgcaaaggccctcccaagttcaagcagaggcagactcgccaattcaagagtaaacctccaaagaaaggtgtgaaagggtaagaccaaaatgaaaagaaaaactttctattactttctttttcccacaagactgcttttgttttgggaaattggtgctcacaatattaaacagacttacaaaaatttccactccatcctctcttttcctctgtaactccatctttgatgaactgtgtctttatccctggaattctttccttctcaacttccaggtctgtggccgaatttaacatggcaaatagaggctttttacaataaactttgactttgccttgcaggcttttgatgaccactcctctttactgagacaacctctacgttaatctgtaacactgaaccactgaccatttccagaaaatatagcttatatttatgtcttccaattttgtatcctcagttctttattttcctcttcctctccttggcaaaatcctattgatttttcaacacacagatcatatgctaatttctttttgaagctactcctgactctctttaacaaactatcattactttcatgtttgcattttgtacattcagctatcataacttacattatatcttatatttatttatttgtatctattctccgaggctaagaccactcagaaaatttgtctgttttcttcttaactctctgtgcttaataaaatgcctggtatataatagatgcttagttaatgattttgaataagtaaacaaatggatgaattcatcatttttaatgccttttgtattgctttctcatttcaatttttattataaaaagtgaaacttgactaagttgtcccactgatggttctttctgactcttaattgttttaggttaagttcctacaggagagaaatatctctccagtgggatacaccaaaacctgcctgagtgacattttctttgctccagttcagggcaaactaaaggagtttctcaaatacaaacacttaaacctctccttcttcccccttgaatcaagaaactctccatgtgagtgactccaaaattcttttgctctaatctcagctaatttctcctttattcttttccatagatttggagatgacattccaggaatggaggggctaggaacaggtaagccatccactgatttaagtgagaacttcgcacttggagttctgcctttttatatacttcaggcctcaaggggcagttgaaagttatgagaaatacccaaggcagaagatctgtgaagacatagaaatgtggggatttaatttaccctcgaaataagtacatgtgtgcccagatacaaaagccctaaaagaaatcagggtaggcccaaaatttcataaaccttcttgttttgtcaaacaacctttgagggcatacaatgataaattatagacttttatggtagaaagattttcataattcatctccccaaacttcatttttcaagggagaaatctgagacatacaggaattggcagtcttttgtctgaggctaccaagtgaactattggaaataagggtgaggtctggagatctctccactctacctggcaaaccacttccttaccaatttcctctttttacacatcctctagcacccagaggaggatcttacatactgaatgcctgcaatataattttaaaaattggttaccagatttttatgtatcatacaatgaatgcaatcactgcatattttttaaattaatagactttatttcttagaggagtttaagacttacagaaaagttcagcagaaagtagagttcctatatgtcctctctaccatctctctccccttttacacagtttcctctattattaacatcttgtattagtgtgattatatttgatgagccaatgtcgatgcagtatgttaattaaactccatagcttgaattagagtttttatcccttgtgttgtaaagttctaagggttttgataaataccatgtacccaccattatagtacatattgcagtacatatagtatcatacagaatagtttcgctgccctatgctccacccggtcatccttctctctctctctaaaccccagacatccactaatgttcttactgtctctatagttttgccttttccagaatgtcacatagttagactcatacagtatacagcttttctggactagcttctttcatttaaccatattcatttaaggtttctccatgtttttatgtggcttgatagctcattttttaaaatcacggaatgatactccattgtagggatatacacagttttttatcctattgaaagataccttggtttcttccaagttttgccaataatgaataaaatgcccctaaatatttatgtgcaggcttttgtgtggacatattttcaactcatccaacacacctttgataaacagtagcacttgtagtaatcagtgtccttcccaggcaatcctcagtgtctctttctgcaggcaaataccaatcctgggatcttgaatgaattttccagccatgttataaagcaaattttctattcttttagatcaactgcttccgtattttggcaaggtgcatacaagaccagcaaatttgctttgggatctggaagatatgcttgactctgacagtgtatttggaataatgtaaagaggtttatagggagtgaaggtctgaggtctttgacctggctctagtctcagctctacaactatgtggtttttgctaattatttcatctttctgtgtgtcagcaagcttctttgtaactcagggataataacatcttattgtctaaaacaagaagctggattaaaagatgctttgtgatcgtttctcaatatgtgattggatataggcaattcaaaatgtaaaggaatagaagaacaattagagaagaaaccgatctagattggtagggaagactatggatacctagaccagggagattcaaagtgctcctctttttcattttaacccttggcctgactagaattccacttctgcctcctccttagtggttgtggtttggggagactctgtgtaatcagtgggctgtaccccacagggaaccccccagtcaacagctgtggatcacctccccaaagaggaagcagaatgaaaccaacagagatgcctggtgcaacaattaagcaattggtctgatccttcctgggccacagggccacgctagggaacttcccagtcaggggacaatgagcaggagagaggagtgaagtgtctctgcctgaagggtgtctttctgtgaagaagctctcttggggtgaggttggcttacgtgctcttcttccatctcttgcagatatcacagtgatttgtccatgggaggcattcagccacctggaattgcatgagctcgctcagtttgggattatctgaagtgccagaggttctgccactctcaatgacatctgctgtaattttggttgcttttgccctgttgatctgccggagtcttgaaattcagctgattggaagtggtttctttgactttcaaggtcattccctatcagttactactaagagttctcttactgtcagaatctctcttgcagtacagctcaaaatagtggatgcatttcaaacttgaccaccttttcctaccagctagttagaagtcatcaatatttctctacattttgtttatctgtaagtcctttaaatctatttttgctaggcattcattatgattaatagtagacttttaagacaacatttatgtcactccccacctcctcatatttaataaaggagatatttaccttgaatgttggtgaagttgtattaaatgctacgtagaaatatctgatgctgtgttctgagaaccaattaaacaaagaaggcacagtcatacaggaaataagtgcagtgcttacaaaacagcatagcattaagatttgaattctgtaagtttgtaaattgtataatttccgggtctaaattttttttttttttttttttgcgacggagtctcactctgtcgcccaggctggagtgcagtggcacgatctcggctcactgcaagctccgcctcccgggttcatgccattctcctgcctcagcctcccgagtaactgggactacaggcgcctgccaccatgcctggctaattttttgtatatttagtagagatggggtttcaccatgttggccaggatggtctcgatctcttgatctcgtgatccaccccccctgggcctccctaagtgctgggattacaggcgtgagccactgcgcccggccactgggtctaaattttattgaactaggttattccagaagtctcatgcagctctaagttgtatagttctaagttggtgaggaactgggatttaaactcagaattctgacaatgtgagccttcttttcggtactctggttgaggaaggtttccttccacggcatcccttcagtgaaattattttgtccaatgacttaaaatgagagtcacaggagttacatacattgactgctttgtgtacatctgtagtaaatctaatctttaaactgtcaattgaaaagatttatatgctgtaaggtttagactcatatgcaaaggataggcagttgaccctctaaataaaatggatggtttgcctcacccctgaagttgtgtcaatgtaatgtgctcatacttatcttttctcaatactttcaaggcaattgtgcaactcaaatgctgcctctatgtgacttggatgctttggaactaacagtatgaatttcttcatttcagttttgaaatctgtggtaaaagaatggagtaaattaaccgaagagagagacaggatgatagagaagtaagagattcaggttctaatcctgtctctaccagtaaattgcaatataattttgggcaaagatctcaccctttgtaccttcaagttttcctgaatcagataatctaaggttcatggtagtgataaattttgtgactttgtggtcttagaggagtgcagcactgagacttgtggctgctacaaggcctgtgttaaccattttgcacgaatgatcaggttaccttctggccagaaaattagaagtacaaaagaaaagctgaggtatagattcaaaagtggaaccatgacatgcaaagacgcccagtggaaatgtgtgtttcctccttcagcaggaactcctgcctccacccaggcacctgctttctctcctgccaaagctaacccttgcctttcaagtcagctgctccatttgacagccagtgccttcagttcatcccaattagggaggatttgcttcttctccagctgggagagactctggttcacatttggcttacttttcaaatatttctttaaaaatgaagcaatgacattgacaaaacagaatgcactcaaaagaatgtatccaaaggctacctaaagaagtatctagaaactatgctacatggggaattgttgaacgaactgataacatttagctgagagaagaaaacattcattgccagcaaatatttgaaaagttgtaatggtccacagctgtaacaacctgaatacaccggatcttttaaaaaagtaatggggaaggccgagtgtggtgactcacgcctctaatcccagcactttgggaggctgaggtgggcagatcacaaggtcatgagatcaagaccagcctggctaacatggtgaaaccccgtttctactaaaaatacaaaaaaaaaaaaatattagctgggtgtggtggcatgagcctgtagtcccagctacacaagaggctgaggcaggagaatcacttgaaccagggaagtggag

SEQ ID NO: 13590 - DNA, 149971 bp, Human
  misc_feature (1)...(149971): n = A,T,C or G
agccacttttctggtcatcagttgaatactgaaaatgtcaatcaggtgcaacttctttgttgtgagggtaggcaacaaagtatgcaaaagccagaaactagtggcttgcaggctttgatatttaattttacaagatcaactaaagattctcttttttcagtcataaatacctaggaaagtgctatatgtgtttcatgttcttgcacctcatgaatgaggtcgtgatagctgtggtgacaatctctgaaattcttcccagaactcaatccttaagaaccaggagtatagtttataattaaagtgaaaatttattttagaaagttcaattttagaatctataaaataaaaaacaaaaaccccaagcctacgtaagtaattttaacgtaaaatgttaatggccccaaactctaatggtggaataaggacaataacatgaagtatatgatatttgagataaaatatagctatttaagaaaagcttcttactctccttgagccttcatctataaaataaggataataaaactgtgtcattgtgttactgcaaagattgattaaatagatacgtataagatgcctaggttatggccattttttatatttaacaaattcctaattctttcttgtttctacaactgtactaaattattttaatagctgcaaaagtattttaacatattgactaaccatttctctgttgctagacatttggactgttttcaatggtttggtatctcttcgtatataaatttcagaggacattcggacctcctgtaaaggccaggtaatacatattttggggcttctgggaccacataaggtctctgttgcatattcttttaaaaaatttcttgttttcttttaacaacccttctcaaatacaaaaaccattagcatgagggctgtgtaaaaacaggccacagactagagctggccctccaacagcaatttgcttagcccttaattgagagtttttaaccagtctgggcctctttggaagttcactctaaaggcataatctcaattttagaagctggcaacacccaagagagcaattgttagtctctagtcccatggatgtggtgttcttcagattcctctgccaatatttttcttgttaggaaagcatgatgtgaaagtggtgacaggatggagaatgacaatggccagtgtatgtgagtttttgtctaagctaattcttacgcaagacaccggctgaaaaacaggtgaggagcacttttcacgtgctatcttccagaaatgaattcaatctgtaaataactgagatgtcttcacagctcttgggtaatttttgtctgtagcaataagaaactttatctctattaaagttaggaaggggttaggatccagtaatgaatgaaatgagaacttaagttgcaactcagtttctgtacttacttgtgatctagcattaaacacagtgccaggcacgaaataggtggtgagaaataagaaaatgatagagctatttgctctaatggttagaggcaatgatggtcagctttgagttactttggtgaccccgcagggaggaagagcacaggtggaacattagaatctctttcaggaaaaggatgccgctggatccatcaggtccagtagcactgcccatttctcctgctccaaggcatctgccctcgaaagcccccaggccacacccgaggacaccacccaggattctaggacacctcgagggcggacgtggtttggctctcggtccagctggaccgggctgggccaaccgggagtcagctcgaactcacctgcttggcaggtgcgcgcttcccgaggcgtgacaagggagcgccggcgcggtgggtggggggcagagaatgtgaagctccagacgcatggcacccgccgccaagtcgccgcggtggctgccgggatgcgccgcagcgaatggtcgcgccgggcgccgctctgagtgacctttcacccgcgcccagcggttccgggcggcagcacaaggcggtagccatggcggaggcggcggctgcagcgggtgggactggcttgggcgcgggcgcgagctacgggtctgcagcggaccgggaccgggacccggacccggaccgcgccgggcggaggctgcgggttctctctggccatctgctgggccggccccgggaggctctgagtaccaatgagtgcaaagcgcggagagccgcgtcggcggccacggcagcgcccacggccactcccgccgcgcaggagtcgggcaccatcccaaagaagcggtgagtagcggtatgtggaaggagttagcgtcgagggaccaggccgggcctgtgctgcaggagggcacaggcgaggtgggaagggaagtgacacgggtgggcggaaggcatcccggtccctgaaagtagggacccacctctctttcgagagagtggactagaccctggattctgtcaggaagggggcgggatgggatggtggattttggtcactatgtgagggtaacaggcttgaagaactctcgttggagaagggtttaaaggattcctttttcctgagcttttagtgccaggaattcattttttatcttgaattaatacttttggtgctgaggtcttggaatgggtagcagaggttctatttttctccgaggagatataaatttgtactagatgatagatcataggaatctctctcattcgcgaaagcctgctgtgggggaaactggtggtgccctggaaaaaggtgctgactggtttctgtggggtaagttccacttgcttaggatcaagatgtattgactttgagggaggaaaccgatgaatggtaagaagccataaactgcaaacactagctagtggtttaaggtgtggtggtatagctactgagctctgtgtaaccagaagctaaaagacaagagtctaaccgatgagggatgtttgtaagagaccttgactttcgatgtttttggagaaatctttttttttttttttgtatttttagtagagacagggtttcaccgtgttagccaggatggtctcgatctcctcaatctctgatgaaggctattaggagaagctactttctgacgtgtggctttgtcaccgtggataaatggataaaccgagagtgaaaaaaataagtagctaatgtttaaagtgtacttttaagtgtgccaaagtgtgctaaatcctttgtttcttcccaagctatgaggtatgtgcggttttctcccattttacagatgaataaattaagtctgctggagtcttagcagatatgctgtgtgacaggttagaatttgaaagcacatcaaattgacttcatggccaagttcctaagctatacttgcttctgatgaattaattcaacatacatgagtctttacaaaatacacactgtaccagcaatacagaaatttaaaaatacggtatttactcttaaggaaggaatagcttagtaggtaaaattataatacagcgttataagaaacttaactgggaactataccacctggtcatttaacccagttttgggtttgtgtttgttagtgcaaagatgttccaaagtaaagattgtctgagtaaattttggatgtttgcattactaatagtttgccaaagggggaaattgttcttggcatacaaacagtatgttcacaggtaaagaagtgagagacaaattagggaactgctgagactcaagtgtagtaggagagggtgagaatgacaggggacgaagactggagaggtgaatcttgtttacaggattttacgtggggcaatacatgattagatttacctttgataaaggtcacactgggagcaaattgaagacagttgagcattttggcagtataatggctgggaacatagacctggatttcaatttccactacaccgttacagctctatgatcttgggcaaatcacttaacctctgagagtttcagtcaccgtcatttgtaaaaacgggaacagtaatcctgttttgcagtgttgctgtgagaattgaaaaaaatagagttaaatgatcaagtgtttagtgcaatgcctgttacataacctttcaaagaatggtagctgcaattttcacagtgtctaaaggcagagagactaggagactattattccagggagaaatgctgggattctgaactaaggcatattattgggagtaggcaacttaattgagaaaatgctaggaggtaaattttccataacttggttactgagtggtggggaggggaggaataaaggatttcatctcgtctcctggcttcaattgaggttatattattaatagctgtcattaggtttaaaattttctaaatggtttcatgtacatttatgtgttctcatttgtatgcatatatgtgattgtacattttatgtagattcacactcttagaaccaagtaaggagggcaggttttccttatggttagatttaatggcttggtttacagcattcagagaaaaaatagtaacgtttgtaaggcacaccaagatgatggttgaaggtgactggtcagggatgccctgtgtggctgctccaaggactgaaggcatcgatagttcaggcacgactgtaacccatttgttgcataggttacagctggtgggaagccctggtctttggttcggggttagacgactagtggtaaaatctagtcctgtactggtactttgagattttcatcaaaatatgagggaacacagaaacttgtattagatgacacatcaaaagcttccacagagggtgatatacttgatagataatcatgaggaacccaagtctcccttctacttcctacttagctgggcctgcagttgccagctacagaatccagcctaaagggaagataaatgatagaggaagaaggaaccacagtatatatctaataaggtgtgagtatgcctatatgtcaattattttggaataattttgtgatttgtgtattattccttcccttttattactttggatgataacattgcttgtaattgttttatcacatggttgttttatcacatggttggttatatcacatggcctggagtagtgacttcttgaaatgccatattttcattcctgttacagaatagtcatgcatatgtttcaacatttatagagtagttgctttatgaaggtcctgtcctaggcattggaggtaaagagnnnnnnnnnnnnnnnnnnnnaggtctttggcttgtgggttatcagtccattcgttcatgcattcattcatgcttataaaatatagcagtgaacaaaaactctgccctatggaacttatattctatctggagtggagacagtgaacaaacaactaatatagtatgtcaggtagtgataaatataaagaaaaatgaagcagcttgaaggggcttggtgatagagaacccttgaaggaattaagctgggaagagacatgatcagattgggtttgggtttgagagaagtcactccagctacagtgttaagaatggattggagaacggtaaggatggacatagatcagttagaggagatcagttagaggaggctgttgtaacacaataggcgagaaataatgaagaattaaactaagatgatggcaatgagaatagggagggaaatgatgtgtgtgagagttttagaagttcattaggtgacaccattaaagtttaatcacactttaaaactatgtaactaaattaatgccacaggagtttggagactgaatgacaatagaaaagggatgacacagtccagaggaatgtggacatttcagagggctgaccaaacaaaacctgctgtttacttatcacatggtctcctatgaagttggcaccaattacttctttttctcttctcttttttttttttgctatggagtcttgctctgtctcccaggctagagtgaagtggcgcgatctcagctcactgcaacttcctgcctcccgggttcaagcgattctcctgcctcagcctccggagtagctgggattacagagcctgccactgtgcccagctaagttttgtatttttagtagagatggggttcaccatcttggccaggctggtctcgaacccctgacctagtgatccacccacctcagactctcaaagtgctaggattacaggcatgagccaccacgtctggccggctccaattacttctatcccggaacatatgttctcattatttgaagttgctgagcagagtattgaagtgacagtttactcttggatcctccctttttccttaagtgcatgttacccatgtacagtttttcttttgactttgcttctaagtgcaattttagatccttaaaaatcatagtaaatgtcaattacatatgtgacacttttacgtcttggttttggatttttttcagttttttttttttttaaggctcttgtggtcttacgaaaaagagaagaaaaaataccatgttaactttcattcttccacactgctaacctctttcccagttataactttggctccaacctcattgtggtttgcattagtcagaactgctcaatggcagtttttacggaggttataaatgttcaggtcaaaagaatgattaagaacgccactaattgtttagtctacttgcttataatgtcacttacaaatgccattttaataaaaagcagtatattaacgtcgggcatggtgactcacaccccataatcccagcactttgggaggccaaggcaggcaaatcacttgagcccaggaattcaagaccagcctgggtaagatggtgagaccccatctctacaaaaatacaaagaaagttagcctggtgtggtggcacaggcctgtggtttcagctactggggaggctgaggcgggaggattgctttgagcctgggaggcagaggttgcagtgagctgagattgcgtcattgtactccaggctggacgacagggcgagactgtgtctcaaaaaacaaaacaaaacaaaaaagtattatttaacatctgccggaagctttggtagatattttccagaaggaatacagctgagttaacctcttgtaaatatttcccaagagggtatcctgaagcctgtaagagctgatacagagcaaaggttatttgcacaagtgacctggcttaaaacttaacatcgtttggcaaaattcgagcttattttggtagttatgttgaatgaaatatttaccctattttgagttcctagctaggaattctagtgatagtagtaataggagttttaattgactaagtcctaatatgacaggaaccatgctaaagcttatgtacattatgtcatttaaatctcacacaacagctctgaaaaatgagtgatactatatgtacattacagttgaggaactagaggcttcgagaagttaatttatctaaggccttgcatttgtgaaatgaaagagatggcatttcaactctgttcttgctccagagtccatattctttcctctatgctggattaccacatctgatgttcccggggagatatctacttactattcatcaagttgctgtctttgtcatgctaagtttcaaagtttttgtgattaaatagatcatgatcaaatactttgtcatatagttaagaaggcattagtttatgttgtacttaataaattataaaacatcattctgtcaaaatgaaattcataataagaaaatgtaatgggtggtttaaaaaggtagaccagccagtttacttttgtgagtgcattttgccatttgacttgtggaagaagacagtgtttggaatgaaagggaattaggaagaatgtggaagacccaagatcagagaagaaaggaggaaaagagaataggtcatggagggtttactgcctagttgcaaactgtctttggactgtgaatgaacaggaaactgaagatttaatcgctgtggttatttgttaatatgcttctctagattgcattttaagatggaccagaccttctctacatagacttttttatgttgggaagttactatagagccatctacccttgtggtcatttaataaaaatacctgagaatgaattaagtgatctgtttttaggctgcagagaaatggattgctgttgtagtcagatgagatactttatggaacactttaaaagcaagtgctaagcaaatattactccgtttgattttatttccttattattgagaagataacttctgctgttattccgattagtatgttaatttcaaccctaaaccaaatcaagggatcatgactagagtctaccgttgtagcataaagtattaatagctctctgcctattagtgttctctttatttgttgggtcttgggggtgatattttgtcatatccttgtcccaacatctgggctcagaatcaactgagagataagacacaggatacagacagagaggtaaaaacattagcttttttactgataatgctggttggagatcgtggcttagatctgtactacctaatatttaccctgaattacactccatcacaggcagtgtaccacagaaggcctcctctgcaggtgtagagcctaacacatgctaccaaaacagtagagagagaacttacagcataattaatttttgcagaatgaacacatctattttatctgtatttagattaagaaacagcattaccagtactctaggaagccctctttgtgctcatcccagtggctccttccaccaggataaccactaccttgacttctaacatatagatttgcctgtttgaacttcatgtaaatggaatcatacagtgtgtacttttttgtgtttggcttctttccttcagagtattatgtttgtgatattcctccatgttgcatctagtcacattttgtttatcctcatcgatgaatagtattccattgggtagatatataccacaatttatccattctgttattgatgaacatttaggtggtggttacttttggtccgaataattacttgttttaatataaagtgcatatcaaactagtgtttttatagatattactgcataggaagaggttaaagtaattaaaatagtgtttaagaattaatatatttacttttcttaagtacatcaattgtttgaggtaataaacagaatgctcccaggtactaaatcatttttataaataaattaaattggatttttaaacaaagtgaccttgcagtgttcacatattatttacgagcttataagatttcagcttaaaatcataagtccaactctattactcaattacacattttaaatttgagttacaagtcagtcattcttaaagactagattctcttaagttttgtaaatatataaaatatcaattttttgtatagttttcttaaaaacattaacatctgtctttggttctcttaagcatttgtatatttaattctggatctttcagtagttgaaatacgcttactcattgaaaaaaactgctactattccagtaactgcagttacttttgatgagagagttttgcctcctgggtgagattcggaggggtagatatcgtcttgtcattcactaagaaaactgttatatgattgcatataacatttgttcttgccagcatgtttgaaattactaatcagagatttggccaggttgctgaccagattcttgttgttgacctcagtgggactctccaaattctatttatagttgctgtgtcagagacctcatcctataagcaggggaatgctcaggtatcccaggaccttagaatcaagtaatgtgaactatttaatttgctataatcacagaagttcgcatttccaactcagattgattacctagttgggttttacattttttctaaaggtgcttgaactaactgtataggaatccagcctaaggaatattaaaatgacacctacttgaattctcttatcactttagtcacatatactatggagtggatattttgctgtcaactcaaattttgtaggtcgacactatccagtagagctttctgtgatagaaatattctgtaatctgtgttatccagtatcatagccactatggagctgacttttaaattttgtttaattttaatttaaataggcacatgtggctagtgatataccgtgctggccagtacaggtgtaggtggaaacctaactcattatcttctttctcattctctagaacttatttatctgggctttctcatatctcatagtgttaacactagtcccacagtcacatccttcaatccctatcttgaacttcttttcattcttttaagatcgaactttcttttgaatttattcaaattaataattaattctgcagtcactctgctgctctcatacatgtttgtgtcatctgatcctcacaactgcccatttcacagattaggaactgaaattcctagatacttgccagaaaaatatattagtcagtttctagctactgagtggtaaagcttaaatttgaatctagattttttaattttaatttttttttttttttgcgacagagtctcgctctgttgcccaggctggtgtgcagtggcacgatctcggctcactgcagcctccacctcccaagttcaagtgattctcctgcttcagcctctcatgtagctgggattacaggtgcacagcaccacgcctggctaatttttgtatttttagtagagatggggtttcaccctgttggaccatgctagtctcaaactcctgacctcaggtgatctgtccgccttggcctcccaaagtactgggattacaggtgtgagccaccgtgcccggctgattccagatttttaaaacatctcaattctagagctttttccttgatattatattgatatcacccagccctgttcattttttccttcacaatctttcacattcattttgtgcattaaacaagtatttattggttacttatgttctaagcacttgggctatgtcagtgaacaaaatggagaaagatttttattttcttggaacttacattccagtgggtgaaatggaaaattaaacatagtaaataagtaaattattaagtatgttagaaggtgataagtactgtagaaaaaagaaaaagtagagagggtaaggaggtagggttcaaattttaagaaggatgtcaatgaaaacatgacatttgagcagatatttaaaggagatgagtttagtcatatggatatccaggcaaatgagtgttctaggcagaggaatagtatgtgcaaatatcctaagaggaaatgcacatgtggcatatcaggaaagccacaaggagactggtgcagctggactcaattcatatcccctcacctctaaccgctgtttaaaatatgtagcttttaaacttcagcttctgatttacctagctcttctactgttctaggcagagtctcttattcatgccacatttttcagcttttacaccttttattgtgccattgtctggaagacctttgcttgttgattgatcccatgtttcagagtctcttgttttggggatcttttctttttacttttgagaactggggaagcattgatctatctcctgttaccttttccccacgatttctcaggttatgaagagtaactttaaaacatacggttaagtgctaagtgtcataggatataatatgtaggtctagagccttgaattcatttaaatcacctaggtactcttcagccacctcacccatttgaaacttcgtctaccggctggccgcggtggctcacgcctgtaatcccagcactttgggaggctgaggcgggtggattacctgaggttaggagttcaagaccggcctgactaacatggtgaaaccctgtatctactaaaaatacaaaaattagccaggcgtggtggtgcacgcctgtagtcccagctactctggaggctgaggcaggagagtcactcgaacctgggaggtggaggttgcagtgagccgagatcatgccactgcactccagcctgggtgacagagcaagactctgtctcaaaaaaggagaaaaaagaaaaaaagaaacttcatctacccaggtttgcaattactttgtgacttccatatgctaagcactggggaggattattgacacatggtttttgcctactgggacatgtaggtctactaaggaagactgatgtgtcttctattactgcaagatgtaaggtataggaaaggaatggtgactactacaacaatggaagggcaattttatatcaaagaaacctagtctagaaggattggaagagtattgttctatgtcaagatgttatgcaaaaattcttaaatctgagggtgaaaatattgatgagagagagcatttggatgagaacagaatcagaagaattagggtaggaaaatctgggcaatgtaataaagtttataaaactggtgtggcagtttgctctagtaatgatggtctttcagcaatctggatagtgtttagaagtgtcattctgctaggagctgaatgtctggcagttactttacaatcataaagaaaagggaaaataattttggcattctaaaatgttatgcattttgttgcagaaaaaaatagaaaataataatcaaaatgaagactaacattaagagataaccgctatagcacattggcttagatcctttcagacataagcatatgtgtgtgaggtcacgccataataatgtcttgaaattgccatttttcactcactgtcttgtgtatacctttccttatcaagaaataataatgtgtaaaatcattttcagtgactcaggaagtattgtattatatgtaggtaccatttatctgatgaggacggtgttatatttgtttccagtgtttccctattatagagaatgctgtggtaagctttttacaattaaatccttaataatttccttaaggcacatttttaaaaaagggccttaatgagtcaaagagcattggaatacatcattcgctgatctcattgggcgtggacagaaataaggaacgattgcttgtttggacttaattctgacaagtaataaaaaattgaaaatcatcggaatctttggagaacgactacatcatatttgagcaagtttgtatcttctaatttagggaagcagctttccagaaatttagataaaaggaaattagatgttctagcctgagtctttaaaggggaaaccaaaacatgaccacagggagcctaaggaatagtgcttaaccctgcctgggtctatgggggtaatgagaaggagggagagctaagacgactggcctagatgtatcagtttaaaccacttattgctatcagtaaataatgtacattccgtgcttattcagatggctcctatttactgttcaggcaaatcttgttacatggagtgatgtaatttaaggattatggtgtcagcagttttcattccctgccgccccccaccccaacattttgcatgtatttaaacatgttgcagaattgaacttcacaatactcattagtgtaccatccacctagattctactgttaacatgttactgtgcttatcacatatccattaatccattcttttttccacctaatattaatctattttgttttgatgcattttaaagtaaattggtagtttcatttttgaagttaaatctccttcagaaaggttctgcttttttcttttatatcagttggctttgatttccagatagtatttgttttgccttcacaaattatttctggctttacaactattagactactattctaattttgtttttatttccaagttcatacctgccatctgccattattttcagaaagtacattctagtttgccatgcctgcactcagattttatacaattggtaacttaaaaaaattatcatattttggtatgtatactaatgagggatatttgttataagtattaatctgagctaggttaaagcagaaaagggaaatttattctaagagtacaggggtgccaaagaacccaagggtaagaatggagcttggcctcaggatggaattagagccaagaaccagaaagccatcaggtttcttactagtatcacttcttgctactatttgctgcaggcttctctaagtggatcagctttttctgctcttctgtccaaatggtaaaatatggctgccccactccttcaggaattcagccaatagcacagaataattgaaccccttgtttccagtcctgggttacatgtttacattgctgcaatcagttattgcctggaaggaagtggtggtagtcataggacataggtagctgcccaggcagctaaatgagctgaaccaactctggttatcatgcatttaaagatgatacaaccagattatctgctcattgtttttgatgattccttctctataatcctgctccatgaattattctattgattttccttgagtcatcaatctttttctctttgttgatttttcctgctgcttaaaagcatgctcagataacgttttgaaattttccacacgtatcactcttttgaaaaggccttaacagccatgaataacctaattataaaacttttagcctcttaaccaattctggtacctggtagatgttcttatctcttcttagcttccatgttattgcactatcctgttgttttttttttttttttcccaccttcctgtctttctgaccatggttttgctgacttccttctcttcctaagcttaaaaatccctaagattaatttttagtcatttcttctgcattttcttccttaatcatttcatctacttgaactgtaatagcttttaccactgttgggggaactttaagttattatctctaactctcaactctcatttttacatttttaattattgggtatttctatctgagtatcttgctggtttctccaactcagcattcatgtgtaaggtcattattttagtctccaatctcagtcctccactgtttctcttcacttccgccattatttagatgcccaagtccaacaacacctgagtcatgagttcttgctgagctccatcccccatcccttatttggttcattgacaaatcagatggactccaagtcagatggactctattatcgactctcaagacactttgcttttctctcattgccaccagcctagatgaaatcttaattgtctcacttctagcctggtctccctttcttttgtttcccgcctttaaatgattcttcattctattaccagaccaatctttgttcagagaaagtgtcagtacttgctgcctgcttgtgctgtgctacattctaacattgcaaaaatgattgacagtcagtggagatatatagatatataaaagatatgatgtagctgtagtcattgtatgcagaagaaagagccataaattcttgaagaagataggaaaaggctttatagaagtgacttttagactggttgcctccagggagagaagggcattttagacaggggatatatacaggaagacataagaggacatggtgtgtataaggaattgtcataacttaatgtgtctgggaacagctgttaaagaaggtgaaaatgtagagtggtgctgtgtttaagaattgggatttcatccacattggagaatcaacaaagttttaaagtacacactgctagattttgacttttggtagaagcaatgaacatggaaaatactgttttgattctattgttctctattgattattgaagtaataacaatctcttatttggcattcaaggctttcagctgttctctatgacttcttgaatgtgctttatgcttcagccaattttatgctgcttattagatgggaaaatccttgtgctttcttcctctgtttgactattgaaattttaccatcttccaaagaagggaaagtttaaatgcctccacaatgaagggttctttcagctagagatgaacaccactgagctcttgtaataatttgtactccttgtgtggccatcattgagtatactgaaatctttgcttcctagttaggagtgttggagccagacagtcatggtttaaatcctagctgtatcatgtactgttcctgtgactggggacaagttactgaatctttctggaccatttttttcatgttttaaataggggtaatgacacctacatcacaggattaaagtgagaaggaaataaggtaatgattgtaaagcccttagctttatagtgttatgcaatactgtcattgttgcagtaaactacatagaaaggagtaataagaatagagtgctaaaatagtttctatattagaccgtttttgcattgctataaagaaatacccgagactggataatttataaagaggtttaattaattcacggttctgcaggctgttcagaaaacataactctggcatcagcttctgggaagacctcaggaagcttacaatcatggcagaagatgaagtgggagcaggcacttcacatagcaaaagcaggagcaagagttgaggttgggtgtgggagggggaagtgccacacatttctaaatgaccagatctcatgagaacccactgttgtaaagacagcaccaaaccttgagggatctgcccccatgacccaaacacttcccaccaggccctacctccagccccggggactgcaatttaacatgatatttgggcagggacaaatattcaaactatattggtttctgaagatggaagcacagcaagaagtaggaggtactcagtggcaataatgacattttaatagagaaaacaaatttccttttttttttttttttaaaaaaaagaggtggggttttgctttgttacccaggttggagtgtagtggtgtgatcatagctcactgtaaccttgaactcctgggctcaagaaccattgtcctgagtagctgggattataggtatgtgccaccatgcctggttattaaaaaatttggagcagagtcttgaggtattgctcaggctggtcttgaacacctggcctcaggtggttctcccacctcagtctcctgagtcgctgggattataggcacaagccactgtgcctggcgagaaaacaaatttctagtaaatgtcaccttatgcattaggaaggaaggtaagaacccaaaaagtgtagaacatcagcagtttctcgtactgtgttttaggctgattgtcagtatcacacacatgatgtttggtcattcttgtgctatttctggtttgaaactcttctccatgactcttagtagtcatggctcaccattgcttgcttctatgtgtgatatgtggccttggtggccacacattggaatttgaataaatatattcttgtgctaaaggaaagttatttgataaataattgttttaatttttatactttttaagacttttataaacatatatgaactaggcaaatttccatagcggatcaaacttcctaaaatttgcatcagaaaatatgatctctgtatagccctcatttctccttccagatagtcctttgtaagatttgggtatagatttatgccacctcctctgtcatgtaatcatatttccatttcctgttatctctttcccctgtctcccacatggtgagtgctgccactttgccctcttgctgcccattgttttcttgcggaattctactcagggccatcctctcctatagtgaagtgaatttaaagtttttcctttccgtttctctctctcaattccagtctcctgattttggtaaggtttgggtgagagcaacttaattgtaaacaatttacattaaagctttgtattcctttgtggctattcaacagatgaggcttctattcttaactttttctcatgtcttaaggtaatgcttacccacatgtggtctgtggatgaccctcatcagaattttctgagggtgctagaaattgtaatcatgggctgggtctagggtggcatccaaggactctgcttttaaagtaagtacccaaggtgatgtttatactcccagaaagtttgagaacctctgttgttgtgattgggtcctgcttttaatgctttcttctcttcccccaaactttatggggttcattttttccatgggtttgccggaagcaaagatagcaatcccaactacctgtcacttaaagtagaaggggtactgctgatttttttttttaatcattattttaagtaaaacaaaccaaaaaaaacccaactactgttttgttttgtttttttttctcacaattgcaagatttaagagtgaaaacagagcccatacaatgggaggagacccaaagggggttgccactcccggcaagaatgcttggggtttatatcccaatcattgtccctccccctatgctctcaggtgatatatgatttgactttttttttttttttacctcctgctttagcctaatttgtattttagtgagccctctttactatctgattggttgggtgtgagctgagttacaagccccgtgtttaaaggtgggtgcggtcaccttcccagctgggtttaggaattcttagtcggcttaggaaatccagctagtcttgtctctcagtctcggctctcaacaggaaaactcaagtgctgttggggaggttggccgacgaccgctcttaactgcttcctgctgaattgggggcatagtaggggtcatgcagttcagatttccttgggaggggtgccttcgatctcatcaacattggagcatgggctagtaggccggtctaggggtccgcagtagttcaaatgcatcaggggctccatttgaagaaccatttatacttctacaccttctattctggaagagacaaacttaacaaggaggttaaagatacagggattgaaacgtatggcctgcagtgcaggggattatttctttggcacacttcacaggccctgactatctgcttgatagtttttaaaaggcctggtccagtaaataatgatttagccatctgatgggtgctatcaatgcctaaatgaaaggtttggtgaagggttttaagtaatttccattggttagctgcaggcaaaagtatttttccttcttcagtggctagccatcctgaggggaggaaacttgtcctcatgagggtccccattctgtttctcctgccgagtactgcagcttggtttcccggaggggattaccccatactaggggtccttctgtaagcatttctaatggagggtcctgccttgcggctcttttggcttcaatatccgcttggcagttcacttctatttccctttcgtttcctttctgatgaccctggcagcataagactgccacctcttgaggtttctgtacagccagtagtaatctcctaaaggcttcctgatgtttgataggtgttccctcggaagttaggaattccctttctctccatattgctgcgtgggcatggaggactaggtaagcatgcctagagtctgtgtatatatttaccctttttccttctcctaattctagtgtataacggcccctccttttgctagaatgtctctccctaacaaaggagtggggctttcaagcataattagaaagccatgtgaaaagagtaaagttccccagtcacaacttagtggctgggagaagtatttagtgactgcctgtcttaggacccctcagataatgacagatctggaggacagttgtccgggacagggagagtaagactgagaaggccacaccagtgtccaggagacagttaacctcctggccctcaatggtcaagcatacccggggctctgtgagggtgacggcatgggctggcgcttaccccaggcaccctcagtcctgctgctggatcatctggttagtggcttctgactcagagatccttcatcccctggggcagtgggccttccagtgattcccttgacataaggggcatggacgagggggtagcttatttcttttcggacaatcttttttaaagtgtccttgtaggccgcactggaagcaagccctattaggcattcaacttgcccagcctttcggtgttccagagcctcaaagtccgcttacctgagggccatgactaaagcggtgacctttttcttaacttgtttgtccctttctgcctgctctttctgatctctattataaaaaaactgaggttgccaagttcagtagagtttctaagttttgctgcaggcctaaggcggacttttgaattttttctaatgtctgcaactgactgaataataaacttaccctttaagattagttggccttcaatagagtcagttgacagagagctatgcttcctcagtgcctcccttagtctctccagaaacgtggtaggattttctttctttccctgtgttatagtggacaacactgaataatttataggcttcttcctagttttccttagtccttctagcacgcaagttagtaaatgtctgcagcaccaatctccatgttctgattctgcatcccagtgagggtctacactgggaactgcctgctggcctgtggggaattgttctttcctctgttgtcatcctatcattgacctgactgagataccagagatcgccaaactctcaggttgcagttatggcagcacttttctcatttggggttagtgtctgatctagcagtaacattatatttttccatgtcagatcaaaggattgtcctaacccttgtaaaacatcaatatagccatcagggttatctgataatttacctaggtctattttaatttgtctctctctctctgtctgtctttcctctccttgacttactcaatttgcttttatcctgttctgttatgttgttgtagacccatagtactgggtcatcagttctagggccctggccaaggagccaaggcttggagattgtattgcagagggataagctgggtagaaatcgggggaggagagcatcttacacaatgggagagcagtcctcctagccatttacaaacttggggccctggcaagttggtgggaaacaggtcccacataacggtcgagagctgtgtggctaaattgggagggacacgagggacaagactcactgggttgatagcctagatgcctaaggacacagcatagagcttcattagatccctttggagatacaacttgctccaatacgtgggaaaggaaatgaaagtctgaaccattagtatctaggaggcagggatcagaggaagtagattcagaggtaaggagaattttggggctacactttcaagaaagtcatggtcaggacccaggaggtatgggtcagaaggaaaggtggggtgcacgcatgggtgactgttgagtagagacttctggctgtgccatgatgtcaaccggctaatgctgggagttcgggacgacagctttctgcctctagttggcccttggcttccccaggaaaattgaaagcgcaagctggttccaggcagatcaatgctcccaacccagaaggtttgggggttgttagaaagccttttcccagatagcctcacatctgagtcttaagtctggcagccacgctaatcgtttttttaactggccgacaagcaccctgtattttcctctgattctaaggaaggatagcaagcgaaagtagtccaatattactcaccgctttggagagtcccttcgtggttgccaaaatgttaccagggtgtccttgctcctagagctcccaagatgttggcggccacttccaagatggcagcaagcctcttgttctctgacctggggttcttggcctcacggattccaaggaatggaatcttgggccatgtggtgagtgttatagctctattagaagccatgggtcatggaagagaaccgtggaacccagcgactagtgttcagcttgattaggatgaacttgggcacttagctgtgcaggaacaatggcaagcctttagcccgatcgggagtggcaatgggtgcctcgctggatcaggagcacagtggacaccctgctggatttggaggggtggaagtcagcatcagcggcgggtctgcgatggcggcaaacaacagtggtggatggcaagtgaaagcacagctggagccataacaaacacagaccagaagagtatgcagttgcaagatttaatagagtgaaaacggagctcccatacaatgggagggaacccaaagggggttgcccaacaattacggtttacaacaagaatactgtgtacattaagccggtatggatttcagtcttggtatttttagggtcatgccaagggtattgttggtctgtccccaaaggacagcaggggaagggaacttaggcttggtttcaatgctaaaatggcatatagatttttggagacatttgtattttctttgtctgtgttcagttttgtagtttctacagaaatgcaaggctctaccagaaatggctttggtcacttatggattggtcagtataataagcttgtgatacaattccttttttaattactaacaagcatggagtgagcaatgaaagtgaattggcattttcccagttggtggtagagacagtctggggttggttgccaaaattgccatattgggtagattacaagtggacaatgaagggaaaaaccatgaaatttaaagtacagtccagggaacacaagagtccaagtgaaggatatatccttttctctttgtcctttgctatgacaacctcctgatgcagatttggattgttttcctcattacgtagaccaacacctgagggtaaagggtaggatggttgtttctttccaggctttcagaatggcaggtaccaagcttgtgtgagtggatatgtgggtacacacctgcccttaccacaaaatatttgtaacatacactactaaatgtatgaatgactaatagtgtgtatttccattttcaaatgtgtcattcaaacagtaacaagtttctaattggtagattatggtgtagtgtgtgagagaagtgtgggagtaaagaatggcaccccaagaacctgaagtgattagtgactgcccagagtattctgtcaatgtgaggtaaagctggtcttgccttatttgcccttcttgccccccgcccctttcctgtgcctctgtttagaatttttcccctttatacctgtatattactttttctttcactcatttattcatgataaatgtagtaggaattggacctttgggacgcagtttttgagccttgaattcaagttttaaaaggtttctttcttttcttttttttgagacaggacctcactctgtcacccaggctggagtgcagtggcaatcatggctcactgcaaccttgaactcttgagctcaagggatccttctgccttggccttgtagtagctgggattacaggcttgcaccaccacacctggcttttattttattttatttttgagaattaggggtcccgctgtattgctcaggcttattttgaacttcaaggctcaagttatcctcccaccttggcctcccaaagtggtgggattacaggtcattgtgcttggccttaaaaagttttttagagtgctagtttcttgtggactataaaaagttgactgtaggtagttaaatgtatatttggtttaccatatagttgaagctgtttaattcataatggaattctatcattcaaaaaaatttgtagctattgctaagaagcccaatagattttataataaaccatcatgaaagttctgtgtatatatggaagaaagaattattttctcagaacagagagaaactgcactgagattcaaaggctgagcagcgtatttgcctcaggttcagagagttgtggtaacatacatttttaatgtatggtatttgtgtgaggcctctaattttcctccatctctgattactaatttcatctgcctatcccatgggtgcctatgaaggttcgtgtgtgtgtgtgtgtgtgtgtgtgtgtgtgtgtgtgtataatgtatataatatacatatatgatgaatgcattataaataatatatctggatatattatatataatattttgtgttttgtgaaatatgcagtgttatttagtgtgtatatttttaattcccttaaatgctgttttactatggattttattgtttctcctttgtgtttaccactgttttaaacatttcatcgtgtttctatatgcatatctattcaacttactgcttttgattgctgcattaatatttcatggaatgcattttccacattacttacctgcttctctagtgatgcctccagctactcttacaaacaatgctccagggaatatatcaaatgtgttcccttatggaattgtatacgaatttcctatgcaatacatacccaggagttgtatagttgggtcatagaattggcattacctatgaaagcttactacatgattgctctgtggagtggcttaccagtatgcatgtggattccttttcttcatgttcttgttaacaactttctgtgttctcaaatctcatatttaagccactttgcattatcacactgctaagaattatcacattgattaataacttattatatcacagggtcacatttttattctggcaactagagctgagaaacttacaatggggatattgagggaagattgaaattcttgttgaagtttaaagtgttgcatgataatgttcaagaaggctcactgtctagaggacacagattataccttgttgacccatctagaaacatgatcttatcagagtcctcaagttgattacatttagatagtctgactgccctcaccagttaccaaagttaattaacaagccaataaactaattcatgatgaaaagtaaaactgtagatccttttggccatttcagttgtccttttttttttctctctaggaaatcacaatattatcagatgaaggtagctttgtgagttttatatcagggcaagaggaaatattgatctgaagagtgaagcatcttttattagaattttgattattggaattttatcagaaaaacttttataaaagttattagatagctgaacttttacagttgttaacccagaatgaaagtagccaaaatcattttttccttttccttattttctagtgaaaaatattatgactattatgattagaaatagcaatgtagaaaccatgcatatatatcaggatgtttgcagtttattactagtagaggaatagtagtgtgacaaccagtctgtaaacagagacttcaaagtgaaaatttcccattttaagaataaagaaactctttatggtttttataatagtaaggctaaatctaaatatttcacctaaagattgtataataacagccctgaaaaatgcaaaatgctgaatatgtacatcatgtacatatcatgggagaatactgccaccttgtgcatataggatgctattttatgcctccattttcttttgttacaccagctaatacttgctttttcagtttggtactgtggttagatgtgtaaatgtgtaaaacatttatttttttatgcagtaaaatcaagccaactattctttcggcaggaggagggtttttttttgttttgttttgtttttttgagacggagtcttgttctgtcacccagcctggagtgcagtggtgtgatctcggctcactgccacctccgcctcccaggttcaagcgattctcctgcctcagcctcctgagcacctgggactacaggcatgcgccactacacccagctaatttttttttttaatttgtagtagagatggggtttcactatattagccaggatggtcttgatctcctgaccttgtgatctgcccaccttggcctcccaaagtgctaggattacaggtgtgagccactgtgcctggcccggtcttgttttttgaaagatgttaaatttggtatagttagctctaagaattggaatgtctgagatcatactggttaattgacctctggggttagttgagaattggattcttttatttgaatcttatggaaagttgatgattctttaatcattcttcattttagtgcttgcagtactttggggttattctgaatggcagaattcattacactatcggaagtatagggaatttggcttctgacacaaacatatcccttgatttttaaatgttttccttcagctgaagtgcagaagaattactacaacacagggtgagcatccttaatttgaaaatctaaaatccacaatgttccaacattggaaactttttgaacactgtcatgagatagtgattcctttgcttcctgatagttcagtgtatgcaaactctgtttcatgcacaaaaccattaaaaatattgtataaaattaccttcaggctatgtgataagatgtatatgaaacataaataaattttatgtttagacttgggtcccatccccaagaaatctcattgtgtatatgtaaatattccagaatctgaaaaatatctgaaatctgaaacacttctggtcccaagcattttggataaaggatactcaatctatagtaacatgtaatagtttcttgaaacagtattgatgtaaatcaaaaaatgagttctttcaaatattctggttatctgacagcctgacttagatgggtttcagatattattgcctctctgaagaggaagaattatgagactggaagtcagcctttggatactcacaactaacttagctgcgtgaccagggatgcttctctgggcagtttctttatctgaaaaatgagcaattgaactggatgggttctgaggatctttttagttttcaaattctgtgactatataaagttttactctaattttaaaatgttatgctgtaataccgttcaaaatacttctatgtataagaagttattaaaaaatttaatcatatagttatatttaactatcagagtatatactagtaatttggtggggatggggttagaatatgtgtacataaaagtttaaaactagaagcctgggaaatttacctgttttttatttaacacctggggtacttgaagatatcagaagattggtttgggggtaatctagattttaattgtatatgatttatgcataatcctgttttgggtataaatgcattccaaatgcctacattcaacttctgagaagactccaaaagttgatataaatatggtaaagtccatttcataagcccaattttatgactgggatgaaaagagagaaaaaggtacctacagttgaaaatttggaagttctttagaatattacccaacttgaaaatttaaggccaaagactcttcaggatgtaaatcccttcattttatagtgtataacagcagatctttcctgctatcttgattcatttcctcatgaagtgctaagaatgaacccatgtgaccaagtttagctttttactttggggccatctggggataagtttttaaattctagggataattttaaggaaaatgattttcgttgttaagctacataaacatgccagattcaacctctgtactgaaatgatttccttgtgccttgccttgagatttttgcatttattttgtgtaataccaaattactattttgtagagaacagaattataataaatgttggaattcactaataaaatgcaatcacataaaatctatgcatattataagccattaaagatgttaatgtattaaaatatacatttatccttctgattattgaaatataagaaaatactaagtaaattatacttcataaaagtgaagataatttaatcatgaaaaaaagcaaagtggaaaatatcctaatctgtttttagaatgtgaaaatcttatggttcaatcccaagttttggcaccaaaaaaaaaaaaagtaaaatcttaagaaaatgtgtgtgtcactggtaacattagtcgtgatgtttcttcatagagatttttccaaaagctccgttccaaaatctctctctgcaatgaggtaggaatgttatgggattagaaaaaatatttggtgttagtttataactaatctacaaatccagtctctggattgatactcttcagatattttgaagtttttgtagagggactgtagcttttattaatagcaaatcatagttgtaaacagagcattcctagtttctttgtcttaattttatgtatagatggagatttcagctcataattaattacctgtatctggcttagttgtattatgttcatgttcatttgtttgaaaagcctttgaactagaacaagaattatgattgtaataaaaaaacttgcttgtcagttgttattttcttctttcttgagaattacagagaataagagaacactttctaatgcgtgcatctttattttgaaattttaatgcagcaaataactttcaagatagaaaagggtttttgttaagttatttgcaccataaactgcatagttgaatttgtagtaagaagactcaccaccaatttatttcagtagccaagatcaaactagggtactatgccaaaacatgtaataaaaagtgatgcaatacttcagcatgattgctttttatgttttgtacaggtccagacctatctattcttacatgatgtgcaaaattgaatgattcaaccattgattttgataaataaggatttttacaactatgaaatattggtgttttgcaaattaaaaatagcatgttatgaaatattggtattttggaaattaaaaatagcatgttattttgaaatattgaaagtgagtatggccattaactgttacaatatgtaggtcaaggtagagattggtagctatatggaatttgaagaatttagaatgtaaacccagcactgagatttttaatctactttattgtgtctactactagtcagtctacttggtaaattggtctttttttaaaaatcgtagcagaaggttaataattatgagttttttctcatgtgtaaaactttgtttccttagttttaattgcaaagctttttaggtcattctacagtgtaaacccaataacatgtacaaaatgagacatttatattttaagcatatcttcttcctttttgcaactttttatttcttcctttgaatgcattaaatttattggttgtagccctctgtgaagcaggtgctgctcatcagagtgattctatattcagaaatattagtatatggacattttaatgtgtgctaattttatttaaccttatacaatatttgtgggcataaggtattttagatgattgtgagttaataatcaatgatatactgtacagttttaagatgtttagcattggtctcacttatatatattttcttctcactaggcaagaagttatgaaatggaatggatggggatataatgattctaaattcatcttcaataagaagggccaaattgaattgactgggaaaaggtaaccctggtttatttcttcttttgttcctcctttaattctttctttctatgaaaaattttaaacacacatgaaaatataatgattcctccttgagtttaaacattatcaacattttgccataactgctttttgtctcctggtaatatttcaaattctgatgttgtcatgtcacctctaaatatatgtatttgtgtgtgtgtatatatatattatatgtcttaaaaaataaggacctaatataaccaattatataatattatatatccaaaatagcaaaaaatttttatttagttatccagttcatattcacattctccagttgtctcacaaacatcttttataggtagtttatttgtgtcaggatccaaataatgtctataagccacccaccacccaattcccatgccattcagttttttgaaagtagcttcatatttaaatctggtaatttacaaggagtgtgggttattatgaaaggtgaatgattttaggtctgtgtgaatataaatagtattttaaaaaattagcttctgagataaattaggaaagaagtgatagggaaagatcagtcatttttgtgatagcttttctatgtcttaaatgtggttatttgttgataagaattacaaagcatatttgttcaatcatacctcagtaaaactggaaaaatattaaaaagaattctaaaggatatttgtgttattcctgtttgttctagatacggtcagaattgtaaaacgagttctttgttggttttaagcaatactgcctttgccaaagctctgtttttggtttgtctgttgaattttgatacatttgaaagggcagtgagtacaaatatgtaatacttaaatgctggaaccaaaaataaaaagaaactgagactaagtaaaaaattggatcagatatattatgagtctattccagtattgtaccctgatttaatatctattggacattactatacttaagttaatgtttttaaaacatgtgctatatcagtatattaaaatatcagcaaagtaagtttcattcctttggagaagttatttatttccttttcattgcaatgtattaataatttttctatttttctgacattaatattttgtacctaaaataaaacctcaggaatagtaatttgaaagtaattttaatgaagttctgaagatgtacatttgactttttttttaattaggaaaataaatattatctgtgttctcattcccatccttaattgtgactgggtagcaagcaatggaggcttagttgagaaattgtgtaattcaggtagaagggatttctggttaatatcagatttaccagtgttctaaatgtggaatcttttatgttttatttaaatagaataatgtctaatacagtagaaacatcgatgtagagatcggcttttcaaaatcttctgaaggagtaaaaattaatcttctgaacttagaaaaccaaatttctctcttctcggacactgtcctcatttctccttctctttttctctgtgtttggaccttgaaggtatacagtatttctgttttatggaacagggtagatagtcacttgtatttcagcaaagtcttctgtacagtactgtaggccatgtaatggtttatatgagaaggtgtgtgtgtatgtgtgtgtgtgtgaaatgaatgactagtcataaaacatcacaggtaattataccttagtgggtcccatgttttcaggatctcgttcttattttgggtgttctggcacttgatttgtcagtttcctggaagagatgaggctgtaggggtctgacacacatgccacacttctaagaaactgatttaaaaaattagaacctcagtgtattcatttatggttagattattgctttttcagggtatggaatacttgttagtgccctttctgatgttagggtatctagagaacaacatttgcaacttagatattctttggagagcatacattcagaacaaaggagatttgatggtcttgatagagatttttatacaggctgtaatagaaccagagaatttatctgttggttttaatgggttactaccactcctaccagaatgcattccttaaaggcctcatttctttgcattgttgactcctaagtcagagtccagtgggggagagggagaataagggttcatctgactggaagagcctgcaagggagaccaggaaagtgaatatctggcaaatttgcattagtggagggtagcttttgccttccttcaagacttacaaaaaggataattccccaaacgtataaatgggatttaggtgctctgagattaaatatatactaaacaaacaataactaaaatgaaataacaaaacaaaattcaattcccattttggtgggaagcaccagtaccttgtcacaggataataaactgggttgaattgaatcataactttctctatatctagtctgttttcctaagaataattggtgaatgagtaggtttctctgatttttatcagaaaacatttacaaacactcttaagataataatatctactatttattgagtatcagccaaacagtggctgaacagtattaattcactcttatttattaataatattagatggtaaggacaatttttgaaattttttgtagagactttctattctggcagtgaggtagacagaaataattcaggcccctcgccttctataaccatacagaaaagttggataaaatattagaagaaagaaatataacagagctggaaagaaagaaagggaaatcccaggtgccagaaactaatgtgattatcagtgaaaattgatgaggtgtggggttttcctatttctgatccaaagaacattgaaaaggtagatttttatacggaaatgtagttgattgtctatattttgcaggagggcgactttgacatttcaagcccaggcattacattgtaagcaattattagaagctattatagaataacagcttttcccctatgttaggagaagagtctgaaatttttttctgagcagtctatcttctgaacagatttataatttatcagtttataaatctctagatttatcacttaccactcttattccttctaagtatgagtgaatttagtcctcctgggtttaagcagcataaggcaatactctggagccaattctagagattttttttttccttcagcttttaagttctggggtacatgtgcaggatgtgcaggtttgttacatagctaaacgtgtgacatggtggtttgctgcacagatcaacccatccccttggttattaggttattaagcccactatccattagctgtttttcctgatgctctccctccttctactgctccccttgatgggccccagtgtatgttgttcccctccttgtgttcatgtgttctcattgttcagctcccacttataagtgagaacaggcggtgtatgggtttctgttcttgtgtgagtgtgctgaggataatgggctcagctcgatgcatagccctgcaaggacatggatgtgtccctttctatggctgcatagtagtcgatggtgtatatgtagcatatgtacgttacnnnnnnnnnnnnnnnnnnnnctccccttgatgggccccagtgtatgttgttcccctccttgtgttcatgtgttctcattgttcagctcccacttataagtgagaacatgcggtgtttggttttctgttcctgtgttagtttgctgaggataatggcttccagctctatccatgtccctgcaaaggacatgattgtgttcctttctatggctgcatagtattccatggtgtatatgtaccatattttctttatccagtcaatcattgatggacatttgggttgattccatgtgtttgctattgtgaattgtgctgcaatgaacatatgcatgcatatatctttataatagaatgattttttttttgcctgtacaactatttaatgtctgtatgcctctgaatagtaattaggagaaaacatatggaaatgaaaattatttcaaattttaaaatcttgaaacagaaagcaatatttataatgtatctattcctttgtgtatttacccagtaaggggactgctgggtcaaattgtatttctgcctctagatctttgaggaatcaccacactgtcttccacaatggttgaactaatttacagtccaccagtgtaaaagcattcctttatctctgcaacctcactggcatctgttgtttctggactttttaataatcgccattctgacgtgaggtggtatctcattgtggttttgatgtgcgtttctctaatgatgagtgatgctgagctttttttcatgtttgttggctgcatgaatgtcttcttttgagaagtgtctgttcatgtcctttgcccactttttaatggggttggttttttcttgtaaatttgtttaagttccttgtagactctggatattagacctttgtcagatgctccgattgcaaaaattttctcccgttctgtaggttgtctgttcactctgatgatagtttcttttgctgtgcagaagctctttagtttaattagatctcatttgtcaattttggcttttgctgcaattgcttttggcgtttttgtcgtgaaatctttgcccatgcctatgttctgaatggtattgcctagatttttttctggggtttttatagttttgggttttacatttaagtctttaatccatcttgagttaatttttgtgtaagatgtaaggaagggatatagtttcaattttctgcatatgcctacccagttctcccagcaccatttattaaatagggaatcctggccgggcgcagtggctcacacccgtaatcccagcactttgggaggctgaggcgggtggatcacctgaggtcaggagtttgagaccagcctgaccaacatggagaaaccctgtctctactaaaaatacaaaagttagcagagcatggtggcgcatgcctataatcccagctactcgtgaggctgaggcaggagactcgcttgaacccgggaggtggaggttgcggtgagccaagatcacgccattgcactccagcctgggcaacaagagtgaaactctgcctagaaaaaaaaaaaaaaaaaaaaaaaggaaatcctttccccattgcttgtttttgtcaggtttgttgaagatcagatggttgtaggtgtgcagtcttatttctgggatctctattcttttccattggtctatgtgtctgtttttgtgccagtaccatgatgttttggttactgtaggcttgtagtatagttggaacttgggtagtgtgatgcctccagctttgttctttttgtgtaggattgtcttggctatacaggctcttttttgattccatatgaattttaaaatagttttttctagttctgtgaagaatgtcaatgatagtttaatgggaatagcattgaatctataaattactttgggtagtatggccattttcacaatattgattcttcctatccatgagcatagaatgtttttccatttctttgtgtcttctctgagttccgtgagcagtgatttgtagttgtccttgaagaggtccttcatttcccttgttagatgtattcataggtgttttattctctttgtagcaattgtgaatgggagttcattcatgatttggctctcttcttgcctgttgttggtgtataggaatactagtgatttttgcacattgattttgtatcctgagactttgctgaagttgcttatcagcttcagaagcttttgggctgagatgatggggttttctagatacaggatcatgtcatctgcaaacagaaacagtttgacttcctctcttcctatttgaattttctttatttctttctcttgcctggttgccctggccagaacttccaatactatgttgaaagtagtggtgagagaaagcatccttgtcttatgccggttttcgaggagaatgcttccagcttttgctcattctggtataatattgactatgagtttgttatatatggctcttattattttgaagtatggtccttcaatccttactttattgaatttttaacatgaagagatgctgaattttatctaaggccttttctgtgtccattgagataatcatgtggtttttgtctttagttctgtttatgtgataaattacatttattgatttgcatatgttgaaccaaccttgattgtggtggataagctttttgatgtattgctgggttcagtttgccagtattttatttaggatttttgcattgatgttcatcagggatattggcttgaagttttctttttttgttgttgtgtctctgccaggttttggtatcaaaatgatgctgatctcataaaaggagttaggtagcagtccctccttttcaatttagtttcagtagaaatggtaccagctcttctttgtacctctagtagaattcagctgtaaatctgtctggtcctgggctctttttggttggcaggctattactgtctcattttcagaactcattactggtctattcagggattcaggttcttcctggttcaatcttgggagggtgtatatgtccaggaacttatccacttttttctagattttctagttcatgtgcgtagagatgttgatagtattctttgatgattgtttgtatttctgtagtgtcagtggtggtatcccccttatcatttttgatggtgtctgattcttctctcttttcttctttattagtctagctagcagtctgcctatttattttttcaaaaaaccagctcctggattcattggctttttgaagggtttttcacatctctatcttctttagttctgctctgatcttggttatttcttgtgttctgctacctttggagtttgttcttggttctctagttcttttagttgtcatgttaggttgttaatttgagatctttctaggtttttgatgtgggcattttagtgctagaaattttcctcttaacactgctttagctgcaccccagagattctggtactttgtttctttgttttcattagtttcaaataacttcttgatttctgccttaatttcacccaggagtcattcaggttgttcagtttccatgtagttgtatggttttgggtgatttttttagtcttgattctaacctgattgtgttgtggtctgagagactgttatgatttcagttattttgcatttgctggggggtgttttaattccgattacgtgatcaattttagagtaagtgttgtggcgatgagaaaaatatatattttgttgtttttgggtggagggttctgtagatgtctatcaagtctgcttgatccaaagctgagttcaggttttgaatatcttttaattttctgtctcagtgatctgtctaatattgtcagtgggatgttaaagcctctcactattattgtgtgtgagtgtaagtctctttgtaggtctctaataatttgctttatggatctgggtgctcctctattgggtacatatatatttaggatatttagctcttcttgttgaattgaaccctttaccattatgtaatgctcttctttgtcttttttggtctttgttggtttaaagtctgttttgtcagaaactaggattgcgacacctgcttttttctgttttgcatttgcttggtaaattttcctccatccctttcttttgagttcatgtgtgtctttgcattttacatgggtctcttgacagcatgctaatgggtcttgactcttcacccaccttgcaattctgtgtcttttaattcgggcatttagcccatttacatttaaggtttttattatgtgtgaatttgatcctgtcatcatgatgctaggtagttattttgcatacttgtttatgtggttgcttcatagtgtcactggtctgtgtacttcagtgtgtttttatagtggctggtaaccatttttctttttcatatttagtgctttcttcaggagctcttgcaaggcaggcctggtggtgatgaattccctcagcatttgcttgtctggaaaggatcttcttcttcgcttatgaagcttagtttggctggatatgaaattctaggttgaaaattcttttctttaagaatgttgaatattggcccccaatctcttctggcctgtagggtttttgctgagaggtctgctgttagtctgatgggtttccctttgtaggtgacctggcctttctctctggctacccataacattttttctctcttttcaacctttgagaatctgatgattatgtgtcttggggttgatctcatggagtatcttactggggttctctggacttcctgcatttgaatgttggcctgtcttgctaggttggggaagttctcctggattatattctgaagtatgttttccaacttggttccattctctccatctctttcgggtaccccaatcagtcataggttcagtcttttttacatagtcccacatttctcagaggttttgttcatttcttttcattcttttttctctattcttgtctgccttgaagactatagtcttcaagctttgagattctttcctccacttggtctattctgctattgatacttgtgattgcattgtgaatttcttgtgttgtgtttttcagctgcatcagattagttatgctcctctctaaactggctcttctggttttcagctcctgtattgttttatcatgattcttagcttttttgcattgggttagagcatgttcctttagctcagcgaagttcgttattacccaccatctgaagcctacttctgtgatttcaaccatctcagccttagcccagttctctgcccttgctggagaggtattgtggtcatttggaggagaagaggccctctggctttttgagttttcagtatttttgcattgattctttctcatctttgtgggattatctagcttcaattttttgaggttgctgacctttgagtgggatttttgtgtggtcttttttttgatgctgttgttgttgctttctgtttgtttgtttttcttttaacaggccactttttcgtagggctgctgtggtttgtttggggattgctcgtgaccctatttgcctcatttttcccagacctggaggtatcaccagtggaggctgtgaaacagcaaagatggcagcctgctttttcctctgggagctccgtcccagggtgggtagtgacctgttgctggcctggatgctcccatagggtgtctggagacccctgttgggagctctgacacagtcaggaggaacaggatggctgggttttggtggagcagctgtgccatgttggggataaccctttcatgtccagactgcctggactcttcagagccagcaggctggaaaggctgagtcaactgaactgcagagacatcggctgtgtctcccccaaggggctctgtcccagggagagatcagagttctgtctgtgtcaccctgtctggagttgctgaaattcccacagggagtccccacccaatgaggagcaatggattggggtcccacttaaaaaaaagcagtctggccacaatctggcatagcagctgtgttgcattgtgtgggattccttctcattcagaccacctggactgcctggagctggcaggctagaacagctgagtcaacctaaccacagaaatggtggttgctcctccttcagggaactcatccatctcaggcagtctccagattgttgcactggctggctggaattccaagccagtgggtcttaacttgtgaggtgctgtggaagtgtggcctgcagaacaatgttgcttggatccctggattcagtccccctcctaggggagtgagcagatggatcttccaccttgctgggattcctagggtggagtctgtaaaactcctgggttactgtgcgagcctgagtgactgttcttttgagacacagctctgtgtattgaacccaaggccctggtggtgtggggtcatgaggggatctcctgatccacaggttacaaatatggagtgggagaagtgtggtttccctggtggggttgcacaatctctcactgctctgcttggctgggggtgggggttcttttggctccatgcttctcccacttggatcatcaccccaccctccttttctttgttctccatgggtccagctgtctgcctagtcagtcctgatgtgagaacgtggatattttagttgaaggtgctgaattcagttgctattttcattcttctccatgacagctgcggatcacagctgcttctaatcagccatctcagtccctatagatttctataaactaaaatttttgaaaaatgtcattatttttgactttatgggtattatacattagtttggtacttagaaatcacaagttagtatataaatgaaaaatttgagtttgttagactttgtctttttgatggcataatttttaattgaagctttatctgattataaaaaggctgttaaattgcttagcaattgtggaactcaccctgaggctagatgattgtatatacttatcaggggaacccacccccagtatttcaacataggttctattttccctaagtgtcggctggtctgagaaataaacagaaagagtacaaagagaggaattttacagctgggccgccgggggtgataccacattatcggtaggtccataatgccccctgagctacaaaaccagcaagtttttattagggatttcaaaaggggagggggtgtacaaacagggagtaggtcacaaagatcacatgcttcaaagggcaataaagatcacaaggcaaagggcaaagtaaagatcacaaggcaaagggcaaaattagaatgactgatgagggtctgtgttcggctgtgcacgtattgtcttgataaacatcttaaacaacagaaaacagggttcgagagcagagaaccggtctgacctcaaatttaccagagcgggatcttttccccaccctaataagccagagggtaatgcaggagaacagggcgtaatttcagtccttatctcaactgcatgagacagacacttccagagcagctgtttatagacgtccccccaggaatgcattccctccccagggtattaattattaatattccttgctgggaaaataattcagcgatatctctcctgctttcacgtccttttataggctctctgcaagaagaaaaatatggctctattgtgcctgaccccgcaggcagtcagacctttggttgtgttcccttgttccttaaaattgctgttattctgttcgttttcaaggtgctctgatttcatattgttcaaacacacatgttttacagtcaatttgtacaatagtggtcctgaggtgacctacattctcagcttatgaaggtaacaggattaagagattaaaggcaggcataagaaattataagagtattaattttgggaactgataaatgaccatgaaatcttcacaatttgtgttcctctgccatggctccagccggtccctctgttcggggtccctgacttcccgcaacatatactaatatttttgctgcttcttatgtgctgccccagagtgagagtcactttgcttttagtcattgtcagtcctgatgtgcacttccctcttggataatttttgtccacagaattttttctttccatgtagaatgatttcattggccttgaaaacttgttctggttctgtatcttctataatatagtctatttcagccctatgggaaagtgataaattgatctcaccttatattttacaacaaaagccatttaatattctcaaactaatcttcagtcatggaaaagaagaagatccattcagtagtcactgtgattcaacaattggtataagtgcttaactttccctttatcacatctctggttaaagtttcatgttctctgcccatgtgttcatctcacaaattaaatgttgctgtagctttgactaagctaggttgcaagtttcttaaaaacaggagtcataataccaattccatgtattctgcaatgctaagtacagtcttctgagtgttaaataaatattgtgcattcagatatagagatataaagactttattttagtgatagaaggtagttttaaattttatacatgatagtaacactaactctgtatctgtagtttcaagtatcttgaaggtggtcacctttttattttatgggaatacctgagactgggtaattaataaagaatagaggtttatttggctcatggttctgtaggctgtgcaagaaacatggcatcagggtctgcttctggtgaggacctcaagctgcttccagtcctgcagaaggggaaggggagctggtatgtgctgagatcacatggtgaaactgaaagcaagagagagatggtagggaggtgccaggctctttttaaacaaccagctcttgagggaactaacaactcactcacacttctctcccttcccccagggcattaatctattcataaagatatacgtccatgacccaaccacctcccactaggggatcaaatttcaacatgaggtctggagggtttggtgtccaaactacaggactcctttaagagagtgaaaggataaatcacagagtaagagaaaatgtctaatatgtgtatctttcattttataaatatataaagatttcttacatgtaattgagaaaacaataacccaggaggaaaatgagcaaaagacttgaactggctttcaaaatggaggatatccaaatggacaatagttataggaatagatgctcaatttcataagtactcagtaaaattcaaattaaaattgtaatgagatgccaatggaatgtctcagattcaattatagaatttctattgtgttcttttttatagttttttatttctctgctaagattttttttctaatattcaccaggagtacattttccattttgtccattggcgtagcaacaatagctgctttaaaacccttgtgtgctacttccagtatcttgggtcattttggggtcagtcatcattaattgtcctttttcttgaatatgagtcatactttccagtttgttcttgtctagtaatattggagtgtgttttggacattgtacatgatatgatgtaggagctgtggattctgttatattcctctgaagagacctttaaaagactttttttttcttaaatcaagcaattaacttgactgatctgaaactctaaattctgtctccctgtggtgagcagctgaattgcctgtccagtttttttttaagcttaactgggctgcctagaagattccagtatgtattctatacatgctattcagagtcagccagacatttggagagagctgatagattggttcctctcttacttgcttctttctgtgatttctcggtatgctttccagatgcagcattcaccccaaacactgtgctctggttccttaagccaggaagactgtaaattttcagcatttttattaccttttgaggcaccagctggggcctgccataaggctaaaacttatggaaaaaacaaaaccaaactggaaacttatgaacttatgtagtattttttccttttttcaagtgtagcacacccttctcccctatttttgactgcttttggtctgtctatactgcctttagatagctgggttttgtttgttttgttttcgttcagagtttatagttacatgtgaaagtgttggtttgatagtagctgcttgaccatcactggaagcagaatttaagctttaaatttaaatgaagatactttgctctaatatttttactttctttgtaccttaggtaccctcttagtggcatgggtttaccaacatttaaagaatggatccaaaatacccttggagtaaatgtggagcataaaactacctctaaagtaagcaaacaaaaattattactaactcatttaactgtgtttttaaaacccaaattaatttgatttatctttgtaattcattatattggatttactgcaactgtcatgttttttgttataaagcctattaattatattggccttgttagactgttagcggcagttattcattgtcacagatatagaccttagtctcagaatttatttgagatttatctggcaaactttttatcctctctgagccttggttatttttagaattgggagtaataactatttgttctgcctatcacagggtagtagtgaagtgcagattatttacttccttaaagagtgctttgttacagaaatataagttgctatcatgtttagattatttaatagactgactgtaatctaggattaatagagaataatttaaaataaaaatgtaaaatcacatttagtattaggatatttagaatatttgaagaattataaaaagtaaaaatttgattaagatatgagtgattgaggattttagtttgttcatgtagtttcacttttctgaaagtgggattaggaaactttaaactgtaggtatatatatatatatatatatatatatgtatgaaactaatgaaatatttagcgtttctttttattatttttgttgtgtttttattattgttgcatttctttttattatttttgatgtgtttttattattattttgctgtagcatagtattctgtatgtctctctaactggatataagttccataagtacagggctatgtcttatacaatattctccactgtatccaacttgttgttaagtggtataggtatttggtgagtacttgttgggtttatttaaaaatccacagttattttactctagttattaagttaggctgaacaactaattctaccccttccaagccatcttttaacttttcctagacgtctcttatctcttaaattctctctctcttttgatctcttgactatttgcaattacttgtttttgacattgatacaatccacatactatagttagaaatttcaccaggttttgagcccttttcaattcttaatgacttaaaatattaatatattttgttggagttcttttagtatttccttctcctatgggataaattgcacagggtcaaaatttttttttctgtttaactcactgttgtatcaagaccttgaagagtggctagcttatagcagccactcagtaagtatttattatgcagtatcttaataagagattaagataatatgcaagtatcatatttgttctttgcatattcttatatactttcttttttccaaatactgtatgatagcttccctcaatcccccgtagcagattttacttggccagccgtttatagacttcttcctatattctagccatgctattaggtgcttttcacaaaaattatcacatttaacctgccttccttatagtagcactatggtgacaatgtcatttaacagatgaagaagccaaggctcacagaagttgggtgacatgcccaatgtctcatagttttaactttgaagttgaagattagatttcaagttacctgttaggtgaaattgaatatcaagtttataattatgttgtgagttttaaagcagctctataaaaatggatttattacttattttgaggctttctgttgatcactttaaaatggcaattgaagaataagaaatgctgaatttttttttttttttttttgcgacagagtctcgctctgtctcccagagctctgtcgctctggagtgccgtggtacaatctcggctcactgcaagctctgcctcccgggttcatgccattctcctgcctcagcctcccaagtagctgggactacaggcgcccgccaccacgcccggctaatttttgtatttttagtagaggcgaggtttcaccatgttagccaggatggtctcaatctcctgacctcgtggatctgcccttcttggcctccgaaagtgctgggattacaggcgtgagccactgcacccggccagaaatgctaaattttatcgacaggtataagtgtagatagtgcgaaagtcaagtagctttctcccagtctccttaatctgaaatggaagatttaatactttgctgtcttccctgttgattacaatctttagaaatttgtaatttgttactctcataaagctgatttctatatatgttgtgttgtattttcctatgcttcagccttactttgaatgtttaaaaaaaagtctacattttatagtcattctctttaactgaagtacccaaaattcgttgtctaaaaataagtcaaagaaatcaattttattttctaggcatccttaaatcctagtgatacacctccttctgttgtaaatgaagattttcttcatgaccttaaagaaactaatatttcatattcacaagaggcagatgatcgagtatttagagctcatggtaagttactttatattagccctatttatttttaacaaaaaaattctatattttaagctgtttttgtgtttttcttttttttaaccacaaaacaggtcattgtcttcatgagatatttttgctcagggaaggaatgtttgagcgaattcctgatatagttttatggccaagtaagttttcccctcctcgtatcattaatttagtattgctaaattttaggtaaatttaacattggaaatacgtactttttggcatatgagttgtaaaaaatataaattgctgtatttttaagagagtttacataacagtcttgaagctctttcttgacttggttgttctgaactattggttttaacaattcattttgttgctgataattaaatcatcattttaaatgtaaataatcatatttgagatgtcagtggaaaaacatatttttggataatttggaagcttcatgaaattagtgtcagtaatacattcagatatatagaattattaatataattgagtactgcaaactaatattagtaataatttgttgatatcagcttgtgagctttaaaaagcctggtcaaacaagttttatgtattatgtttatgcatgctatgtttaaaatgaataattaaattttgagtaattattaggatttggctgggacaggggatggatgagctttctgttgtaattttgctcttagtgagtagtaggtactatatttataaatctgaagtttttacctatctcttttagcaggtaatttaaagcaagatgggtatattgttccttgctgtccatcattgcattttttaaagagttctattgatcttctgattcattttctcttcagatcttccttttcagagtgtatattttattttttaataaattggctcattcacggactctcagttcttaaatgagatccttctactttggagggactgagagaaaaattatactttaatgtgggggcaagaggcaggtgagatacacagaaggaaaatccaagagcatatgtagcagagatgaagttactttcctgatacttgtatattagtctatgcatttggaatatttatgaaatgtctttcatctctattagtttagtatagaaattttaactgttcctgaggaaaagatattctccaatagaagaaatatttttgttttgcttccttgctttttagtagctttaggttacttctctaccaagatttggagaaggtttattccatttattactggaaaacatgaaagcaaaatttatcaattttcacttcccacaagaaacctaataggccatcctttgatgtatcttaataagaacttccaagtgtaccttctaggcattttcttcatgtctttcaatattaaaatacttagagagttgggcttggcagtgcatgcctgtagtccccgttactcagaatgatgacgcaggaggattacttgcctgaagttcgagtctagcctggactagtgagtccctcatgtcttaaaaaacaaaaacaaaaacaaaaacagaataatatagtggaagtatattttgctttaagaaatccaaatattctcaaaaactcagatgtagtaaacaatatttcacaaaagtttctttgctttgtaaaatccctcccattttattggttcccttgcacctttgctcttccactttttttcatcccagtttccaaatcagttccttctcagtgtatatccaggtttttgtgaagccataagggttttcatgccgcatgtttcttgccccttaagcctcccatacacccttgggagattaattcaataatccttttgccaacttcttccatacttcaagaatctgtatgaatggtgtattcctggctgaatcaagtttataattttattctgttcaatatcctagtataatgacttctttggaaatagtttcccgacaagttattaagtcactgaggtctttatttaattttaatgtgaatttcctactggcgatgaagtccaagtttttctttgcaggaggcctagttttgagacaatgaagaaatttgaggcaatgtggtattccatagagtggatgtggctgtctcattcttgcaatacacacacacacacacacacacacaactggaaatctgttgtagttgtctttaagtctggctttgatctgaatcggaattctatgtgttgcttaataggatgcttagggcttaagagtaaggacaattacttcacttattaaatttagtatttatgcattattttcagtggcttaaacaccagaactttagaactgtgaaaatacaggctaggtacttgaggataagcagtgaataaaacaaaaatccgtgctctcaagtgccatacaatttactgaggggaaacagataatccacaagtaaatatgtaacatattgggtagtgttaagtgctgtaaagaaaagaaaagcatgtaagagggtagtgcgaacaaggatgtgtagtggaatgggggtgcagtttcagataacatggttaaggaaggcttttgattaggtgacattcctagaagataattttgccttgttgaagattttttaatagacatctttgggtgttttgtgaattattaattaatgagtattctatttagtaaatttaccacagatagcaagctttataagtttaatccaaaagcttgaaaatagatatttattaaaaatcggaatgaaacaaatgacatgttttcttagctttacacaaaccttagaaaagataattgcaacttttatggaactatttttgctttcataaatggatattcatttgctttcctcagcattcttatttcctactaagtccttaggctcttagcaactaatactggagttttgcatagttttcttgcctcaagtctcgctcctccatgccatctcttattatatcaggagattgacttttctaaaacaatctctttgccatcttgttcccctccttaagaacctccactaatgtcctattgccagtcaagttgagtcttagcacctcttgcttggcatttaaaatcttccagtcaggtttttgttacttgtataacttttacaagcataaagagaaccctttagttctgtacaaaggaaaggaattatgtgcagtgtattttgtgcaatattgtaaacatttgtttaaacaataaatcatcaatggtgctaaaattagtaggtgaaagtatgatgagaatcatgatattttacatagtctaagatatgtaaatactgtgtcactaggttttcccactacaaggatactgtgtttcttgttgaaattaataggtatttaaataataggtatttgaacaattaatacctattaattttgacaagaaacagagtatccttatagtggggaaacctagtaacacggcctaaccaaatgctgtattaataagttaacattactggaaatgagacatgttcatatcatgtgcctctagatgtaatgcactgacaaagatgcaacatcacttctgtggaattactcccaaaatatataacctgaacttaatcatgaggaaacatctacaaacccaaattgaggggcattctatgaaataactgaccattgttcttcaaaactgtcatggtcatgaaagttaaagatactctaaggaaatgcctatttttaaagaagacacaaggcaactaaatgcagggtgtgatcctggagttgattctggtccagaaaagaggacattagtaggacaattggaagtatttgaataaggtctgtagattagtttattgtattgtatcagtgttgattgcttggttttgaaattggactgtagctacgtaagatgttagtatttggggatgtgagatgaaggaaaattttcgtactatctttgtaacttttttgtaagtcaaattatttcaaaatgaaaagttaaaaaggtaaagtgttttagtactcaattaactcattgtgttaatgagcaaatgaatgaaggaaaagtttagataaagaatttcgtaggttcttatttgccaaggttatcagattttatttatgcctctgtaattaatttattttcccttttttcaacagcatgccatgatgatgtagttaagattgtgaatctagcttgcaaatataatctttgtatcataccaattggtggtaggtattgtgccttttgaattttaatatgtaaatttgttctatttaaaatatttgtattttaaatatttgcgtcaccctactgaaaacaaacattattgtaattgtgatgtggttattctcaaaaattggtcaatgatgctcatttttgttctaagtaggattccttaaactgtttgagacatggtataccttagttcatggctttttcctctatgggccctagttgaagctgtaatttaatgcctgaataacaaaatgtttctgctttagtaattactttttaacctgtatatttatggagagaattttctttttcaaaagctaaatataaatatgtcctatataaacctttgagattagcataggaatggtaataagactcccaacaattctagaagctccatattccctcttcagctgatgctttctgttgaatttatgcaaaaaaggcactaaaatgccatttattatgaaatatttttctaattccaaatgactgtgacaagcaaatagtggttactgatcacaggcatcacgttcttaaccaacagttcatgaactcactttgtaaaattacgctgaaccttacagattaacaccccctgtacttcttgtggaaggtgactttcacatgttttctttcatgcagaacttatggaagtatcagtcaagaatttattcgatatatggtgatttagatctggttaagaacagagaacattgttttgttctttaatggtatcaagaaggcatttttcctttgacagtaaatgttaagacaacagtgtgtttaaatacttctatgtattattctatgttaaaatcactttttcaccaaagaacatataaatgtttttaaatacctcataatctagacattttaagcttgtttctattctaatttattaaagcttttttgtataagaatataagattattttaaatgataaatgaatctcataattgtggtaaaaaggaagtaatgatgtctctagttgtataggatgggtctttttttcttttaagctacctctccatggtaattatctgcttagaacttttctaatcatgtttttggagttccacaaattgctaggggcttcacttgagtgtggcatttccaggggatggaaccatagcccattgctttcagttccgtaatattgcttcattttggcactcagcataaaataaaggtgagtttgcttttagtgtgttagcatttgcaagttgtattttgcaaagtattaataggtatcacttttctagtggccctatctgtatacttgatatgagggatttgccatagaaatatagctaaaaacagaatatttaaacataaaagttgttgtttcctattttggcaggaggaacaagtgtttcatatggcctgatgtgtcctgcagatgagacaagaacaattatttctttggacacttcacaaatggtatttaataatttgagatatatttaaaacattttctttattggctccaccttaattgtcattaaaaaagaatctagccactgggcgctgtggctcacgcttgtaatcccagcacttggggaggctgaggtgggtggatcacttgaggtcgggagttcgagaccagccaggccaacatagcaaaacctcatctctactaaaaatacaaaaattaaccgagtgtggtggtgtgtgcctgtaatcccagctacttgggaggctgagacataagactcgcttgaacccaggaggtggaggttgcagtgagccaagatcacaccactgcactccagcctgggtgacaaaaaaaaaaaaaaaaaaagaatctaatatccattttgttttaaatgtatttcatcattacattttacccttgtattcagttctccaaaaggtaggtttacttttaccctcaggtatatatgttgatggctattttaccaaatttgaatttttttttcaaatacctaagtagagagaatagtttacccattttttagatgaagtcgttattaacattttgtcatactttctttatctttcttttttttctagtagttttagagcaaattctgatacaatgctactttacatgtaaatatttctgtataatctcgtttaaaaaggacattttctcacataactattattatcactcctggcaaaatcaaaagtaattctttatgttatttagtagttagtctacattaaatttttgataaaaagtgtctgttttatagttcatttgttcaaatggggatccagacaaggctcacatttgctttccattgtagctcttaagtctcactttatgtaaaagcttcatcttactccctgtttttttcttttgaatgttatagacttttgaagaaacaaggttatttgtagtatagaatgtcatattttgaatttatctgttgctgcttcttgtcatttaactctttatctaagccctgtatgtccactaaattagaagttccatataaagtctagttagattcaggcattgcctttttttggttttgtttttacagcaagaatccctcatagatggtaatgtgcttttaaaaaaatgtcacataacatcaatagaggtgtgtagtagctgattgtctcacttttagtgatgctaaaattgatcaagttcagatggtgaacactttattttattgtaaggttccccattaacctatctccttatcccagattttaagaaaaggcaatttatttcctcagaagatagctgaagaatagcctgttctggaatgttaacatgggtttggtagtatatatgggatgtaatagggtagcctatatgttttctttaggtttttctgtgagtgcctatgaagttttttctgcttcttttaatttcctttttctaccaaaagatatgtttgaactcttggtagctacaaggtatatatttagaatgagtatgtaattgcctcaagggccagtctgttgggggagaagatatatatataaggtaccatcagatcaataaattctttgtcttttcattctgcaatttaataatactgtcttttgtttagctgccaaaggaccaaaagcctgattataccatagttgtattgaagttactgttgtcagccaggcgtggtggctcacgcctgtaatcccagcactttgggaggctgaggtgggcagatcatctgaggccaggagttctagaccagcctggccaatgtggtgaaaccctgtccctactaaaaatacaaaaattagccaggtgtggtggcgtgtgcctgtaaacccagctactcaggaggctgaggcaggagaattgcttgaacccaggaggcagaggttgcagtgagccaagatcatgccactgcactccagcctgggtgacagagcaagactctgtctcaaaaaaaaaaaaaaaaaaaagaaagaaagaaattactactgtcttatagtgagagtataattatgagttttatgtaacataaaactaaaagtgcattcacatacatcatcttatttaatgtttttcacaacgctgtgaattaagcagtgcagttatttgtatgtgttcagatttggaatgtaggcagcaactgctatttttgtattgtctgttgtgctctttcctttttattattaagtagatttatctatgttagtttttgccgtgaaattgagcatatgaaagtagaaagaaagcttccctgggatccagaagaaggttctatatgttacccaattgctcagccagatagaaaggggaaagaagtctgctcttaatagtagaaagtaattcatgaaaattcatatatgtatataaaagttaggtcaaataagaatgccaaataacattttttattggcagtcatacgtttggtaagttgagccagatgaaatttagttccttcttttgagcccgaggcagggatttgctttgttttgtacatggggtctctggccctgttttgaattaaaaataaagtagggatgccatctgctatattcaaatgtccttgcagattgttttttctaatcttatggtcatattctgatattcttaaattagatagtgattgctatgttaacacagagcagatagtatttgcacaatgccaggacctgtatatgctgtttttttacatggagtacctcatttaattattgtagccaacactttatgtattattactattttacattttacaaatgaggaaacaataagcttagacagttaaataatttgcctaaggtaagagaaggaatttaaattaacctctgaataaagacagagtctatgttttaagccaacccctgcataatatgctgcctttgttactatgttgtcatgttgtatagtctgggataagtggacttggtttccagtgtgggtggttgaggggaacccttcttgcttaatcactgtcttaccacttgttgctttgaattaggaagttatatttcctgagaaaatattagtagttcctggagatcagatttctttcttcctttgcaacagaatcgaattctctgggttgatgagaacaatttgacagctcatgtagaggctggcataacaggacaagagttggaaagacaggtatgttatttatttttcttatttttttaaattaacttattctaatatcaattctgatgttatttctttaatgaaagttttcaaaactgtatcccctctatgaatgaaataccttttatgatacattcattcactcaaagaatttgtttagtttctattatgggtcaagcattgagctagattctgaggacatgatagtgaataaggcattgtctgctaccttcaggtagcttagattaggacagaaagttcgataaataattaattatttggagtgaaaattgctatgtggatgctaaatgcagggtattatggatcatcaaatggggctaggtgggaacgagttgggcaaagaaggtatcacatagaacctggcattttttttgttgttgttagtactgagtcagtggcaaaggacacagcatttaaaatgagacttcaggatgagtctgagttagcaaaaaaggaaagaacaatccagaggaaggagcatacatgcagggcttctcagggtgactgttactttttttttttttattttttttgagacggagtctcactctgtcgcccaggctggagtgcagtgacgtgatctcggttcactgcaagctccgcctcctgggttcatgccattctcctgcctcagcctccccagtagctgggactacaggcacccactaccgcgcctggctaattttttgtatttttagtaggacggcgtttcaccgtggtctcggatctcctgacctcgtgatccgcccgcctcggcctcctgaagtgttgggattacaggcgtgagccaccacgcctggccgactgttgcttttgagggtctgcagatagctgaatatggctgaaggctagtgtgtgtatgggagaacatgtcttcttggtatttgtatattgggtgggtgtgggtacagtagtggtaaaggatcaagccaggaaaacatgaagagttcagatcataaagggccttataaagccccttttagaagtttgaactttacttttttactggtattgttctggctgctgtgtggtgaaatgggtggtctatgtaagggtggactaagagactgcaacaataatttaggcaagagctgagagtgacatgaagtagtagaaatggaacaaaatggaacagtttgaacatggaattctaggatcttggtgatatatttcatcagctgggtgaatattggtattcattgaacttttcagtgtgcaatttcattgacaactactcatttcataaattcatgaaattcttggagttcttatagtacctttttgggatcctaatgaatttttggaaaactttaggtttctttcatagattctaagcaggtaatagtgaaaataaattggttccttcaacttcctcaaacataatcaagataacgataactcagcttttgtaaacaaaaattagaaagtccaatttgttagtgatgtactgaccattttgttcaacttgggttatagagacccctctcctccaaacctttaataggaagagatgtgatgtgattgttatcttattttgttgttgttttcttttctttcttgaaaagttgattgacattgatctgctcctgaccatttctggatgataggctttgaaaaaaaatgattaaactatttattttttatttaatgcagtcagatgcagataactggaataaaattgaacttatttgttgagacagtgttaaagatcctcaataaattaaggttttatatcagataaatagatttatcaattattatagtttataatgaactttagtgggcagaataatagtatttaatgaaaaaacctctaaaaagtcctgtatcagtattccattatgcttaaatgaggcattatcagcacagcacttttttttataacaaagaatggccttttatgtcaccaattttgtatctttattatagcatttgatgtagtattttaacctttccaagttttcttttttttttttaaaggttagaattaaaattcaaggaacatatttccttgaaatttaaatgacattttcccagactaggaacttctgatattttacctactagttcatttccctaaatgccgatatagaactttcttttttgcctccagtaggctataatgtagttcctacagctattttgatcccagtaaaagttcttcctcattaaacttttgtgtccttcagattctacttcagttgaggtaaccagtttaaaacatcctggcttttctttctgcaagcttaaaatgacacaaatacagtagttgggtagcacagattttaatcgctttaacttgtaaatcacattgatgttaacatgataaaatttaatggaagctgctaacatgtcaattatggatttggagaatttttcctacgtttattaaatctttggctacttttattggttaatagtctgaggttatctgactcgaatttttttttttctgcttaggcacatcatcactaataacctcacattatctttctttgtttctaatagctattagctctcactgcaaacctcaatatagctcctagctgtgtgaccttgggcaagttactcacctttaagcctcagtttctttacctataaagtgggtatcataattcctacttcgtggggtttttcatcaagatgaaataagttaataatgtgaactacttagaactttgattcattccactaatttttattgagcactatttgcttcattcaggctaacagactttaaatattctttttatgtgctgtagactccaaaatttatattatcatcctagacttctttgctgaactgatatagccacttgcctaattgatatctccacttgcgtatttacagacatttcaaactccgcattttaaaaactgaatttttagaggaaaaatttgcaatcttgtctccaaaatgtgtctgttctgtagccgccttcttctcttcaggagatggaaattcaattccttaggcagcttggaccacaatctttgaagtcatagatttttgttttatattgctttataatagcttgagatataattatgatctaatatgtacaatttaatgtgtacaatttgataagtttcgacatatgaatataaccatgaaaccatcatcacaatcaagataatgaacatatccaccaaccccaaaagttttcctctttctcctttataatcctttcccactcccacccacaacccttaagcaaccccccaggaatcactgatttgctttctgtcacatagatttgcttaaattccctacaattttaataaagtggaatcctacagtatgtatgggaggagggtctggcttctttcactaggcataattattttgaaattcagccatattgttgcatttatcagtagttcatttctttttgttgctcagcagtattccattgtatagatatgccactgttttgtttatacattcacctgttgatgaacacttggattatttctagttttgggctattacaaacaaagctgctatgaacgttcatgtgaaagtttttgtatagacatatacatttgtttcctttcggtaagtaactggaaatggaatgaatagatcaaaatggtaggtatatatttacctttttgagaaactatgaagttttttcccagagtgattatatcattttatattcccaccagcactgtataagagttccagtttctccatatccttgccaatactttgtattgttagtctttttaattttagtctaaactttagtaggtacatagtagtatcttattgtaggtttgttttgttttgttttttgagacagtgtctcatgctgctgcctgagctggagtgcagtggcacgatcatggctcactgcagccttgacctccctgggcttaggcaatcctcccacttcagcttcctgagtaactgagaccacaggcaagtgccaccatgcctggataatctttatatttttctgtagagatggaattttttgccatgttgcccaggctgttcctgaactcctgggctcaagtgttctgcccaccttggccttccaaagtgttgggattataggctcgggcccctgtgtctggcctcattgtagttttaatttatatttctctaatgactagtgatgttgaacatcttttcatgtgcttatttgccatccatattctttattggtgaagttctccttaaattatttgcccaattttttttttttgagatggagtgtcgctctgttgtccaggctggagtgcagtggtgtgatctcggctcactgcaagctccgcctcccgggttcatgccattctcctgcctcagcctccccagtagctgggactacaggcgcccaccaccatgcctggctaattttttgtatttttagtagagacgggttttcaccgcgttagccaggatggtcttgatctcctgaccttgtgatccatctacctcggcctcccaaagtgctaggattacaggtgtcagccaccacgcccagcctatttgcccaattttaagattgggttgttttcttattattgagttttggaattctttatttattctgggaataagtcttttttcagatatatgctttgcaaatattttctttcagtctgtggtttctcttttcattttcttacactatcttttgaagaccagctgtgtttaatttttatgaagcccagtgtattaatttgtctttctatcatgcttctgctgttgtgtcataatgcaaggttatagagattttctcccatttgagttttataatttttagtcttagatttaggtctctaatcagttttgaagatttctgagttattatttgtatatggtataaaattggattgaagttaatgatttttgcacatggatatccaattgttcagcaccatttattggaaaagattatcctttcttcactgagttgactttgcaccatcatttaaaaaaatctgttgtctatatatgtctgcttctagttctggactctatatatgtctctgtgctaatactatactgtttggattactatagctttatcacgagtctttttcaaagttgttttggctattctaggttctttgtatttctatatgaacttcatgttcatatggaaatgtcagtttctgttaaaaaaagaaaaagtcccattgggattttgattgggattgcattgactctatatatcagtttgaggagactgacagcttaacagttttgattcttctgacctgacccatgaacatggtatatctttagttttttgtaggtctgtaatttctctcagcagtgtcttacggttttctatgtacatgtctttcatatatatatatatatacacatatatgtatatatgtatatatatattttagagacaagatctcattctgttgcccaggctggagtctagtggcaccatcatagctcactgtaaccttaaactcctgggcttaaatgatcctcctgctacagcctccccggtagctaggactacaggcatgtgccaccatgcttggctaattttttaatttttctggagacagggtcttgccatattgctgagactggtctcaaacttctcgcttcaacctaccaccctggcctcccaaagtgttgggattatcggtatgagccaccatacctggcctcgtatatttttaaaaacaggatttgtccctaagtagtacatattttttggtgctgttgtaattggtatttttaaaaattgtcagtttctggttgttctttaatagtgtataaaaatacagttttttatactgatcttatatcctgcaactttactaaattcactaaattttaactttttttttgtagatctcattggattttttacatagatgactatgttgtgtgtgaataaagacagttttctttctttctttccaatctgtttgcctttttttctttttcttacctgattgtactggccagataatgttgaaaagaagcgagacttgtttctgatttaggagagatgtgttcagtcctttaactattaagtatttgttaactataggtgttttttgtagatgccctttatcaagttgaagaagtccctttcttgtgttaatttatagagtttgaattaggaatggatgttggatttgtgaaaaaaatgttattttgtgtcttatagttgaggttaagttgaagtaatttatttgagttcagtcttattttctaaagtagaaaatcagtgctgattttttcccaattgttgctttagtgacatgccaccaattttgatatgtttattttcattaatttgaaaatattttctacttctttgattttttctttgatctatggtttactcaccatgtatatatgttatttagttcccaattattttgggatttttccagatatctttctgtcattgatttctatattaattttgttgtgttcagaaaacatactttatatgacttgaatcctttcaaatttattactacttgttttatggcccacagtacagcctatttttaaaatgttccatgtgcacttgcaaagaatgtgttttcctgctgctgtttggtgaagtagtctttaaatgtctgttaggtcagattgacttataatgtaattcaggtctcttatattttttattttctgtctacttgttctgtcagttattgaaggggggtattaaaacctccaacagtaattgtagatttgtatatttcttctgcagttctatttttgcttggtgtattttaaagctcggttattaggaggataaatgttcaggattgttatggcttctcgattaactgacccttttgtcgttatgaaatgacctcctttatgtgtgataacatgctttgctctgaaatctgctttttctgatactaaaatagctattggagttttcttagcatggtatatctttttgctttttccattattttactcttaattagtttgtatctttatatttagaatgtttttcttataggcagcatataattggttcttttctttttatctaagttgacaatcactaccttttcattgaggtgtttagatcatttaccttcagtgtgatttattgtggtttagtttaaatctgtcatcttgctattcattttctgtatttcccatctgtttttgttcttctttccctcttttactgcctttttgggatttttttttaaatgatatgctttatctctttagtttctttagtagttttaagtttttgttttgttttaggatttgaagtatacatctttaacttgtgtcagctacctttgagtgatattgtaatactttgcagtatcatttaaaaaatttaaataatatgaaagcatcttgtgtatttacccatctagttaacctttcctatacccttaattttgtctgatgttatttgccttctgcttgaaggacttcttttaacatgactttagtgtgggtctgctgttggcaaattctaattttgtctgaagaagtctttatttcacctttgtttttaaaaaagatatttgaagtgagtatataattgtagattgatattctttcagcagtacaaagatgttgctccactgttacctactttattgcttttcatgagaaatctgatattatctttgtctttgtttctgtgtatgtaatatgctttttccccctctggctactttttttttttttctttgagacagagagtttcactcttgttacccaggctggagtgcagtggcctgatatcggctcaccacaacctccgtctcccaggttcaagcgattctcctgcctcagcctccagagtagctgggattacaggcatgccccaccacgcccagctaatactatatttttagtagagatggggttttaccatgttggtcaggctggtctaaaactcctgacctctgatgttccactgcctcagcctcccaaaatgctgggattataggcatgagccaccacagccagcctaggttgcagactttacgacacttaacttaaatacatcagcaccatctcctaaagacagaagaatagtgttcttctttataactataataccattatcatgtctaagaaaatcagtagtaattttttttttttttttttttttggagacagagtcttactctgtcgctcagcaggctggagtgcagtggttcaccacaacctctgcctcccgggttcaagtgattctcctacctcagcctcccaagtagctgggattacaagcttgagccaccatgcccggctaattttgtatttttagtagagacggggtttctccatgttggtcaggctggtctcgaactcccgatctcaggtgatccgcccacctcggcctcccaaagtgctgggattataggcgtgagccactgtgcccagccccctctggctacttttaagattttcttgttatcactggtttgagcaatttgattgtcatggaccttggtgtagtttttctctgtgtttcttttgttgaggattcgttaagcttttttgatttgtggctttatagttttcatcaaattttgaaaaactttgtccattatttcttcaactatccaataaacccccctccccgctgacctttagggactctatttactcacttattaggctctttgaagttccacagcgcactgctactcttctcatttttttcttttagttcctgttgctatgtcnnnnnnnnnnnnnnnnnnnnttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctctggctacttttaagattttcttgttatcactggtttgagcaatttgattgtcatggaccttggtgtagtttttctctgtgtttcttttgttgaggattcgttaagcttttttgatttgtggctttatagttttcatcaaattttgaaaaactttgtccattatttcttcaactatccaataaacccccctccccgctgacctttagggactctatttactcacttattaggctctttgaagttccacagctcactgctactcttctcatttttttcttttagttcctgttgctatgtcttgaagttcactactgttttattttgctatgtcttttctgctcttaatcccattaaatatatttttaatctcagacattatatttttcatctccagatgtttaatttgggcctttttatatcttgcatgtctctactttttgaacatatagaatacagttataataactgttttaatgttcttgtcagctgtgtctaacgtctgtgttagttctggattggttttgattattcaccccataatgattatggggtgttttcccgcttctttgtagcttggtaatttttatttttattttatatatattttatttttatttttaattttatatttttaattttgaatggtaatttttgattagatggtagccattgtgaatttcgatgtttttcagttctacaaatattcttcagcttttctcctgggatgcacttatgtggaaacagttgatcctctagttcttgcttttatgatcttttgcttttttcagtctgagactaattactttccactactgtggtatgacattgttggatatcctacctaatactctgtgaattaatagttttctcagttggactagtggaaacaggtactgtttctggccctctgtgagtgctggcactattctctaatctactggtgtccagccctttgaatgtgaggacttttttggtggcagatatcatgaaaattatgcatagacctttttttttttaagctcatcagctgttgttagtattagtgtattttatgggtggcccaagacaattcttcttctttcagcgtggcccagggaagccaaaaggctggacacccgtgctgtaatccatctggagtatatcttcctctggtctttggtatttcactcacttgcatttacttttcagtactctgctgaagacctgaggggcacactctgcagatctccaggcacctctctttgtgctgcttttttctgtactttttcctgtgaactctaaatgccttgattgccttgactgagctctatgctcaatctcaactcagtgtttgccaagttgtgcctggattctgtttctgtggagcgctaaactagggtcaagtcacagtgctcatcacctgtgtttactttctcataggatcaccgtccttcctgactgcaagttcagtgtttgaaaactttttttttttcttttttaaaatacaaggatggagtctcgctttgttgcccaggttggtcttgagctcctggcatcaagtgatcttcctgcctcagcctcctaaagtgttaggattacaggtgtgagccaccatgcctggcctgtttcttctatttttctgtgttttagtcttattgggtgggagggtaaatcctagctcctttaacttcagtttgggtagagggggaagttcctgctctgctttttatttttttcatcacacttctaattattctgtataatttaattatgattcttaatttcagtttcctttactatttctcctgtttttttttttagcagcatatacatttttctcaatattgctctataatataagcaccataatttagggattttttaaggaatatatctgaaggtcagcttgtagtcagtaaatatttgttgtttcagtattgaattggaacacaagtgagataaagcttttattcccctagagcttcatggcacatggtaaataaacacagttatttttatctagcgtcatatggggcagagatgttattttattaaaaaagaaatcttgagtcagacatggtggcttatgactataattccagcactttgggaggccaaagcaggaggaatgcttgagcccaggattggaggctgcaatgagccatgattgtgccattatactccagtttgggagacagagtgagaccctttcttggggaacgtggtgggtgaatatttgattaattgtatgagtaaatctgtggacctttcttcagcaaatttttcttaccagctaatggcattaacagagacacagaccttataggagaaagcggctaaatgtatatgatcttagataccatttattaagcacttactatgcaccagcagttgtttctcactaaatttgcatattgtggtatactgcggtatgcaaattttctagcaacagtaaatgacaaatttcaaacccagggatttttgtttgttttcttaaactttttggcaagaaaaaacccaggttttcaaccattacactttcttcacttatttagtaggaagttagtaagattttaaatgaagtaaatttaaattggtgtggtagagctcattcagcatggggaacatctggtttttttggtatctgtatcttttgctttacacaattcctggtatatagtacctgcttgtaattggagaagataatgaagtaacctacctgacaaaagaaacaaattaatcgtatatataatattggatatactgatagaaataaagtgtaacaccgcactgttaatactagacagatcaacgagacagaaaattaacaaggatattcaggacttgaactcagctctggaccaagcggacctaatagacatctacagaactctccaccccaaatcaacagaatatgtattcttctcagcacctcatcacacttattctaaaattgaccacgtaattggaagtaaaacactcctcagcaaatgcaaaagaacagaaatcataacaaacaatctctcagaccacagtgcaatcaaattagaactcaggaataagaaactcactcaaaaccgcacaactacttgaaaactgaacaacctgctcttgaatgactactgggtagataacgaaatgaaggcagaaataaagatattctttgaaaccagtgagaacgaagacacaatgtaccagaatctctgggacacatttaaagcagtgtgtagagggaaatttataacactaaatgcccacaagagaaagcagtgaggatctaaaattgacaccctaacatcaaaattaaaagaactagagaagcaacagcaaattcaaacactagcagaagacatgaaataactaagatcagagcagaactgaaggagatagagacacaagaaacccttcaaaaaatcagtgaatccaggagctgttttttgaaaataccaacaaaatagaccgctagccgactaataaagaagaaaagagagaagaatcaaatagatgcaataaaaaaagatacaggggatatcaccactgatcccacagaaatacaaactaccatcagagaatactataaatgcctctacacaaataaactagaaaatctagaagaaatggataaattcctggacacatacaccctcccaagtctaagccaggaagaagtcaaatccctcaataaaccaataagaagtcctgaaattgaggcagtaattaatagcctaccaaccaaaaaaagtacaggactagacggattcacagctgaattctaccagagatacaaagaggagctggtgtaccattccttctgaaactattccaaacaatagaaaaagagggactcctccctaactcattttatgaggccagcatcatcctgatatcaaaacctggcagagacacaacaaaaaaagaaaatttcaggctaatatccccgatgaacatcgatgcgaaaatccttaataaaatactggcaaaccgaacgaatccagcagcacatcaaaaagcttatccaccacaagcaagttggcttcatacctgggatgcaaggctggttcaacatacgcaaataaatcaatgtaatccatcacataaacagaaccaaggacacaaaccacatgataatctcaatagatgcagaaaaggccttcaataaaattcaacaccccttcatgctaaaaactctcaataaactaggtatcgatggaacgtatctcaaaatattaagagctatttatgacaaacccacagccaatatcataccgaatgggcaaaagctggaagcattctctttgaaaactggcacaagacaaggatctcctctctcaccactcctattcaacatggtattggaagttctggccagggcaatcaggcaagagaaagaaataaagcgtattcaaataggaagagaggaagtcaaattgtctctgtttgcagatgacatgattgtatatttagaaaaccccatcgtctcagcccaaaatctccttaagctgataagcaacttccacaaagtctcaggatagggtgcaaaaatcacaagcattcctatacaccaataacagagagccaaatcatgagtgaactcctattcacaattgctactaagagaataaaatacctaggaatccaacttacaagggatgtgaaggacctcttcaaggagaactacaaactgctgctcaaggaaataagagagaacacaaacaaatggaaaaacattccatgctcatggataggaagaatcaatactatgaaaatggccatactgcccaaagtaatttgtagatgcaatgctattcccatcaagctaccacttactttcttcacagaattggaaaaaactactttaaacttcatatggaacaaaaaaagagcccacgtagccaagacaatcctggacaagaagaacaaagctggaggcatcatgctacctgacttcaaactatactacaaggccacagtaaccaaaacagcatgatactggtaccaaaacagatgtataggccaatggaaaagaacggaggcctcagaaataacaccacacatctacaaccatctaatctttcacaaacctgatacaagccatgggggaaagattccctatttaatcaatggtgttgggaaaactggctagccatatgcagaaaactgaaactggaccccttccttacaccttataaaaaaatcaactcaagatggatcaaagacttaaatgcaagacctaggaccataaaaatcctagaagaaaacctggacaatgccatttaggacataggcatgggcaaagacttcatgtctaaaacaccaaaagcaatggcaacaaaagccaaaattgacaaatgggatttaattaacctaaagagcttctgcacagcaaaagaaactatcatcagagtgaacaggcaacctacagaatgggagaaaatttttgcaatctatccatctgacaaagggctaatatccagaatctacaaagaacataaacaaatttacaagaaaaaaacaaccccatcaaaaaatgggcaaaggatatgaacagacacttctcaaaagaagacatttatgcagccaacagacatatgaaaaaatgctcatcatcactggttattagcgaaatgcaaatcaaaaccacaatgagataccatttcacgccagttagaatggcaatcattaaaaaatcaagaaacaacatatgctggagaggttgtggaaaaataggaacgctcttatgctgttgggagtgtaaattagttcaaccattgtggaagacagtgtggcaatttctcaaggatctagaactagaaataccatttgacccagcaatcccattactgggtatatacccaaaggattataaatcagcctacgataaagacacatgcacatgtatgtttactgcagcactattcacaatagcaaagacttggaaccaacccaaatgtccatcaatgatagactggattaagaaaatgtggcacatatacaccatggaatactatgcagccataaaaaaggatgagttcatgtcctttgtggggacatggataaagctggaaaccatcattctcagcaaactatcacaagatcagaaaacaaaacaccacatgttctcactcataagtgggagttgaacaatgagtacacatggatacagggagaggaacatcacacagtggggcctggggcgcggtgggaggctaggggagggataacattaggagaaatacctcatgtagatgatggattgatgggtgcagcaaaccaccatggcatgtgtatacctatgtaacaaaactgcacgttctgcacatgtaccccagaacttaaagtataatgataaaaaaaaatgcaagtaagaggtaccatttggggaaccatcagttaaaacaagtgatttaactgtttcccatctgtgaaaataggaataataatagtgtcagcttcatatggttgttgagcagattaaatgaattaacacacttaaaaaattagttaaagtgtgtacttaaagatttgcttctgtataatgtgaagtttgttttgtcatgacagtatgtgaaacctctcttttcagtacctggtacatcttagggctccatgaatgtctttttttcttttcccaatttcataaaattgagtaaaagtttatgttttaaaagaaaattgagtaacagtagtgttttaagagaaaataattcatagtattttgtttggagatggagttagggaagaaatataatgtaacagtctgataatcttcattttaacctcttcagccatttatttaagcttctttttaatagatggatattaatctcttaaaactaaataatatattgaatatttagtggagaaacttttattatataacagttgatgtcttttaaaatcttgttttcctagcagcaaaattagaatagatagagaatttgtattgctgatatgcaaaacctaacaaattatatttaacctaataggctttcatattttggattacaactttcacaccatacttaaatacaaatatacagacgtggctgacatattctacatagctgtgtggcttacttgaaaaatagaacagttgcttaactggatgactatcaaaatggtcaacacagattgatgggcttgagtgtagcagacagcgggtatgcagatggtggtgtctgtaccgtttgagaagagatggctgagtctttaaaatgatttcattggaatggctttggtggtgttgcagtaaagggcatctattcaatctcaggtgctgtgcagatggcaaagccaagataatatagaaaaatgagaaacaagtgactatttaatgtacagtaatgcatgatctgcatcacaaataaatgacgttattacatgcaggaaacctatccagatgcctgtacattaaaacacatgactccttgagagaattaagtacaggcaatttgctcggattttctgcaggcctgctgcatattacattagggtagagagaacaagagattaagtgctttatttattgaaagtgtttaggtaaagttggctgttatttaagcataatctgatctccataaatatttaaactatctctttgtagaaaaaaaaagtggggaaggacagctggccttaaaacaaaaggatgtaaggagtatgattatctggtcaacctgtgaaaaatagaacttcttttggcctacattttttaatcttgtaacattttccactaggcaaaagcttaaaaaaatttttaggactagtgtgataaaagtatcttttttttttttttttgctatgtaggaattaataaattcaaatatcaatgacatggaaattttaaagtgggaggagttaatgtgttgagtgctgtacgtaatgggaccattttcactgtaaaatgttaaatttttgtttttcagcttaaagaaagtggttattgtacaggtcatgaaccagattccctggagttcagtactgtaggaggatgggtatctactcgcgcatcaggcatgaagaagaatatctatggcaatatcgaggacctggtaaatatttttctagttattatgtaataattgattagtatatagatattattataaaatgattagaagcctttaaaaattaagagttggggctgggcgcagtggccaatgcctgtaatcccagcactttgggaggccgaggcgggcggatcatgaggtcaggagatcgagaccatcctggctaacaaggtgaaaccccgtctctgctaaaaatacaaaaaaaaattagtcgggtgtggtggcgggctcctgtagtcccagctactcgggaggctgaggcaggagaatggcatgaacctgggaggcagagcttgcagtgagccgaaattgtgccactgcactccagcctgggcgacagagcgagattctgtctcaaaaaaaaaaaaaaaaaaaaagaaaaagagttggatggtagattcccccctcccataaataaactccttttgactataataacattggacatgtatagtagaaagttaatcaaaacacaactgtggtcattatttaaggatgccccttttcaggtgactacattttaagctttgtagatgtttcacagtatccagctcataaaatacggtcagctctctatatccactggtttcgtatccacaaattcaaccaaatgcagctcaaaaatatttggaaaaaaaaataacaataccacaaggaaaataatacaaaaaatatagtagaacaacaatttacatagtatttacattgtattattcataaatattctaaaatgatttaaagcatgtgagaggatgtgcataggttttatataaatactgtgctgttttatgtaagggacttgagtactatggattttggtatcctcgaaggtcctagaaccagttctatggggatactgatggatgtctgtatacaaatattattttacaagcctcgtggaaatgaagtcttcaactctaccgtgattttagtccatttacttagatgatttcgtttttgctattctgtttccttaggagattttgcatttttctgaaaataatttttcctgtatagaattaaataggctgattgaaattgttctaccaagtagtggtaagacctgtcatgttttatgtgcacactgctttttgtagctgatatggtgccactttgctgggagttagtataataatagtatataactctgggcaccctagttagggattaggtatcatttgttgctttttcaatgattagttgtgtgaatttgtacaaattggtttacgtttctaaacttcagtttcctcttctgtaaaatagaataatgatatttgctgcatagaattattgtgaggagtaaaggacataaaatgaaaactcaaaatctctggtgtgtagtaggtgcttcataaatgttgtttccttatcgtcaatattttcatagtagtttaaaagaactttaatttgagactattaaagtgatgttcccaacattattcctggagctatttagctttgcttttgaaatctaaagtttccacattttcatcaatatctttgttattaggaatattaaatctttaataaaatatattggttctttatagttaacactgaggaattaaaaacttttgtctatattgtgaatactttttaaatattttcattatcctatttatttttctttattcaaggcatttagaaaagcacatttttctttttgcaattaaaataacctaaattcagttttggggagaaaatttgatccttttgctattggattattaaggactttatcagagttaagcaaatatttggtaaacagctacatttagcactgtgaaatcatgtagtttattttaatcattttttggagatatttaagggatacaaattataagtgtacatcctagtgtaattatttgcattaataattacttagtgcattttattttattttattttattttgtttgtttttgagacagaatttcgctcttgttgcccaggctggagtgcagtggcacaatctcagctcactgcaacctccgcgtcccgggttcaagcgattctcctgcctcagcctccagagtagctcagattacaggcatgcaccaccatgcccagctaattttgtatttttagtagagatagggtttctccatgttggccaggctggtcttgaactcctgacctgaggtactcctcctgcctcggcctcccaaagtgctggaattacaggcatgagccaccgtgcccagccagcacgttttatttttaacttaaatttttaactctgcaatatatagtatcctctgaagctgtcttaatttatattgtttgcttttatgacaatttttctaaagttgatattcttttaatacatgtggctacaatggaacctgtgaaaaaattaaagaacgtgttaatatatttcgtaacattagtgcatatttaattaaagcacagtaacgatgctcatagcttatttaactgtttgaaaaaagttgaagatagttgtttagtccaaattttttaaaaatttaaaagttttaacatctgaagagtcagaagtctgtgtacaatgggatatacttttcatcttaaattctggttcccacttgttttcaagatcattttaaggaattccaactatagtccatctcaaatacttctcaatttagtgaatgtctcttcactaacggatttcctgagcatatctgattacactttcttgtgctagtgttacagagctgaagctcatcgctattagcggtaatccactgcttctatgaaaggagccttgctacattcttcagttatgaagcactgttagaaggaaaaacattgaactctgtagtgacaaaaccaaactaaaaattctggatcttcacaaaagaaagtaaagtatgatgcagtgagcatttcattttctgaagaaaatgcttcttttaaaattataattggaatagacaattcaagcaattagaaacttattttttatttaaaaatattcattacagaagtataaaaaatgtatgctatagctgggcatggtagttcacacctgtaatcccagcactttgagaggacaaggcttgaggccaggagttggagaccagcctgggcaacagagcaagatgtcatctctacaaaaaattaaaaaattagctgagcatggtagcacatacttgtagttctagctactcaggaggctggagtgggataattgcttgagcccaggagtttgaagttacagtgagctatcatcccaccactgcactccagcctgggtgacaaagcaagatcctattttttttttaagtgtcctgtgtatattaaatacatatcattttgaacattttaacatcttcgtattcatccttctgtcatgggattcttggggtgtcacttttttagccagaaacttctgtctggcggcacctttgcccaagttttgcttggggccactgggcttgttcagcccactcggcctggcaggctgtgcttggctcacgctgctggtctggatcccatgcttgccaacggcgagccaggcacagagtagtgaggggtgtgtgaatgagtgagtgtggagtctggccacagcgcacagtcaggcacgccagctgtggcaggacgggcagctccaggcatcagctccctacaaggctgctgctggaccaggcatactgcaagcagcttccattggtggcaccagggaatgtggtggtgcctggaagcttggagacgccagggactgcagagccccaaagagtgagccatagccctggctcagggagctcctaggtctgggctccttgaagggccacagctcttctctccttctctttcctctctttccctctcgttgccctccatggggcaaacaaggggcgtgtttcagccctgtttgtgttacagccctttcagctccgccatttagcgggtcctgagtttttgtcccacatccaggaagaatgaggtatgcggacaagtggagggtgagcaaggtgaaggagtgctttattgagtgacaaaacagctcagaggagactcatattgggtagctcctttccgcaggtaggccatcctgatgagcatccagctctcagcagagagcccacagagggtagttcctctccacaggcagggcatcctgatgagtgtttagccctcaggagagaggagacacacagtgggtagctcctctccataagcagggcatcctgatgagtgtcagctctcagcagaaaggagatccacagtgggtagctccattctgcagacaggtaatcctggcatctgcctaattctggctgagtcctgggtttttatggggttcagaggggaggaagtttgtgctgattggtccatgggtggttatgggcaatcccggaaaaagcatcataagttcccactccagtccgtggaactggcagcccagcccccaggcgtcaggccctccctggcttgaaggtggggtttcaccggggaccacccatttccgcccaggagcctgtctgcctcctgccactgtttatggtgcccagatgcccaggctgttcgtgctaagggcctcctgcaggccagtgccaagctgccctcagccagcacttatcctcccttctgtgctcattggtgcccaaagtctggagggggctgaggcagcagggtgctggcatgtcagcactgccctgagcatgcgcacacccggctgggttgcaacagcacgcaggctcggcctcaacttttctccaagattggagcaggcactggaatggggagaagccaggcggtggaagcagacacttccgagcctgcaggggctgggggcttcccaggcccccaagagtgtagagatgcctgggtctgcagccacagctgggtggctgcagctgtgtccaggagggtaggattcctgcgtgcttccggcccccaagagcacagggatgcctgggtccagagccacagctgggctgccacagctgcactcaggaatgcgtggcttttgctctgccaactaggaagggggtggggcttccacctgtttccagctcccgttggctccatgcagtgcacagccctggtcatgccacccccactgcagccaatgtctttgcagcagccactccagatgggctgctggtgccatcacttctagaactgtttctaggcatgcaataagcacatgaatgtatctagtttttaatataaaaaagaggaccatatgtgtttcatctgctctttaaattatgtcatcaatatattaacatgtaaatgaacaggtttgcaccattgtttttaaagagttatataattcttttattgagaatgcatggtttatttaactccctcttaatgaacatttaaattattcttgatttcagaattacagaaaataaaggaaaaatattctttttaaaatttctttggtatatacatctttaatcattttctttgggtaagctcctttagttgatttgttggatcaagaagtttatacattttagactttggatccttacagccaaattgccctataaaaattttgtaccaattgacattctcactaacaccatgagaatctttgtattttactggacgtcttatttatgtttttgtattttgttaattgctagtgaatgtaaacttttaaggggtcctcattggcaatttttattttgtattttgtgtattgcttattgatgttctctgctcatttccttcaataataaatagactgttgttatttatcggtccaaaattcattctaaaaatattttggatttttacctaaccacttctgattcagatctcaggaactatttttagagtgatcctacttccccagtatacttactttctcatttgtatgatgagtcacacatctctttccttctcttaagttcagtcattgtttctactgcttcatcccaatttgacctgatcataattaatatttaattcttttcactgttttctactaagtgggattgaaggtggggataaagggagaataatttttttcttagaattctaagtgtctagagcagtgcctgacatgaataatatgcttcataaaggttatgattattgcttagtttttgagtccgttagttctgtgccatatggataaccctaaatttggtttaaataaatgtgttattctgttgttcttaagataataaataaaccactttaaatcaagagatgtacaatcttagaatggtttttccctcttttaaggttatatacaaatttaactttagtctaaaaattactaaaagatactagaattcttaaaagcatcacaatttattacttaacccaatactttaaaagtaggttttacataaatatatataaatgtctgtacatagacacacattcactaacagatgtctagaatttacatcgtgtattgtattaaacaggtggttcatataaaaatggtaacacctagaggtataatagaaaaaagctgtcaaggacctcgtatgtcaacaggccctgatatccatcacttcatcatgggatctgaaggtaaatataactgtaaatttattaagaaaaaatacaggttagtcatgcagttttgtgaaaatctttatattgtgacatcagatctttgaaagacatgttttatatgtttaaggaattttttaaatttttatcattttaagactataaagttttattatgagaacatctgattaaacttcctcttacattttgcttttttatgtttctagagacagcttgatcttttaatttttattttagaatttttaatgaatttcaggaaaagtggtcattaggatttaaaatggtttattttgacattttgtattatagtattcttaaatcttgtcagaattatcggaggaaaggattgataaagcattatcttattgtcttgtctttctgtaattatgtattttataaaattaattactattagaagtggaatttaaaattctggttcacatatattttaaacttttgttggtcttttaatttttcactacacaaatagtatcattttcttggttacttaatgctgggtggatttgaatgtagttcatctcgtctaaaacatttaagtcctgtgcagatctggaaagaagtaaccttaaaataattattatgtaggcatggtgaattgtatggataaagtaaacatgggcttatttttcaatttttaggatgggagagggacattccttaaattcagagaaataaattaaaataaacaagtgtttctacattaacagaggagctcattattcacttcagaaggtggtccaagctgcagaagatatattttggtaacatttagctatattcatgaataaaagagcaggtacaataaactaagatgttaggcataaattctattctttgacagtaacatcaaagagggaaagtataataaactatgtttcttagtgatgtggtagagatcagttgtttggctgatgaccagtagtattgcttagatgtttttcatggtaaccaatgacagacctttgtcaagatatctcaccagtttactcagtttattccttttctgatcagcatactcttctatgaaaaaacaaaactatatttgtaataagaaaaataatcttaaattcatttaaaataatatggttacttaatattattctgggacttcttatactaatgcatcatctacaaattagaggaatgtaactttttgccatcagaagtcaagttgaataacgaaaatagctattaaaactcataatttttcattacattattgatatttacataattggagtcaactctataaatataaataatttttttttcaaatagccacattatacttttttttctcccatcagttagccttttaaaaattctagttgctagatattatgctgggacatttgagacagataataacagacaattatacaacagcgtgacaaattacatgatcaagtaaaatgcagaagaaatatgaacaagatgaagttgataggtgcttacaaaggcttccccagggaggccatacctaaagtggtctttgaggttgataagaagaaaataattccaggtcaagttgagggaagacagaagaggggagttgccctgcagagtgaccatcatgttggtgggcttagaaatgagaaagggccatgtctgcctcattatgaggctgctggtttttcagtatgactggaatgtaaggtttaattgtggagtagaacaggcagcaggtctaggagcagaatggtaagggctacagggtagttcgagagataatttggtcttttcatgccttttaaaatgatttgaacttttatctaaaagactgggctacctccgtaggtagtcactaactgtatgaatttaaggaagggacaaagttattatagtaaagtaagcaaagaactataagagattgggctgggcgtggtggctcacacctgtaatcccagcactttgcaaggctgaggcgggtggatcacttgaggtcaggcattcaagaccagcctgaccaacatgttgaaaccccatctctactaaaaatacaaaaattagtcgggtgtggtggtgcatgcctgtaatcccagctacttgagaggctgaagcacaagaatcgcttgaacccgggaggcagagattacagactgcagtgagcctagattatgccactacactccagcctgggtgatggagtgagactttgtctcaaaaaaaaaaaaaaaagaaaaaaaaaagaaatatttaaaatttatgagactaaattaccatagttaaatgagattttattacaaagtacatgcaacatagcatactgataaaagagcatgaaccatgaagtctttatcagatctggatttccatcctgattctactacttatatttccatgactttgtataagttagataattttcagtgcccggtgtcctcagccataaaatgggaataataaaattattcatcttcataagtgtgttataaggattaagtgagattatgctgaacaatttagtgtagtaaatactgttgtagctgcttattattttgatatcagtgatctttacaatttatggtccctaatccccatttcagtttgtgaatatagagttattttaatataggccaggagacagcatgattgaaatagtaaatttatatgaaatcatattcttacgtaaaatgtattttatctgctactttgacctacctgtgtaataacttcctgccttaaatgtgaatcataaacttttcttgagctttaaaaaaatttctttcagttaaatcatttgatgacaaccttgaaagtattactatccaaaaacctattttctccatccgactaagctctatacgtgattaaccatattaagtttaatgtgtttgtcttgttttgtgttatgaatttttcatgatttttttcaacaagtagctttctcctattttagatgctataacatgatcagtataatgaaaaatgtaataaatattcaagcatttgaaatgctttccattctgtttctatatatggtatttactatatatggatttgctcttttatttgaaaaacaaagtacatttttgttttttaacccatgactcacccttcttttagtctttgtctacaattaaagagatggaatactcaatgtcagttcttttgtaaagtttcactagttattctttgcttaaatgaagatcatcctttggtagtttcctcaggaaaggcacatttatatatccccagagttctggaatgttccaaactggttttctgtggctgtgatacttgaaggacagcttgagtgaatataccttttggtcattaatttctttaagtttctttaaaatgctatttccactgttactttgttttatatattattttaaagaaatatgatacctgtttaattttcttagtaggctaattttctctttttgcctggaggccttgaggattttttttctttattgctaaagtctaatacttttgcaacttagagttgatagtcctgggttattttgcttcagcacccagtggaccctttctatttgtagattcaggtctccttttatttctgtaaagtttttttttggatagtagtgttaaatattagggttttttttttcattgtttcagttttcatcctcggggacattgattatacgtatgtttgactttctttgctagttttccatttcagtcactttttctctgaccctttttctctgacttcttaattttcattctcttgattatttttctggttttttttttcaatgccctgtattaagttttaatttaaatctattttgtattctcctttgggtagtttataacatagcctttactttttacgtgactttttttggttctgtttctttcctcaggttagtcagctcttgtttcatttcttgttgttggtttttgtttgtttgtatttctgattcaaggtattttttcatatccctgttgcttgattgatgatatttaattcatgttgtgttacagctttcttcaggatcgtggctggttttagggtggagacttttcaccaatagtaatgtttttattggcgttttctgacttttgtagttgttttgtttacagatctgatatgcctttttctagtcctatttgttacttggaaagggctcctattttgagagtgttctttcctgacacttctaccctctgctatgctatttgtttataaatggtggtgtttttagtgaaggaagaattggcatgtcttgtttctctttcatttctatagggtctttaatttctctttattattttattctttctctttactggcttgtctgcaaggagtccacatacttttacgtgtgtacacgtgtacacatcttgcttctccaaggcagccatttctggttccttccattttcaaacttcttcccatagccagggctatggactaccaagtcctgtataatattttggcattattattgcacttttgttttctgggagtaattttggctgtacttcctctagttcctctgttactctctactttttgtgtgtagtcttttaataagactccttttatttacttttcatacttataagcttatagcagctggaaggctacaggaaatctgttggaattttttctttttatctctacttagaggtaatttgaaagttgcagtgttttttgtttccttgtatgctgaagatctaggtcctgtgtggctttgttttccttgttgattatattttggggagttgaagaaaatagagggagagaaaagattcataatcaaatgcctgctgtgcttaatccttaagtcctgagaatatattttcaaattatgagagtcacttcaagcaaatacttgcattttatatcaaacagcatttgaagccttcagttttctttgagaacaaacatatttgaaaattataaaacagaaaattctgaagtttattgacactatttttttttaagcagaatggaaagtgaatgacatacaagcctctctgatgtcacattgccatggagttatttggaaacaattatacaaagtgaatataaagtactggcataacatacatataattaagtaataaataatttaagtagttttatatcactctgttgacataatattcccagaaaaaaagaatcaataaatacattaaaactctacataaatgggccttttgatgcagtgaatttggaatatccatttgtgattagctgagtttgaacttaagtcagaatggaagctgcccctgtcaaactgcatttgggacctggatggatttttatcttacactgggaccatgcagaattcctagctggcttgttgcacagactcaccttggtcatttcattaaccttgcagtaatgcaatgcctcgttttatactactaatttttaaaagtctcatttataaatttatggtgagtttcactactttagattgcctgcagtatatatatgaagcaatatacagaaatttaagtcatgatgccttcttactagtaccttagaattttgatgtagaatgagaattttaaagaaagtttgttaatgtaacagtatatacatttaagaataaactttttgaataagtaataacttgtacatttataaaatttggatatgtagaaacatgggaaattcaaaagttactcaagaatgttatagggaaaaatttgcctcctatccctgtcttacaggcatcttccctgtccaaaggcaacactattgctacatataactgatgcaggatttttgttccttagctcagctaaaatcttgttgtatgactaggaaaaaattagccatgcagacacgttgaaaggtgaggagggcggaagttattaaaagaaagctctcagcaaaaaaaggggttctgccaacaggctcccacctcacagattgaataccaggccaccacatgcacaagctgaagagcccaggcttcttccccctgcacaagacacacattcctggtgactgtaccccactcttccagtgcacaggcgggcccccagtctgctgtgggcatgcccagacaaggccttggttaggttccctcatctgcacaaaagcatctgatgtaaacacttgtggagcgggttagagattctctgggaccctcccttatctgcctcctgtatctaccataaccatctatgtatatattttttaaaaaacaaatgggagcttactattctttgctcatcacatttagagccagttcattctttctgacagctgcatgatattccattcattgaatataccctgatgtatttaaccaaacccctgttggttggcatttaagtggtgtccaattttgtctttggcttatatttagattacaatgctgtgattcaaataaatattctcaaatgtcttcatttcttagaacttaggaaatatttcaccaaaagcttagaacttggagtttggttctgaatagaaatgttttcctggttaaagtcagggtttatactcaccttctttaatgaatttcaatcttgtgagttttgagtttgatcaagtggttattaaagttttccatagtctatggacagataagagcaaatagaagagatgattcatgccttaggaatttctgcctgacaaatttccaatttatttgtaacaacaactaactgtgaacatgagatgttaattccaagataccaggaatttctaaaagtgttgaaaagagtggaaagaatgacagataatcttagtgatattgtcagtatagtggaaggaaattcgcaaattaaagtgatactacttgtcttggtgagaaagagtaggtgtggtagataattctgtgttagggggtaagacagcatagtactaataggtaacctgtcaaccctttgcctcttctgacaaagttttggaaattcacctcagaaagaaactgtatcttttagctatcaccattcctccttccagctccccagcaatcctgccccaagccctaagcaactactgatcttcttttgatctctatagatttgcctgttctggaaattacacagacttggaattatataatatgtaatcttatgactggcttctttcacttaccacattttaaagattcaacagttgtgtgtatcagtacctcattcctttttttataactgaataatattccaccgcatgcatattctacattttgttactccattcattactgagattgtttccacattttggctgttatgaattgtgctgcattaaacatttatgtacaaacttttgtgtgacatatttttattttggggggtttatagcctaggagtggagttgctggccatataagtcataaccctatgtttcaccatttgaagaatagccagactgttttctagcatggctgcaccattttacattcccacaagcagtaaatgacggtcccattttctctaagttatgtaatttattgctatacagttgttcatagtgttcctttataatcctttttatttttgtaagattactagtaatatcccctattttatttccacttctagtgatttgtgtcctgtctctttttttctcggtcactttagctaaagatttgttaattttattgatctttttggagaactaccttttggtttcattgattattttttattggttttctatccttgatctcatcaatttcacctctaatctctaataattccttctgtctgcttgtattagatgtagtttgctcttctttttctagtagcttaaggtagaaggttaggctatttgagatttaaaaaaatatgtacagatatttaccatcacaatttctctctaggtattgctttactttatctgataagttttggtatattgtgtcttcctttccattcttctcaaactgttttccaatttccctgttgatttcttctttgactcgattatttagtagtgtattgtttaattttcacatattagttagctttccaatttctttcttatcagtttcttatttcattccattgtggcttgagaacatactttgtattatttcagtctttgaaaatttgttcaagtttattttatgacctcgctagcatgtagtctgtcctggagaatgttctgtgagcacttgaaataaatgtacattcttctgttgttgggtggagtgttctattctgttaggtctaattggtttatagtgtacaagtcctattgccttcttggtcttgtgcctagttgttgtgtccattatagaaagtaaggcattgaagtctccaactgttattgttgaattatctatttctcccttcatttctgtcagtttttgcttcatatatttttgtgccttgttattaggtgcattctgtttatatttgttgttttgtcttcctgatggcttatcattataaaatgttcttctttatagctagtaatattttgtttcagtctgtttcgtatgatattagtatatagtcactctagctttcttgtgtttgctgtttgcattatatatattttttctttcgatctagtcgtatctctgaatttaaagtgtagattctgtagatggcaaatagttggatctttttaaaaaaatcgtctcactatctttgtcttttcttttggttgtttagtccattcacatttaatgttattattggtatggtcggatttatgtctgccttattttccccccctctgtgggtctcatgtctttttgtttctgtagtttgtgattattgctttcttttgccttaagtgagtattttctaatgtagcattttaattgccttagtgatttttttcagtatacttttttgagttacctccttagtaacctctataaatgttacaaaccaacaatacattgctaacattaccactatatataattggctttcaaagaaactgaaagaagaaaggagagcaagtacaggttgagcatccaaacatgaagatccaaaatccaaaatgctccaaaatttgagacttcttgatcactgacttgacactcaaaggaaatgctcagtggagcattttggagtttggatttttggatttgggatgctcaactggtaagtataatgcatatattccaagatttaaaaaaatcccaaattgaaaacacgtctggtcctaagcatttcagataagggatattcaacatttctagacatagaactttttttatattacccattttgtttatcttttctgcttctcttcatttgttcctgtgggtttacattaccatctgtaatcgtatccttagcccaatagagctttactttcactcacttcttttgtgctagtattggcacatatatcacatttgtatatgttatagatccaaaaatacatcatatatgtattgttttataccaatgctttttaaatcagatgtgagaagaaaggagaagaaatatgcattaatactatctttggtattacataaaatagaagaagactcaaaagtgctcttttttgtatatattaatttgaattactgtttggggtcacctttggtatttattttaagcctggttttccagcagtgaagtcctctcagcttttatctgggaatgtctttattttgttttcattttcgaaagataactgctggatgtaggattgctggttgacacatttttccccctttcagcattttgaatatgttatctcaccactgtctgactttcattgtttctgctgataagtcagctgttaactttatgagttttctcttgtgattgatgagtcatttttctcttgctgttttcaagatttttctcttgcctttgacttttagcattcctactacgatgtgtctgtttgtggatatctttgtgttgctcctgtttgaaatttgttgagctcccttgatgtataggttattggtttttaataaatttaggaagttttcagccattctttctttgaataattttttctgctcctttctctgtttttcttccagtactcccattacacgtaaattggtgtgcttaatggtttcctgcatttctctgaggcaccatccattgttttctctgttcttcatgttgcataatctctatacatctatcttcaagtttcatattcattcttttgccagagaccatctgttgttaagcccttgtagtgaattgttcatttcaattattttgcttttcaactccagaatttctatttgattcttcttaatagtttatcttcatttataatctttaatgatgtgacattgtcatcagaataatccagaataatccaatcaaattcagacactttagaagggatagttctggagattagtgtttgggatttttagggggagcgcaagaggggtcctccccattgtctcccaggcaaactagatggcctacattttaggctatatctctagtgaatctacctgtgtcttcccaattacctttttaccacatcattcactgtttttgagaatgtccttggacttggacttcaccatgctctgttgcaaataaagtcatttccattggaaagagattaggagctatctgtcttatggcctgtttctctccccagagagaatctctgaaccacggctcaggagttaggggtggggacaatggcatgtttctatctaagtaacacctctgctttaggagctgaatgctgggagaaggtggggaaggaaattaggttatctaggtttgcttctcctggcaagaaaccagccctttatgagccaggacaaggggattgaaaccccagttttagtgtgctacactcaaggtagagcttttgtcccacagttggggcccggagctacaggggagcactacctcccagctgcactcacctggaacttagccttgggaaaaggtagctgggatcaggatattatatggaataggatcaaaattttttctgaaattaagaaagtctttagatatatattcaagagaaaggaaaacatgtgtccagaaaaaaattgtacatgtatgttaattgcagcattattaatagtagccaaaaagtagaatcccatatgttcatcaactgatgagcagataaacgaagtgagttatactatacaatggaataatatttgggaattaaaaagtaatgaaatattaatacatgctatagcatggatgaaccttgaaaacattttggtaagtgaaataagccagtcagaaggccagatattatgagattccttttacatgaaatgtccagaataggcaagtctgtatagacagaaaatagatttgtggttgcctatggctagggtgtgggagtagaaatggagagggtttgtttagtggatatggtttcttttttgggatgatgaaaatgttctaaacttagattgtaatgacagttgcacatgtctgtgaatataacgcaaaacattgtattttggggccgggtgcagtggctcatgcctataatcccagcactttgggaggccaaggcgggtagatcacctgaggtcgggagttcgagaccagcctgaccaacatggagaaaccccgtctctactaaaaatacaaaattagccaggcatggtggcgcatgtctgtaatccagctactcaggaggctgaggcaggagaatttacttgaacccaggaggcacaggttgtggtgagccgagatcatgtcattgcactccagcctgggcaacaagagcgaaactccatctcaaaaatttaaaaaaaataccatttgacccagcaatcccattactgggtatatacccaaaggattataaatcgtgctgctataaagacacatgcacacgtatgtttagtgcagcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctagaaaccatcattctcagcaaactatggcaaggacaaaaaagccaaacaccacatgttctcactcataggtgggagttgaacaatgagaacacttggacacaggaaggggaacatcatacaccggggcctgttgtggtggggggaagtggggagggatagcattaggagatatacctaatgtaaatgatgagttaatgggtgcagcacaccaacatggcacacgtatacatatataacaaacctgcacgttgtgcacatgtaccctagaacttaaagtataataaaagtatatatatataaatttaaaaatttaaaaataaataaaaaataaattgtattttacactttaaatgggtgaattttgtagtctaaattatgtctcagtaaagatgctaaaacaaaagagaacgtttagtcacttttgttatcttttaaattttgtaagacatatctattttgtattaaaatatttatcaagccaaacttgcagagcttttatgatcatacaagtcataagttattttataacctcagtaggaaatcatgtgtatatgtggtgaatatattgtgatctaatgtaatttgcttttcatagacttgtcatagtttttaatcctgtgttatatattgacaagttgttttaattatattgtaaacttactggaagctttggtttttgcgaaacttttaaatttcttgcgttatgaagatgtgcagtttcaaggatttctccccgtctttactcttttttaaaaatgatgctcagaaaatttactaataaagttattaatttctaatatttgtacatcagaaaccattcatttgaaaagcttggctttgtgaatataatagtttaacttattttttcctctctaattagtccctcttataataaagaaaagagcatttctttttttaatctttttttactttttgttttgttttgtttttttgttttttaatttgtgtgtgtgtttttattttttctttttaaagagcatttcttttattggtggtcatcttatgttagatatttataatgactactttgtctccatctggtattttttgtttcttaaaagggcatctcagtaatgcctttatcttttctctctattaattcttaggaaaaaaagcaagataatatttcctcagatttcttctatcatcttagattctcattgaaggttagggtttttttgcccaataaattgtttttaagactaaaaataagcacaaatatcaaaatacgcttttgtctgaatacatatgagacataagaatccattgtttttcaatttttttattttaataagttgtaatactttaaaagccatttaaaagtaaccttcttggagaaagtttactttaaaatgttgaaaaatatttgtacatgactaattaaagcgtattcctaaagcttttttgagaaattgtaaaatttgcttaattttataattttttctagaatgacttgagtagccattattccccaggtagacttgataaatttaaatgtgcataataaattgaattaatagattaaatagatttaaatatgatttagaaaattgtcatgtgatgtactggattattcccccttctttttttcaggaactcttggtgtaataacagaagctacaataaaaatcagaccagtccctgaataccaaaagtatggctcagtagctttccctaattttgaacaaggagtagcctgtttaagagaaattgcaaaacaggtaaaagaaaaaatatatatatatacatacatacatatatgtttatgtatttatatttttcaaattctactacatagttgattgtgatatgttacaactaatcttcatttttagttgtattatatttgtggtttttacccagttctatatgaaaaggtagtgttgtacagtcatcctttaagtgcagttactatttctttgagtaagtatattgctatcaaacctatttcttggtctagatggctatatgattgtaagccaaggtaagatagtactttgattggtagcttcagatgactttgccttttattgactgttatgtgtcttaagttatttttgggtaagatattttatgattaattgaagtgatatttaatttaaattgagacatttattgaaattaaaagtaatggctaaatatcaaagaccccaaaatttaaatataggtaattcaacttcatcaattcatagaatgtgctgctactaggctatactttgtttcataatattatctaagctatagcttaaattaaggaatatactatgtgtaataagctaaaaagaatttttattttctcccctccttaaaaaatatattattaagattttttttaagacaagataatgctaagtaattttatttatgtatttagttctgtcagtatggaaatttctacgtctctctcggcatttggtttattgtttaaactacaactgtctatgaataattcttaattcaacttttcccagcagggaggaagtcaagggaatgtactctagcctctctttttttttctttcttcaaactcctgaaattttaatacttctattagctatacccaagtagaatcttgaggacaagggagtttttgatgtgacccatataggtcagcttcctgatatccagagcagtgtggaggaagaatctgttgaggcaaaggaatcatatcgagcaagtagtctatgtttatcttggaatttgtaaggtacagaaatgtaaaatgatgaagagtctctcattttcccatcatctcaagacaaccactattaatgctttaaagaactttaaaatgagaaaaaatatatacattatttactcacatatatatatcattcccagtgctgtttattccatacactcataaagttttactttctaagacactctttctgtctggcagcttcccactttcatgaagtacagctatatgaccacctaattcaccagctgatgtggtaatttttgtaattttcaagtagctgcacttacttgtcagttagattgctagacttagtataggtcctttgatcttgattgctagactactcctgggtagggagaggattcaaaaggaagtagggtcctggaataagcattcttggacttgtggcaagttactttggtagtggtaaggcagaagtgattagtaacagttgaaatccttacattagaggccctaattcactagaactttgggaatacgatattatggttagggagctagagtatatagtattaacaccatgttagctaaaatgacgaggtggcaataatatttaaaacattaaaggattattaagtagaggaggattggagataagtttttggagtaaatagtatttgttatactaaagtaacatctgagcactgagtggtgacattccagtgtgttctggtacttgtttctaaaatattccatcattcaaaggcagaggaaaggagtttcaaattaagataccccagatattaagaagtaaaagaacttgcagagccttatggttttgcctatgaattaatacataaaagaacaggaagctagggtgttttttttttttttaaatgaccagaagttcactaattgaaaaataaaacacagatgtttccatatatattttcattaatttcagactgttcttaatgaggagcttttgaaatttcaagtgttttcattttgtattatgatttatccttgtgtaatgattttggattacagtcattgggtgaacatcctaagaattttttaaaatgaataaaaggacaagttttactgatttgtgtaaggatgaaggaaaattccatcccctgcttgtcttaaatagttttattttccctctgtctttgatgagcttcactattccccccacaaaaagtgtggttttttgtttgtttttttaagatggaatcctactctgtctcccaggctggagtgcaatggcgcgatctcgatgcgctgcaacctctgactcccggattcaagcaattctcttgcctcagcctcccgagtagctgggattataggcgaccaccaccaagcccagcagatttttttgtatttttagtgaagatgggattttgccgtgttggccaggctcgtctcgaactcctgacctcaggtgatccgcccgccccggcctcccaaattgctgggattacagtcgtgagccaccatgcccagccacaaaaagtgttattaaagaattgtagttcatgtcatttcttgttcaagtcttgaatgacataattctaattcaccattattgcctctaattttatgaaaaaaaatatgaatgccaaattagatttttcctttctgagacagggtctcactttctcatccaggctggagtgcagtggcacaatcacagctcaacgcagcctctcaatctcctggatgcaggtgatcctaccacctcagcttcctgaatagctgggaccataggcacacaccactatacctggctaatttttttttaaacttttgtagagatgggatctccctgtgttccccaggctggtcttgaactcctggactcaagcgatcctccagtttaggcctcccaaagtgtagagattgctggcatgagccaccatgcccggccccaaattagattttttaaaaaattacagaagttataaaagtagtttggatttgtatttattttcaacaaaagatctcagagaggtcgtgttcagtctgtattgaccaactctgccccttcaataatatctcccctctatagaacacagatttagtacactcataaagcttttgattagatgtgtgcatattttgttttcttgatgctccatctacttttccacactgcaaatacttacatgtaaatctatcttaaatttcattaataagaagtgatgtacaaatgtatcaaaatactaagtttataatttcattacaatggaaatgttgatttccaacatttccgccataaatagttggtgtaatctgatacagtttttattacaattcgatatgcccctgatagaaagtgacacagaagacctacttgtgctattgaaaagcaagtatggaattttccttcatccttgcagaaatcagtgaaacttgtccttttactcatttaaaaaaattcttaggatgttcacccaatgactataatctaaattcactacacaaaactatagtgagccaggtgcggtggctcacatctgtaatcccagcactttaagaagctgaggcaggcagatcacttgagcccaggagtttgagaccagtctgggcaacatggcgaaaccctgtctctataaaaaatacaaaaattagctgggtatggaggcatgtgcctgtaatcctagctactctggaggctgaggtgagaggatccattgagcccaggaggtcgaggctgctgtgagtcgtgatcgtgccactgtacttcagcctgggcaacagagcaagaccctatctcaaaaaacaaacaaaaaaaactgtattagctatatatcttggaacaaaataaagataatgattgatagacagtgctaccatgtggttaaaaaagcaggtcgtaaagaaaggtcctttctagtctatagctatgacagttcagttctatgtacttaataattgacagtttttagaaatacaaatattatggactagaaagtttgtcttacttgaaactgattttaaaagtccagatagataatattctattctcgagcattgctcttaataatggagcaattgctaagagtagttactgggatttggatatctaacagttttggaaacctacatattttacttctattataatgcacatgtagagaggcattaatgtttatcttacctggaaatggataaaaggttttataatggtttagggaaagttgtatattagtttgtagaacatacaagtctcatatgtcaagagtggtacagtatttgctgccttcctttgtaatagtgttttcaggcagaaaaattgaaaaaatcaggttttggaactagtcattgttcaatttgggatttggaatttcagttgatagcaggggaattaagatccattaaagtagatggtacatggcttatgattgtgccaaattcttgattgaataatgaattggttgcttgtaattcttcactgtcattttatagcacttccatctttgcaatattttcagattcaagttgcttttgaaatgggaaactgtaattttggataaatatcttttgggaaagaacatacatgactgttcacaaatagcaaagtgggctatatgtatatatatatatttttttttttttttttttttttttttttttttggagacggagtctcgctctgtcgcccaggcgggactgcggactgcagtggcgcaatctcggctcactgcaagctccgcttcctgggttcacgccattctcctgcctcagcctcccgagtagctgggactacaggcgctcgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggccctatatgtatatttttattactattcttactgaaggaaataaattaagcaaccttatactagcattagaaggattctactaaagtctctcatccgatctttgtccatgtgaggaagtatcctctttcaatacttcactgccttgtgagaaactagaaaggaggatttagtggaagattaatgtgattctttctcataagtggcagtccagtataatctcctcctttattcagtagatgggtaaatgatttttaagacgttctcagaaaatacatttcctgctgtagcctatgaagaggaggaaaataatgttttttaatcagcatatcagtgttagatataacgtgttattattctctaaaagagataaataaaattgttagtttggaaataacgatgtctttacaaggttaaaaggaaaaccgagtgttaaaacaagctcagaagcagtttctgaagcttgggttttttttgtttgttttcaataaaaacttaggagtagtgccctatggtattttgagaggagcatttattccaacaagaggaaaaactgtatttggtattgattagtactcattcctctcaaaactcttctcagtaaaacctagtttcttcgaactaggtttttagaattatagatgaaaatgcagcttttcttcccactaccttttgacggagggtaatttttccttccttctatcacttttattttaaacaattttaaactgatgaaggtttggggttttttgtttgtttgttttaatgattttagattataatttgggaagacataaattttatgaattgttctgttttaaacttaatttatcttggaggagttcaaataaattagaaggagtcaggtttagcacttaccttataaaacacttaaaacttctttttattcaacagtaattcttgggagtatttattacatagagaaactgaaattattttaaatcattttttttgtgtcatgcgtttttttctctgaagcagagagaataaccctagtcaagtgtttggttaattggatcatttactgtttgatccagcaaaattaagacagttatgagacatgttctctaccagaagccactcagaacaagttattatacctttactaaactgaaaaactataaagttataattaggagactggcattatcttttggtcttttccttaatataagtggagggcaatattcactccctattatgtattattttgttctttaaaaccaagcaacaattgacttgtcaaaataaaaagttcttattgtttatcatacagactcctagctgtaagtcagtatgtcatctctaagatgaccaaccagtaataactgtagccttaaatagtctatcatttcatctgtgataccaactctgacttattagttagaagaagaatttgtctacattttaagtttttatgtccagaaattcacatttaacagattatctttttttacatagccttttttgaacttttttttttttttgagacggattctctctctgtcacccaggctggagtgcagtggtgccatctcagctcactgcaagctccacctcccaggttcatgccattctcctgcctcaggctcctgagtagctgggactacaggcgcccgccaccacgccctgctaattttgtttttgtatttttagtagagacagggtttcaccgtgttagccaggattgtctcgatttcctgaccttgtgatccacctgcctcagcctcccaaagtgctgggatttgaacttttaaattaatcaattttgttgtgtgccttatttgaggtagtgtgctcttagcttgataaccaacataatgcaatggatagtatgcagttatatgtggttcctcacttctagtgaggatgttgcatattatgataattttttgtgcccaaatttttgtatagcacatggagtttagtattgaagcatttgcttctgatacaacatgagattgatagtctatttccaaggtagtctctaggctcaagaatttgggctgttccagagtctacataggatgtggatttaccctttgaggaaacaaatgttttcaatcaagtataattcattccttagccatggaccagagttacatggctgccattcaatgcttatacttttatagtttatccttatgacattacgttagcagaaacccctcagacatgtgaaatatatgttaatgttgaatttattttgctggtaactagtcttttaagaggtgccttctcaaatatgtctcatctgaattgcaagttctgattttttctgtgacaagtaagagctatgacttagttttagaaaaaccagttttgcagaatattttgatgtttcttttttttttttttttgaaacggagtctcgctctattgcccaggctggagtgcagtggtgcgatctcggctcactgcaagctccgcctcccgggttcatgccattcttctgcctcagcctccccagtagctgggactacaggcgcctgccaccacaccagactaattttttgtatttttagtcgagacaggatttcactgtgttagccaggatggtctcgatctcctgacctcgtgatccgcctgcctcggcctcccaaagtgctgggattacaggcgtgagccaccgcgcctggccaaggaaatatttttaaataaaatgataggattgagaaatatgttgctttttaagttagtgtagagagtactaagtaaataagactaatcagaatagtttttactattcagattatgcaatcaagtaaattcctggttgtagcatccctaaagggaagaaattgccagcaatttgactaagtcagtcttgtatccatgttgtgaagtcatcgtggttatttatttcattattaaagtacaaaaagtatactgatatttctgtattagtccatatcaggtttcatatagtttcagactattaagtataaaatatagttaggtacaagttcgatgatttgagagattctagtaagggtacatttatcgtagcaggaaagaaatcaattatttcattagctcagttttagtaagcaatttctgtctgagtattcttgaattccctgaatttatcattaacccatcattaaaatttgtaaaaatattccctctcaggttagttttgatcgcttaccagcaggggtcactttaactcaaggacctttttccctcctttacaaaatctgtggaatactctcagccctgcattagtaaataacatgggagtgaatttagagctcaaattctcagaacttgtgctgtctctgacttttgaaggcaatcttttgtggtttttttaaacctaccaaattagttttaaagcagtggaaacataacctaatcttaactgtacatatagtaactcaaattgatgttgttttttaagaatagtaacattattttgatctcttgattatagaaccttccatttaattaactgtagtggtaacttttaattatttgaattataagaaatgttttcagctttatatatttagaatgatgtgcagtgatttacaaatatcaattaccaggagatcataaaccaacctagatgctatttttgagtgctttacttatataagcatttagttatgacaataactgaaaaactctactgactttttaaaaatctggtactattgaagtatgagactttaaaaccgttggtttgaattagataatttcaaaaaagtccatgttaaaataatttaatatctaaaattaaaaaaattctttagcttattagttctgttttgatagtgtttgtctgttaccatctactattcctccttgatactaataggaatactggatagctagcttatgtgacttgattatcaagttaaaaatcacactcaatataattgaatattagttgctatatgatacagcagttgcccaggagctttcttgccttttttccagctttttaatttgaaaattttaagcatacagaaaatttgaaagactggtacagtgatcacctgtctatccacttcatatattcaacaataattaagtttttgctctgtttaacatgtacgtgtatatgttttttggaccatttgaaattaagttgcagactttttttttttttttttttttttttttaaagacagagttttgcttttgttgcccaggctggagtgcagtggtgcaatctcggctcactgcaacctccgcctcctaggttcaagtgattctcctgcctcagcctcccaagtagctgggattacaggcatgcaccaccacggctgggtaatactgtatttttagtagagatggggtttcaccatgttggtcaggctggtctcgaactcctgacctctggtgatccacctcctcagcctcccaaaatgctgagattataggtgtgagccgccatacccagcctaggttgcagactttacagcacttaacctaaatacatcagcaccgtctcctaaagacggaatagtgttcttctttataactacaataccattttcatgtctaagaaaatcagtagtaattttttttttttgagacagagtctcgctctgtcgcccagcaggctggagtgcagtggttcactgcaacctcttcctcctgggttcaagcaattcccctgtctcagcctcctgagtagctgggactacaggtgtgtgccaccatgtctgactaatttctttttttttttttttttttgtatttttagtagagatggggtttcaccatgttggccaggctggtcttgaactcctgacctcgggcagtctgcctcccttggcttcccaaagtgctgggattacaggtgtgagccactgcgcctggccaatcaacagtaatttgttaatgccatctaatattcattatataagattattccagttatctccaagatatgttttatgaatagtgtttgcaaaccaagatttaatcaagacctgcatattttaattgttttaaagattaaatacccatagaaatttactacactaaatgtaatatactttccttcccccccccccccttttttttcattttgttttgttttgtttttgagacaaggtcttgcactgttgcccaggctggagtgcagtggcacaatcttcgctcactgcaaactctgcttcccaggttcaagtgattctcatgcctcagcctcccaagtagctgggattataggtgtataccaccacgcccagttaatttttgtgtttttagtagagacaagcttttgccatgttggtcaggctggtcttgagctcctgtcctaaagtgatttgcccacctcagcctcacaaagtgctaggattgcaagtgtgagccactgcacccatcccctcccattttctgatatatgtgtacttacgtgaattgttttcattaataatacttgccattgataaaggtgcggtagaatgtggttgttagcaggagatggaatttacaagttgctggtaggaacttaaaatgtttttgttatgaatgacagagtggctgttactgtctcatattttacttatgtgcttaagctagaatatataaatatatatgttatatgtatattctacttatgaagaaaagaaatttggtctaatcaggctttgtatattttattagaagtcaatgtgcccactttatgaaaaacatttcagatttgtaaacgtgaagaaaactgattttcctttagtatttttggaaactggtaacgtttttagaagtatcaacccaactacaaagatactcttatgccaatatttgaaattactcaggtagtacatttctttaacatttttaaactattatacatttaataagactacaaaatagaaaataacatagttttaatgtaatttttgtttggaatatgataaagctgtgtgtgcatgtgtctgtgttttaagtgatttttggaggctgtgtggtttgcctgaaatagtgctcatctaaaagtcagaatgtcttcatcttctacctttactgtggataaaatacagtatagttcataaaatggcataatacttgaggcactggattttagttttagaaacatctttgttctaaaataatccactttggggtctggtatttcttttaggatattctcatatgtctttgccagacattaggcagctttttctgctgataaatttaaaatctgttaacttatgtttgtatttatttatctatatctgtagatttcttctctccaaatattttatagaagtcattgatatttgtcttcataaaagtatatgaaaagttaactttttttcctctgtaaatccttaggaactaagctcttgatctcttaaatatagaaagataatattcacattctacctgtctagcttcttactgtattaaatttgtatcacttttttttttctttttaaaacagagatgtgctccggcatctattcgcctcatggacaacaagcagtttcagtttggtaagtaaggagtggtaattttaaaatgtcatttagccacagaaatttatgaaacatcagtaggaagagtacggagtgcagaggtagaaagaacgtcagtcttgcctttcaggaagatgtcagtctaatgaagatagacaattacataaatgagtgagggtagcagtgttggagggcctgtgaaagaagactgcactggataccatgggctgcaaatgaaggaattgattcttcttgattttgcttgaggataaagagtcagaaaaggcttttataagagagatgcttgagctaaatcttcaaaggtgaatataagtttgcctagatgtctcttcttcttctcaaccagacttcttcacttggcagcaaaaatgtgaaggtgtgaaactcaatgatgtgtgttaggggacttcaaatcgttctatgtggctcaaatagagggtggggttagagttgttacatgagataaagttggttgggtgggctagggctttgcaggatagatttggattttgtcttgtcagcagtgggatttctttgaagaataaaatcaatcaactttacatcttagctcattctggcagcattgtgcaggatagattagaagggtacatgcatggaggagagacactaggagatgaaacagctcaagaagcaaagtttgagggctttgagcatggcagcagcaatggagatagagaacggatgatagattttcagaaaatcagtttgctaactggatgtggaaggctaaataaaaggaggagttgaagacaacacctagactgatttgattgggtagattaaataacatagaagaatgggtggtggtcttgggaaaaagatatgataatgggttgtagttatattgtgaaatttactttgggatttaagtttatagaatttaaataccctcaaaacaattcctaaaatcatgagagtgatcgttcagtaataaatactaaaggcaaagataggcaggcttttgtcatgtctaaaagtaagctgagattttaatttagggaagcatggttatagttacatagaaacttaactaaagtcaggttcgtaacatattaagagttttaaaattacattcttctaagttagtcataattgtttatttctttaagtaaattactttcaaaatactatactactgacaaaagtttaagataaatatgttctataagtaatgaaatacttaaatcaagtgaaaaaccacttgtgtgttttggcctgcatttaaagatctaggtcttaaagagagccgtgcatctaattaataagactgtgttattcgtttatatgttattgttgttgtaaacaatgttagacctaggcatttgtaaaattagttatgatttggccatacttatttataattggagtccataacaatttaaagtgaaggtttaaagaaagtcttcctgtcatccctcttccatgttctcattactatacctgaaaacatacttacttgctcccctctagcttgctcctgtctgtggtattataggttctaccttctctagtctttactgtgtctcccctctctctgccctttacttagccaccaaagtgatccttttgaaatacagatctgatcatgctttttggctgtctatataaccttttttatttctcagttttaattgaagcctttacattaatatatcctgccatggcttcatgatcaagcaaaagaggaaataatgcttagcacaacaaaaggtgccccagaccctgcactaaccgtatggctgattggtcggtgtttataccacattggttgttaacaaagcacatgccatattattagttgttaatatttttaatataatctctacttcaggtacaactcttaatacattatattgacattatctaattttagtatattgaaatgatatatatcattgtgtatattgaaataatccaaagatgtcctctataaaccaaagtttctcgaatttagggtatgtttcttagtcatttttctatcacctgcacttatcacgtaataggcatttatatgttgattcaattaatcatcaaattggcaagggggtgaacaaatcctagatggcatagtgctgattacattgtcaatagcacactttataaaattctattcatgactgttcgtcagagtggtatccccactttacaaatgactcaaagactcattattttgactacggtccacaaatcatacgtggtagagctagggatgaacccagatttgtctgactacaaagcccaggagtttttgcactgtctgtaaccactgctttaaaatatagataattaataaatcctgttaaatgacacgattaacattgaaataacagaaaattcactgatcaaactgtccagctagtaaatttggaagtgagtttaatattttaaaaaaccacaatagcagctgggtgcagtgcctcacgcctgtaatcccagcactttgggaggccaaggcaggcggatcacctgaagtcaggagtttgagactagcctggccaacatggtgaaaccctgtctctactaaaaaaaaaaaaaaaaatacaaaaattagctgggcatgttggcgagcacctgtagtcccagctactcgggaggctgaggcaggagaattgcttgaaccggggaggcagaggttgctgtgagccgagatcacaccactactctccagcctgggtgacacagtgagactctgtctcaaaaaaaaaaaaaaaaaacaaacccacaatagctagaatatatttaaaatgtaattatattgttaggcaacatatttaagaaaaagtaaaagataatattatctagttgatactaatgcttgacccacctaaaagtcagtatcacttttacaataatttattcttcaaagctatcatgtcaccttagtatcacagatgtatgtgagtaattctactagcattaatggaaattgtgcatataaatctcgatgagttaagtgaacatttacccttaaggattatttcatatcagagtagtatcatatggagtccgcatgcattgtataaagataagtgaatcttttgtataaagaatagataatttcaacttctgccaagaacacaacatgcacattcaatatataaatgtttatatatgtatttctaattgttgttaatataggatgagttccatttgggaccagaaatgaatgttttgatgatacgttatttctatctttatagatattagaaattgtctcttaaagcgctagttatactaggaagcatctctgatagtttaaaataaaagaaaaaaatccccaagcgtatctcttacttgtgatccaggagctcaaaaagattgctaggttgatctctatctaacctgcagttcagtttgtttctttgttgttgttttttaatgcctcaggtatagcatagatatctaattcttagcctctggttaagacttctattacttggtcttttatgtaacacagtttcctattataatcagcaaaaatgtagtaagtagtattacagattgagattcttataaaaaatggatagaaaaaaactaccagtgatagttttagaaacagctagtttgctctttgcacctattttaaaagaaggaaaggaagggcctacactttaaaaacaaacaaaatccccaaaccttaaaggcttttttaaaaaagaaaactttttatttggagataattttgacttacttaagactgaaattctttataaaaattttgtataaatggtatgacacctttttctgaattgggctgctaacactgaggccagatgcatgactcttaaatgtagcaatcataggagttgagtcgttactactttctgaaaagtgagaaaacagtaaaaggttttcactcaattaagcttaatctgcaggcaaagatgttaatttaacagactttgagactccatttatgttattttggcaattttaactctccgggtgtgattaaggaagcaattgctagttttatgccaagaattctggatgaattaacaattaattaagaaacaaccttaaacttggcattaactccatatttggatagttctgaatagtttctatataattaaaaaaaaaagtaaaaccagccaccatgggtgttcttaatgaaataaaaattaatgaagtaattttattatgtgtaaaccataccgttgaaagaaaacctaaactatgtgtagtattaattacatatagtgatttgacttaaaaaatcaaattgataatgggttttgtaaataaaaagttgtttgtgacatttgaaagaagataaaagtagcaaatattaatataactatatatcgtaatataaatatttatgtaaataacacgggaagattttaaaaattaaagttgtgaaaacttttactttcttttaggattctaagttggagtagcttcttgatcttctgaaaaacatagactaacctattaatataaacttttttctcttcttaggtcatgctcttaaacctcaggtttcctctatttttacatcatttttggacggattaaaaaagttttatattacaaaggtaagaatttttataaaatgctaaaattgtaaatgcttaagatatctgttttctgctttcttcccacatgcacctattataagggtgtttttccatgttgctatgtacatttcagaattacagtttttcatgttggaataaatattaagtaaatcaggcagtcaatttcagaaaattttatttcttttccagttttgaagcttctaaaaataacactgcatttgaacagttttgttttcataacattttctatagtttaaattttttcctttatggaaggtatccataaagtgaaataagagtgtggattttttttaacctttgattgttgaatttttttcctagagtgttaagccatcttataatacatgtgtgccttcttttccttgcatccttgttattccatgtgggattctttttgttacatttttaatttaccagggggaaaacagtactttcttctagttcatgttttttgaagctccaatgagactgaacgttaacattttttttattttctagatctaatttttgtgtgaattcgttggatatggttatttttgccaggtggtggtggggggtgtgcagcttcatgtttttttcttggtactttgatgtatctttttttgagattggaattattagatgtcctttgtcataaatgttgtaagtaattttttttcccagtcaggcatctccttttttaatagggatttttcttttttggtgtaaaagtttcaaatttttatatcttttcctgtgattatttaatatagtctaagcttagaaaagccttccttcctccagtaatatgatcagggccattttcttcactctctctctcttatactaaatgagaatttaaaaaaaaaaaagtctttattactatttgtatttatttcaattttattatgtgaaaaagatctaaactaatcttcacctcctgctcctccaattgttaaccggttgtggcagcaccattaattaatctgtgcttctcatacattgatttgctatgcctcatatcttatatacttatctaagaaatagattccattttagtgcatctcagtcttttttaatgagctttttgttcttgaaaaattaaatagatttcattgttgtaggtctatttttccctcttgctattcagaattttccttgttatcaccatcacctattattctagaaaaattttagaaacttttcatcattttaggaagttcattgtgttttttaattagaattggaataaactagtacattaatttggagaaatattgactggtttataatacttagtttatgcatttgggagcatacgtcttactcatctttttttggatgtgttttagatatgtttcctaatatatttctttttaagattgttagatactgtttttgttttatgcataagatcgcctttgaaaactttatttaataagaagttattgttagtatgtagggatgttgttgatttttgcttcccgcccaatatatccagctactttattctatcattctgcagttttttatttgattctttatcatagttattatttcaacaagttatttgttgtatttacataagcaatatgttattatgattaacactgtggcatactttgaaataaagtgtttttttctatgctgaatagctttgctacgttgtaatgacctaaataggtttattaaacattcttagtgattgacatgtaaagttccaaagctcaatttttaagaaatcagtgtatttgagcccagatcagaaggaaaagagcaaaatgtattttgatttattgttttgtaggataagacttatctgtaataataaatttttttttttttgtagtttaaaggatttgacccaaatcagctaagtgtagccacattactgtttgagggggatcgtgagaaggttcttcaacatgaaaaacaagtgtatgatattgctgcaaaatttgggtatggcttcaagttcataatgccaagagaaagagttaaaagctaagattctaatatcaccaagcaattattaaagtactaggcattaatgtctccaaacagactgcatgtctcaaagtagttattaatttcagtttagtgttaaatttgtggtaatttatgatagtaaacttaaaatattgttttggtttacatccagaatttttaggaagttagattgatatgttgctcttgtctaatcatatatatattattattaaacattgtatttttcctagatttttacattaatgtcaatttcatgatatttgttctactagagtaaaatagaaaattcattgtcctcttactctgtggtgataatagtgtatgtataaagcgtgctactagtgtgtttttaaaaggaaattgtgtttaatcgaaggtatttgataaattatctatactgcaccccctgtcacttactgttttgtgctggtataaagaaacagaaaacatttcacatctataaccaactgaataatggtagggtggtttctctctgtcttcttgatggattataagactgattgatgagaactatagtgaaaatgccatttatcaggactatgttttttcctttccttttaaagtacataaactaacagtttctagacactaatcttttcttttttgatttcagggattaaaatatatcatatacattatgcttaatattagttctttgtaaatatttattttcatttctttttcattgttttttaagaaaacaaatgaacacttaatttggacccatgtgttttagaatgccccacttttatgtattttttttcatatctaatattagccctttatttctagggttgtctgaatttagtgttaacgtgcagtattcttaaaggggaaaatagtctaatcttagacttaaattttagttttcttttgcactatttttaagtattgaaaatgtctcacttttaccctattctgaaattggcaaatggaattttaattttttcagtaaaagagaaagtttattcatctttcatcttttctcgatagctgttttgggaattgctgatattttaactaaatcacttaaaaataattgtgctataaaatccatgtaatgaccagatggcttgaatttcaggtcatctcatttttgtttgaatttttgaaatgtacatgttttccttcccagaaggaatttagccctatgtatgtacccgttttttagtttctaagttatagggagtacgtatgtaatttgattaaaggactgttttcttaaaacatatgatgttagtaaggcacaaggacatttaaaacctactctagccttaaatattagagactgaagctttaaaaaattgttcattgtgtatttaaatatttacttggatttcataatttctaagaagggcttgtagggaaatggaagggtgcattttgctttatcatttaaataactgtatatagagttaaatttgcttagtttcacctcagtcgtctctctgctcacacacacctccacatctgtacacacacccacacacagaggaatttcagtttttaggatctatctttataatttcaattaagtatggctagtaactcattactagttagtaatgtgtcacatttcctgttagaatggggtaggatgatgacataatgcttgtttgttgtgcctcataatttttatagggcatgacctatctttttcttgtgcatcactgttgatgtctagttcattctagatacttgatttaataattgttgaatgaatgaatgaaagtgaatactatattttcctgatatcttttattctactttgtttatgcctaattactgtgccacctgtaaaacagtgtattttcatctttaggtatttgtcaatacattttgtcaggatttttttgtttgtttgtttttgtttttgtttgtgttttgagacggagtcttgctctgtcacccaggctggagtgcagtggtgtgatctcagctcactgcaacctctcccgcccaggttcaagtgattgtcctgcctcagcctcctgagtagctgggattacaggctcatgccaccacgcctggctaacttttgtatttttagtagagatggggtttcaccatgttggtcaggctggtctcgaactcctgacctcgtggtccacccgccttggcctcccaaagtgctgggattacaggcattattttgtcagttttaatttgagccaccgactgacatgaatgtcagtaatgccagttttgttttcttatatgtcactatccatttaccaattaaaactataagtgaatcttctttaaaatatggcatccagnnnnnnnnnnnnnnnnnnnnccttcagatactgacacttaggcccaagcactattgctgtacttctagcagttttgcttactcaaacaaaacttgtatcaaatttgtccattaaaaataggttatagtaaatgagactcaatttaaagcaagggtaaagagttaaagattggctccgtttgaggtctcattttttttttttgctgttatttgttccttcttagttataattaatttcttaatgtgctttcattctggctcccttttattagatgtggacatcttctattttaaacaacccagattgttatttggcagattacttagattacttagagccatttcgattttttttttttttttttttgagacaatgtcttgctctgtcactcaggctggagtgcagtgacctgatgatcatggctcactgtagcctcagcctccctgggctcaaaggatccttcctcttcagccgcctgagtagctgggactacaggtgcacgtcaccatgcctggctaatttttgtgtgtatgtgtgtgtgtgttttgtagagatggggttttgccatgttgcccaggctggtctcagactcctggtctcaagcagtactcccaccttggcctcccaaagtgctgggattacaggcatgagccactgcgcctggcctattttaagtttttaatacttggaaatatcttcttttggttttctaccagaagttctagtatcccaccagttttctgtaggcactaattttttgttctaatcactgaagattcaaggatattttacttaggtaaaatgccactcttcccaccctcaatcctcaatcatctctcctgcataacaagacaaaagaaagcaccaccaagtttctttctgctacagttttcatgtgctagtttagctcatgtattttattttgaattggggcattattcatctatccctttttttttatttgtttatgaaactctctactgccttattagctttacattgatttttatgaagtattcccaacaatttagagcatttttatgtgttgtcttagccattttttctctttgcttacccttcactcacaccccaacatagttcaatacctttgaacacatatgacccaacagaacatagtagccacataatgaataatcatactttgattgtttatccatgtttgctagtaatgtattttaacttctccaagagcagagcagaataaacattacctgtcagcactcatgacaggtgttttgacatttaccatagaacttaaggtaatatgttatcattatttttaaagcatgcttaagttgtttaatataattcaacatgagagtgattaggttcaccagatggcccttttatataaaaagattgtctctcattcctctttcattagtctttccagtccttcctcatgagacagctttaaatttgtttaaaaaccttgaattgatgtttgaaatttgtggggacagcaggaagtaggggatcgatgttgctactttaacataaagcagtttgaatctacatgcagtcattttggagtgattacaaaagtcacaatttagaagcatttgatttttaagccctactattctttaatatattgtattttaaggtaattctggctagaatattgacagttctgaaagctaaaaagagaaaagtttcaaaaagttcagtcataagtctatgatttccttgtaaagcccagactgactctacttctttgggcttatgaatttagaaaggacatccaatttcttcctgctttgaattagaaaatgcatgtttctctgtggtttgtctccctggatcctaatgtgaacagatctgtttcctccctactgccagatattagaaatattagaagagggtctaaagaaagatgacttaggactgaaaagtaagactttttgtctcatctcgacataacagaggcaagcctattaaatgtttatacctgttacttctcatcagatacatacttggcattctcttttctcaaatattcccaacacaggtgccttgcaccttttcctactcctcactctcttttcctttccttccaccactaggttcaggatggatgaactgtttctgtttcctagacctgtggtgctttttctctcttggactcagagtctgactctattttatatctacttgagctatgggctaagctgttttcctttaagcacttgccacagcagttttctgacttgttttccttttcttttgaaactttatttggctttctacctccaacctcacatccaactcagaattgtgttttatctcttcttctcactttcagctgcttgaccaaagttttatcttctttgctcattaacattctaatacaaacagtccccttcattttttttattataccccattctcaagtagttctagactagagctgcttatatcaaatctttgccacttcttttggataacaccatctacctatagtggcaagtcaggaaattttgatttagcccatttagcttgaaattatcttacagtatttgtacagaacaagagtacatctacattgtagtgtttacttactaccaaattcaacacaacttcagaagaagaaaatatttaattataaggtgttaattgaggcgataagataaacaatttttcctttagttgactaaagttaaaattttaatttctgtatgataatggaaaaagcataattaaaaactatttactaaaggtagtggaaaaacagtattcattcattgtcttttaaaataagaataacttttacaaacaagagtacttggactgaattatatatttgtatgggattaattctaactagatcatcaaatacaatttctatggatgaaattttccaattgaaagagatagtttatatgttcatagtagtaagaccttacctgtgttggtcttgtgtttgtttatacattgctttataaaatatttctatgtaagtatgttttgtctctcatttaaatcataaatttcataaaataaacaccacatctaacattccaaatactatgtactcatcttgtattctggaagcttctcagtattggggagttcctagtcgtcacatttcttcaaatatgagtgagacagtaataacatatgaatatatgagtaagaatatgatgagtaaaataagaatacttgtgtgaagattatttcagcttatttgtttctcatagttaattctttctgtgcttttttgagaatacgggtagaagtagttgagtttatgagtcaattttatttcgtggataaaagtttgaaattaagatgaaacagaaatattaaaagtgttttcagatttttgttattcaaacttattctcttgacagctttttgatacatttatgataaatgagattaagataaaaaatttattaacagtttgttctttaattacagtgggttggcagctggagaagataatggacagagaggttatttgctgacctatgttattgcatacattcgagtaagttatatcatatttcccttgccacttaatttatgttgcaaacaatactttttcttactttaagtgaatgcaattgtcttccctattttttaaaattttaagctactgtaatttagcatatcattttacatgaaccttattttagctacaaatcttcagaagcccatttaaaccttctccatatgctcttgaagaagttaaagatgatttaatatgtctttctgctctttaaaagaatggagcctttctctgtttaaaagttgagcataccattcataacattacttggttaaaatcaagctgttttacttagcaacactcttcacttaataatctgttttaatgatgtgtaaatctttaactgtgttgtaaaattttgatatttaacttgaagtagttatttgttcactgatgatgattatagaattaaagaaataattatgtgtacttgaacactcaaatgtttctaattctagattttctacttacgatatactgaaatagtcttattatctcaagtctgttgtatttactgatatgaaattgttcttttgaaattttattttttcaatttagttttgtttttctactttgtaacaaattcaaatttcttaattgctttctgctgttgctggggttacttttttttattttttatttttcctgtttacataatttgaatgatcttactctaaaaggtcattttttcagatatcctattgagaatttggcttccacaaatactcagctttcttgttttaattataaaaatttttggaaatttatacataataaatatacatattttcagggtacgtatgatattttgatagcttcatataatatgtaaagatcaaatcaggattgggatatccatcacctccaaatactaaatttactaatttttctcttggaaattttgaaccttatacacaacaattgttgtaagcttatgtacaacatgtttttctctaaaaaaggctgaattaatatgttctcattttagcaaaaatttaatcccagctaaaatctaaatgttaaattgcagtgaatttgaagcatatagtcctcctcttttgtcccctgcccccacagtgatgatgataagtaaaagtatatttattgcctgttcagcattttagaaattttgactaagagatgtactgatcatgaaaggtaatagatgattgtagatcttgtaaataatatctacaattatcaattgtcaatatcatagtttcttcccatagtaagcattttgaatatacataaaatgttgtttgttaggcattttctctgaggatattggccttttccccataatactgaattcagaattctagaaaatgaaatataactgtaacaagtacagcatagacacaatttggagtatctatcttaatttttaaggttctagttaatgttaaaactgattcaaaagcaagttagggattccgccccccctaccccgggattacatgttttctgtttttataagttttacaatggttaataccattgtctctaaatatatttttactgaataaatgagtgcattagagaaaaacacatgctttagatcagatcagtaatttggggatttttttgttttttttcccaaacacaggtgggttgaaatgactcattttacttgaagtgaaaacttaacatatgttgagttttctgccttataaaattttctttaaaatctctggacttctgtgaagctttctttccaattttgataacaaaacaatattgctctgggtaaagaaattaagtattataagttacttgtaatatgagtattatatcctctatactgtaaaatattttcgtagtagaagtgcctccagatgtttgatctattctgtcacttcagatagctgcactatattactatgttttctaaatttgtttttaaagaaaagttgattttaagaaaaaaatctcctcattctaaacaccttccccctgcccctcacttcttgatcttcctactcctttgatcttgactaattttcgatattggttaatttactatttatgccactaaaattctgttctgtcagtattctctacatgtacacagactgttcctggatagaaactccattcactaaagaaataaatttgagttcttgccctgagtcaggcactctgcctggtgccaaggatacagagaataagacagacaaggttcctttagttacggaggctgcatctcactccagggacaacttttcagtgctcttatgaggtggatagtaaagagtggatgaagttaaatgagaaacatgtgatactaacaatgaatatgaaagactaacagtgttattgattcttctgcatctgttgtagtttcttgatttttctgtttgtgtcttaataggacttggctttggaatactatgtattaggagaatcttttgagacttctgctccttgggacaggtaaaatatactaaagtgcctgatattattcaaatatgcgatatgaattgcttgaagtaatgtttctttttgtgtgaatatgtaagtttaaaacattttatgaagaaacattgagacaaggcagctactttatttaaattaatatattcatcagaatgccgtattttcaagtgttttattgggtggagggagttgaagaaaatttgtctgtgatccaaagaacgaaggtattgttgaagtttacattttgaagaatgttattgaatgctcagtgttactatgtggttatacttcgctttgacttaaattcttaagtgattaatattgcttaaatgttctctaaaaagtcctcccaaagtataaaaccagttaactgtcctttataatattatttagtttttgatatttgtatgtgtaaaaatgggaatttaggtggtttataaaggaaatttagtttaggaaattatgtacaatttctgtttttaaatttaagcaaaatgttgatactggagcatattttaggaaatggcccaaataagatagatggaaatagattttagaagggtttctttactggaaatacatacatacagtattggttagtgacttaataaaaactgattaggaaatgcgaaatggtttattaatagacctgtgagttgtattataactcatccagtaataaaaaaaattctcaaagagattgtctatacaatcccttattcaaaatgctcaggaccagaagtgtttgagattttagaatatttgtattatatatttaccagttgagcatcccaaatctggaaatttcactggaaatcactgcagcatttcttttgatcatcatgttggtactcaaaaactctcagatttgggggcatttcacattttgtttttttgcaggatattcaacctgtatatttttatttgtttctagtatactgatattttacttttctttataaaatttataaagtactttaaatctacaatgaagtgtataggacggaacaattccctgtgaatctacttcttagattgcatatcttaatattttggtttcttccaatccctcttttttcccccagaaaactttttacttttctacatgcagtcatcatctactgagttagtacgctggtgttcgtattccatgcattgttagctagtaacccagtttatgttatactatcactcagtcattcacaattttttttattttttaagtcagatttctcaagttgaaatgttattcacaaattttgatgctaaattttaacaaggggaataaatcctttcaataaaaaaattatcaagtcatcagcctttgagtagtagaaatagtttggcagtggctgggcgcggtggctcacgcctataatcccaggactttgggaggccgagacgggcagatcacgaggtcaggagatcgagaccatcctggctaacacggtgaaacctcgtctctactgaaaatacaaaaaattagctgggcctggtggcgggcgtctgtagtcccagctactcggcatgctgaggcaggagagtggtgtgaacccgggaggcggggcttgcagtgagccgagatcatgccactgcactccagcctgggcgacacagcgagactccatctcaaaaaaaaaaaaaaagaagcagtttggcagctattcatagtggtctcaaagatcttttttttagtatgaaattagtttttatttttaactaaaaataaatgcttaacatctttccaaaatcaaaactaaggacgaatacttagaaaaaaaggtggaaacatatttttccttccctggagaaaccagtaaggcagacattttaacggagcttgtttttttccacaggactagtctacgcaacagaatctctctccagccctttttctatgtcagttctgtctacctggcaggaaaaaccaaaagaaaccctgaaacaacccctccccacaaatacaacacaagacaagggacttgaaaagttggggaaaaccttttaacgcgtctaagaccattttagtgtttaattcctctctttgggtatcttagccagtttggcctgctatacagagcaccttagactgggtagcttaaatgttcttagacaagaaacaattatttcttacagctctggaggcttggagtctgagatcaggatgttaacatggttggggttttggtgaaggccttcttcctggttttatagatggccatcttcttagtaatacctgcacctggaggaaagcagagagagagagaaagcaagccctctcatatctttttataaagcactaatcccattaatgcagctccacccacaggacctaatgacccaccttctaataccatctaactggggcttaggatttcaatatatgaattttgagagggatgcaaacattcagtccaaatcaccgggacagtggattagtgcaatgctacctcttaagagttaatgaatttccttgtcatcagttagtactgatgattgacatcttgtttttttattcttccaactgtggaagctaataatgtgcaatttttttttgtttttcatctattctttatatatacttacatatttatttgacacactgataatttctgttttatgcagttacacatttgttttcctttaaaacaatttcttcagccgaagttttaataaataatattaatggaaggcaactacatttttatgtaaaatttacttgttgacaaccatttagcaattttctttttctttcaaacctttaactagctagaggacatgtttgcagtagcccatgggatcacggtcttttaactttcacacattattagattattggctttttcatatataagccacttaagggattaccggtcatactagtttttgtgtattcctaagtgtcccatcctattgtgttccatcccatccctaccacaatggctgcacctgttaggttctcaatgaatattcttcatagattcttatgaatgagcttgggaataatttgagagtacagtctataaaaatagatattttaagggttggagatatacattttttgttgttgttgttgttgttgagatgggatctcgctctgtcacccaggccagagtgcagtgacgcttatcacggctcactgcagccttgactgcctgggctcaaatgattctcccatcttggcctcctagctagctaggatcccaggtgcacgtcaccatgcttggctaattttttttgtttgtagagatgaggtctcattatgttgcccaggctggtcttgaacccctgggctcaagcgatcctcctgcattggccttcgaaagtgctgagattacaggcatgagccactgtgcctagccgatgttacagattttggagacaccagcaagtcttctgattaaaaccaagaaagtggatacaaacacttatagatagtatggagtgaaggaaaaaaaagaaggcctaagaaagaggtccagggaacctcaacatttaaggttacaaacaaaacaaaaggtggcaaagtgtattgaataataatatctagaggatgtagaggtaatccaatgatgtaaaaaaagcccagggaagtttttttcagggaggaaatggtcaagtgttaaatttgctaataagtaagaatttgaaaatatgcagttatgtttctgtcctataaaaggattgatccaagtggactgtgttagcctcttatcaagttctgtgagagaatactttcagaaacctttccctaaaaatcatttactgaaagtgtcccattgtgggttataactgttcagtctggtcctttctccatctccttttcattattcaactatcagtgagggtttagatataaggagctcttaatattttcctgtttactattgtatttaagatgattggatacatttaagtgcatttaaactgaaatgcagttcacacagtgccataacttgcaaaggactgtaacagcagatgattgtattcttagattttttttagactacttagctgtagcacttaaatttcattttctagagccaacataaagaacttgttccaaagaaaagaacttactacttttataaatttgtaatatacgttaactcttataaatattaaagcttaatagattttatttatatttaaatatttgttttataaggtatatattcaaaataaagacatattaaatatcagtcatctaaatgttttatgagattttttttaaatgtgcatccttgccatgcataagtgatgcatagataacattgataagtcatgtatacctgcaactctcataaattaaagaatttaacttaagaacattgttttataaaattagattttataaaactttcagatactgtattcataaagataaaaaatgtgacatgctaataagacactaaagccctttttgtatttatattttaatcatatactgtttgttcttattgacaatatggataacttttataaagtatgatctgtttaaatgctactgttttttatcaaagtggttctcatacagtcaagtctgcgtcttgagactagagataagccaaccttttgagtttttctggtatcatttcaagtctcatgatgctaaacaaatcaaggtttaaaacacagaatcggtgttattatgtggccaggatatttattggggaataaaatgggactttaatatcaaatagtccagcataacacattaatactttacatcgtttgtcttcagtagatctttgtcaaactggatttcagcttgtgagtaagctatcgaacatttgatataacatcatgattataatttattttgaaagacagtgccttgctctgttgcccaggctggagtgcagtagtgcgatgttggctcactgcaacctcaacctcccaggctcaagcagtcctcctgtctcagcctcccaagtagctgggactacagacatgcaccaccttgcccaactaatttttttgatttttagtagagacaaggtctcactatattgcccaggctagtaacatcatgattattaattgaatcattattattattattattttatttgagacagagtcttgttctgttacccaggctggagtgcagtggcgcaaccatggctcactgtagtcctgccctcctgggctccagcgattctcccacctcagcctcctgagtagctgggactgcaggtgtgtgccaccatgcctggataattttttaatattttgtagagatagggtctcactgttgcccaggctagtctcaaactcctgggctcaagcagtcctctggcctcggcttcctgaagtgctgggataacaggtgtgagccatgcacccagcctgagttatttctaaattaaggaaaacttcttagacatgggtaaagattggtattcatgtaacctagaatcgaattttcattaacatctttatagcttttttaaagctcttaaaatcttataatcaaattgattttgaaatcaggctttcctaagtgtaggaaaccacattcaggagacttgagtgtgttcttgtgactttctgttttccttaagtcaaaaaaagaaaaaactttcttctttttgaagttaggaatggagggctcaatttgagtgatcagggctcttttccattcttgaaaggacaactatgaaagctttagctaagaaaatgacagacttgaatgatgccagattaaccaacgtttattagcacttgtgtagttctcacttgaaaacttaatattgtattcatttatctttttttagggtggtagatctctgtagaaatgtaaaagaaagaataacaagggaatgcaaagagaagggtgttcagtttgctcctttttctacatgcaggtaagttttaaaaattgttcttatacttcttattctgaaaaaaatgttttttttaatcaagggggggaatataattttccagctgagaaaaagcttcagtctattacatttggccagctttcctaaccttcacttaccaccttgttaggattgtgccactggaattttacagtagtcctgagccttttaggagtaggacacccttctgtgagtaagccttccctgccatctgggtggcatggcagtgaagagccaggtgtctggactcctggaaaaagaagaggactactctactcactgaaactataaattatatagtcaagaaattataaattatatacatactcaacatgactctgaagagtgaaggcagtgttttgttgtttactagtaatttaatctcttcaagctctaatattatcagtaaaatagtggtaatgccatttcttcatgggactgttgtaaaaatgaaatgagaaagcatatgaaaaaactgttaggttctgctgtagtattgttttgacataattacattaagcttgaggtagataatccatactagtattagtaaggaaaatttgtatatttccctttcctttccaatgacaagtcctcattaaggcattcagttgttaagcttacttgctccttatagcatgataatttgcatatatttgttttccaagactagaaatatttctgtattctttaaactgctaattgtatgtgtgtgtgtttttgtttttgtcttttttctatcttttctattgtcttatcttgtactttcctagtactagtgttgtgtttcttagttttccttattgttcccattgggaagagataccctttagaatttgctaaattgcacttctgcaaggtaagaaagtaaaattctaacatgagatctgaggaaagcatctttcttacaccttaaatgttcatttcaatcaaaaggatctccttaaagtagccgtttctgcttctgtgtgggagacactgtccatgtttaacaagccttgcagaaagtactaagtcatctgtatattaacatgttttaagcaagtacactgacgataggatcagagattataaaagctgaaaaagtagattttagagattatttgctgggcattcgagatatctgaacgaaaggcaaagagaggtcttgttctctgtagtaaaaagcttacaatgggattaagctaatgtcgacatagtgggtgtaagaatgtcatgttacttttaatttattttaaatttgggggtatctttaacaatgcaccttttatcttaaagtccttaaaatctaagacaaaaatttttgtgtttatattatcaacccaaactgatgcttcatttttctcttgatagcccagtcttttagcagtcagctctcttttattgtaatcctgaaaacaaatcagacataataatccaaaagctatttgttaccattagattttgaaacattttagatagtcaaatctattcttgtgtagttgagaaatttttattcctttgtttttttgaatggtaacttaacagattttacccttcccccttcttccttctgcccccaagttcctgttcaacatctcttaagaaccccacccccgctgtaacattatgaaactatcgtgataaaccactacctatggaaaatgattaggaagtaaaatattctgccttagggcacattctgtaattacacttaaatctaggttcttcagaatgtattcatgaggcctaagaatcttcattctgtattgtagataagtagaattagtatatttagactgaattggccatatgtcatttttattaaatagcagtagctatgttttaagaatggttttcctataaaagcttatgtgttcagtttctgtgaccatcttataaaaccagttagaatatgcaaagcctagttacttgagtggctttgataaataagacttttatggttcttatggctcatacttgattaaactaacatttaattagaatttgatttcagtttagtttggtttgacctgcttagtagtgctaaggagattattccatgttgaatatgtgagatgtattttttaaaccagttttttatcaggtgctatgctcactacctgggtgataggatccatactccaaacctcagcatcacgcaatattcccacttaacaaacgtgtgcatagacccccatatctaaaatcaaagttgaaataacattttacaaagctgttccaaagttatttaaaaataattatggatctatttaaaatcaaggatcctaagaaaaataactcaggtgtagggtacatttattgagttcatttatttcatttttgtccattaaaatgtactttgtacattggaatagaaattccagtccaaacttttctgaagacgttatatgggaagtaattgctagtcattgagtctaatacaaataaagtactccaaaaagtagggagcacaaaaaattttttttaattaaagaataatgtagtgactttgacaaccacgctattacttgtccagatgattttgaaagaggttagtgtttaagtgtcttaaatgatagagttgatctattgtaaaaggtgttagatctaagtcactttctgaaatggacccaaattaaggtattccataaggtgtttttcattatttggacttgtctgagatactaatcaatcaggcccatcaagctttgttatgacttcagtaatctgttcatctactgaaaactgaactgtgtaatacatagatgctggatttgtttgaaagatgataatgctctattaatatttagttacatctatttatgaatgttagtgattctcttatgagtgatatatattttactaatttctgcaagttcgtttcattcatttatccttcacactttatttgaatttggttattcctaatgatagtgcccttggagttaaaatggttctccgttgtttcttaaactttgtatatctggtacttaaaatgtaaatattcaagggatcttttttttatgagggtgaattaacactagaagagaaacacagctggcaaattgacagtagcattgttaaacagttcatttcttctgttctgaggcacctaacatttggcctaaaatgcgattaaaattgtagattagattctatttgtattgtgtagtaaaaagagtatttcctctgcatttgctccttctgttaaattaaattctttgtgggagcctctgtaaattgcatatggagatttgactatgattaccttacctcccttttaaatgctttcctaattgcattttgaaagctcagatatatattatatatatgatttaataatctaacattcttgatatcttttgtatatacacattcaacatgtataaatattgagtcatagtattttaaggctatgtcactgcatttggtacaatcatcctatttgttttccaaaggcttactaattattaatgtaaacttagtgaagatgctatatttcactcagtctgatcatatttggtatttgggcatttctcccatttcttagtttttaattctcatatctcatacttatttcttttaacttcgagggagtttggaaaacttaactgatcaccacgtttcatctggtctgtttagtgactgactttaagtgcagtatacttagttttttaaaaaagaatccctcttgatggagatgggccaattggaaaaacatttacattgcttttaaatttctaattttgggggaggtgtaactagacttaaaaaaaaatagtattgtacaaatatttcctgtgtaccctttactcatcttcctcaaatgctgatatctcatgtaattatagtatgattatcaaaaccaaaaaattagtgttgtttcaatatgattacctaactcacaaacctttctttatcatttgtcctactgatatctttatctttcataaccttcatacatttgaagaatactggccagttatcttgtaaaacatctctcagtttgagtttgtctgatgttttcttgtgatcaaattcaagttacacatttcagcaagattacctcagaagtgatagtgaagtgctcttcatggtagatcatctcagaagaagcatgatatttattaagtctcattattggtgacattaacttagactacttggttagggtggtacctgccaggtttctccactctacaattactatttttccccattgtatttaaaaaaatatcttatggctgggcacagtggctcacgcctgtaataccagcactttgggaggctgaggtgggtggatcacttgaggtcaggagtttgagaccagcctggccaacatgatgaaaccccgtctctactaaaaatacaaaaaaattagccaggtgtggtggcaggtgcctgtaatcccagcaattcgggaggctgaggtaggagaatcgcttgaacccgggagatggaggttgcagtgagccaagatagtgccactacactccagcctgggcaacaatagcgaaactacatctcaaaagaaaaaaaaacccaaaaaccttatggggagaaactttgagactatgcaaatatcctgtttcttatatcatctcctaatcacatcaatatcccactgttgattcttgattacagcagttataattgtgatacttgtaaatggtgattttctattttaatcattcattttacatttatcaattggaattcactgtaaagaagagctttcctctcctctctttttctgcccgccccccaccccttgccactatctatctgtctgtatatgagtctatcagtagggactcatagacattttattgtctggaatatagccattattgtcattattcactttgttgctcagattttcccagtgtggctattgggagtttctttaagttggcttctgtgtccttttgatctgggaaagtaggtttttgaagaggaagaaaatgggcgcacatacttaggaagagtcagtgattgaggcaaggtgtgaagatatgaggcctagggagaaaggtgagaagatatgaggcctagggagaaagaaaagcaggtctgtgggccacagagggtctgtgttctgtagagttggtgctgagtgaaggtatatctcctcaagctttcacagcagtgatagccgttgctcctttgatattggtttcttcctcaagttctttggtttttcttattcctgatgtcagaattgtagttattttcagctcatttttccctgcttttttcccttaatctttttgttcatctggttcctctactcatggatgtctagctttttttactctcctttgttatctcctggttgatttctcctatatcttagtaatattggcatttgttttacctagaacaatatcttatgtttctttgtcagtctccatttaggtatgcctttccagaacacttttcccaatccgacctatcccaattttcttattctttgtatagactgatttttaagctgcataagctaattgatggtgtctgtctttatgttctctcagcattcttcaatctcgtttgtcattctgtatctttagactatgtcatattttggctatatacagcttagaagagtttcttctagtgcatttaaattatctgtgtagaaaaaaatattattgatatttattttgttgtcatttatttttaaagttatagccagaactgaacagtgtctttgttttggtctcaactgcagtgatttgctttttttctacccagaatctttaagtctgttgagccaggagaatccaaacaaatgatgagttcatagtattgttgccagagtgtgacaggaaaagggtcccaggatgatccagacctcaggagaaggttcttggatctcacacaagaaagaattcagggcaagtccacagtgcaaagtgaaagcaagtttatcagcaaagtaaaggaataaaagaatgactactccatagacagagctgccccaaggtctgctgattgcccatttttatggttgtttcttgatgataagctaaacaaggagtggattattcatgcctcccctttttagaccatatagggtaacttcctgatgttgccttggcatttgtaaactgacatggcactggtgggagtgtaggtgtagcagtgaggatgaccagaggtcactctcctggccatcttggttttggtgggatttagctggcttctttactgcaatctgttttatcagcaaggtctttatgacctgtatcttgtgctgacttcctatctcatcttgtgacttagaatggcttaaccctctgggaatgcagcccagtaggtaggtttcagcctcattttacccagctcctatttaagatgcagttgctctgattcacatgcctgacaagaggacttaatgtactttgaagagattataatttgcccattctctatcaatatggattttttaaataatgaaaattgactttagtcagtgtttgcatgtccatatgtattctatgcatttcatgttcctatcctcagcagtgacggagccaatgaaaggaaccaggtttcttgttttgagtctaattttgcctttttcaaggggcagatgttttgcatcccatctgtttactgtggcagtacaaaatgtagttttcacttgcacatatggagctcattgtgtggtcctttggcaggaaaacacgctcttgaaaagtaatggagttgtactatttgtagtatggaagtgcctcaaattttgtcttatacaagtcacatgaagaacttaattgtgcataaaatttgttaaatagcagaaagagaaaaagttagtgttacttttattgtcaagatatgtatgtttttaagtaattttgttaaatgtcattttgattatgcaatttaaaacaatgaatactcatgcttacctgactatatatatattgttttcacacatgctgctgatagttctcattacttctagataacaaaacaataaaatcagtgaaaatggcatttcatcataaaattctgatacaatgtataaaagtttttgggttatttcccaatagaagttttagtaacatgggacagacatgaaaaagattgaatatgtacctataatattgactaatttggtacttcagtgaaggtaaaattcttgttttgcactgcgtcctcagttcacctgttttggcggacaactctaaagcaagccaatgtgtattccttccatggagtagaggctgggaagaaactgagattatatcttaaactaatcatttgggtcgtcttgactttcagtttctagatgttaaatctgatttcacttaacttaaagcccctgtggggattttgtttgttttttagggtgacgcagacttacgatgcaggtgcttgtatctacttctattttgcctttaactacaggggaattagtgacccactgaccgtatttgaacaaactgaggtaattttgcatacctgcatatagcttttacagctgttgattaatttcaataaattttactgtcaatttatgaattttaagttgagtctctttaatcacacatggtttgcctagctgttagcccttagaaatgaaaagcatatttgtttccctggcttatgtactgaattgtgagtctaaaattaaggtactgtacacctagtctgtgattcttcagttgttacagtacataatagctgattaaattaaataacaattaggaattcattaaattaaataactatataggaatcttagatatcactttcacagcccactcatttccacatggtggttgctgttgaggtcagcagccctaatgcccttggtctgtgttgttgtaatgtcattctagatttgtaatttttttatatgctatagctgtaagtgggtgctttgggttcattagctagcagtttctattactttcttaaagagtgtcaaactgtttatttttataaagctttctcttgataaccaatatttctccttatgagtacgcctaaacagactagagtgtggaggatcctgtaggaagctgaggtttcttaaaaactcaggtgttctactgttttaactgcattgcacacctgctaaagctaatttcagtagcacacttttagacccaaactatagaaagggtttggttggcttcctcctatgcctcctcttttttttttaagcagcttttttgaagtacaattcaagtacagtaagctgtatatatttaatgtgtacagttttgacatatgtatacacctgtgaaaccatcaccccagtcagaataatatcattcccaaaagtctgagtacttttttgtcactttagcctttcactgcttcagtgttgccctctggctacccaaatgtcccttctgtacagtaccacagagtgaaattattccttctttctcagtccaaactgctggtctctaagtgctactgatctcaagtagctattgctttatttaaagtaatttgttagaggatataaattcttagagcaggggagggcatatgtatgattcattcggaaaaccctaagtaatgagggttttttggagatgaagtctcactctgttgcccaggctggagtgcagtggcgtgatctcggctcactgcaacctctgcctcccgggttcaagcgattctcctgtctcagcctcctgagtagctgggattacttacaggcgtgcaccaccatgcctggctaattttttgtatttttagtagagacagggtttcaccagttggccaggctggtctcaaactcctgacctcaagtgatccacccaccttggcctcccaaagtgctgggattacaagcgtgagctaccgcacacagccgagggttcttatagattactttgcagtgggatgtggtccgtctgtcccacctgggccctctcctaccctggcctaactcctgatagtttatacatacacaactgagtaattttgagaggcccaaggtactatagatattttacctcgtagccattatatattcacgaatcattaggaactgaaggcaattccagtttctgtcatccttttttacagtgctctttagtcattctatattttgttacaagtgtttatcttttcctacctgtgtcctctataaggagcttggttaggaccttacatattagggtaaaacgaggtttttcttttcactcttaggtatccataagactgacaagtaatttatcccaagtcattgacctaagaagtgttctccataaaggcatttatggttgatttctaataggtttaataaagactctaatagctttataactctgatgcccactatatgatattaggcaaataatttaacctatctaagccttattttatctgtgaaatgggagtaattgtagttatttcataaagctatactgaaaataagatactgcaggcaaattacttggaacttttctggtacacttataggaagcagtcagtaaattttagtcactttgttggtataatgagagatgttcgttactaagtagaacctgactctacatttacaactttgcagttattaatattattaacaatttagtgtgctgaatggtcattttgtcttttttccctagaatctcaaagtgatctttagacattgtgactattcactagaaaaaaacttatgaagctaggctacttatttaattgctttttaaacacatttgaccaaaagagaggaaagttaggcttctagtttattatttaacccaggaaacatgtgccttctttgggagttgggtctttttctttcactgcaaaatgaaatctaactagcaacaatttgttgtgttgtttccaaatacaggcagctgctagagaagaaatccttgctaatggagggagcctgtcacatcaccatggaggtattcttttttgggagtagaatttctaatattcttactttaaaaaatattcagttcagtaaaatgctagggagagacatggtatgaataatatgagagtacttgaggtttctttaaagtttctatgtctttgaaatagctgttactgaggtagatagttaggttgtggtagtagccactagaagcttactttgacacgcctgcctagaaatggagcccaggcaaccttctgaggtctcagggacctcatgttatcagagaatagcccagcttgcctgggaggtacttgaccattacagcaaacgtttttaaaggatgatggggaagaaaacctacataaatgtttttcagccactatcggaatgtagctggtcatcagttatataatatattgaagggctgtttgttctgcccacccaaagctcagcaaattaatcaagacaggatatgagaaaaatcttttttcaaggttttaatgctgttttgttattacttagtggtcattttggtaagtatcgagtgttgtcagaatttatcacatcaccaataaaaattattacaatatgtctatctttgttactagcatgcttatgaaaataatgaggcaaccctttaaaacttaaacaatggccattctgttattaaaatggcaatgtttgaggttatccacttgttctgtagaatagaaatttgttcttaatatatccctcaatataatttgatgcctaggaaaatagaaatgtgtagatttttaaatagtttttaggaagcacagtgacaataaccacctaatttaaaaattcaactgctctggactccttatatccttttttttcctgtttaattttcattcatagcacttattattatctaatatgctgtatatttgtactttttaaaattttgtcttcctactgcaaagtgagaatccatgaggacaggaattctagttttgtttgttgctatatggtagcacctagaacagtgcttagccccagtcagccctccatacattgatgcagaatgaatgaaagaattctgttggaaaaggagtggactatggaaggtgtgtgtccatatcatattcttacagcaaggtctggaaaagattgctaatgttgatgaataaagtagctcccaacgtcattgtgtcaatttaatcttttgctatacttttctcttaacccccacaaatgaattcttaacttagccaatagcattgaagataatatgctcctctctcctttttctatttattatcctttcatttgatggtggttctcatgaatgctagcataacaaaaatggaaaagggagggaaatgaatattagaaacctctcaagtggaattaaaagcttccgattactctaaaagtccaaacctaattttggaaatttgaatgaggagttacttaaagatacttagattttagcaccttcctgtaaaattttcagaaagccatatacattattttaaatattttttattctgtttcaaaatgacactgtattaatattcagggaactttaatatatataaatatatcatgaattattcgtttgttttttgtctaaattgattacatgggacagaggaagcgaaatgatttagccataattacttgtttgaagaaaaattaaaactttcccagtgtagccaacaaatttgccctttggtatgtgtcagcagccaatagtttactttctcttttaaaatcaagaaatgtggtttctgtgtttataatggtaaatatgggggagaagtgattctgcaagagggtgagagcagctgaatcatatatataacaaggaaatagaggcttaattgtctttaggtaattggttattagatgagctgtttccttaattgtgggatgatgttctcagtttattcaatctttatacagtgtcagaaattctctagaagttggaaatgaccaaatgactgcatgcattacagaggaaaaccaaaccaacagttttttcctcggccagtgactctgcttctttagggtctatgaggaaattcaagtccctctaatagtgtctatttgtaagatgcagaaagtgtaatatggcagaactgctgattttacttattcagatgtaccccagacactgagagcttcttggtaggctctaacagagtctgtgtaaacatacttgaaataatatattcataaagctgtcattacagaaaaaaggaaatatgcacaaatataaaataatagaattaaccaactctagtgcaaatctgtttgaaacctggatttcatttgtgagagctatggtaatagtccattatagtaatcaattcacagaaataaaagttaattaacaaatagttagaaaatgttaatttataagatcatgtttattcaattcttgatcacaaagcaaataatgtaaatagcttcttgtcttttttttttttttttttttgatactgagtctcactttatcacccaggctggagtgcagcggtgcgatctcagctcactgcaaccactgcctcccaggttcaagtgattctcatgcctcagccttctgagtagctgggattacaggcatgcgccacaattcatggctaattcttgtatttttagtagagacgggttttcaccatgttggccaggctggtctcgaactcctgatctcagatgatccgcccacctcagcctcccaaagtgcttgttatattttttgatacaaagtatgcttaataccttttaatgttgtataatctgttttccatattataagtactactggtctactaggcaatatggtttcaaagaatggcagtccttcccgtgaagggccttatagtccagtagaataaaatattataccatttcaaaagctactgacaaaaactgatgggattatattattgctactttaaggtaagagtctgcccttttctttgaagagcattcaaaagatgcctttaataaacatgtaaatgctatagatgctgaaacagtgaagagaaaggggatagaataaaggaaaagaattaacatttataaagctgtgaatatttgcctaggtgttctgcatacttaacctcttttaattctgcttaatgcagtggaatagatattattcctgtctttcacatgaagatgctaaggttctgaatataaagtaactggcccaaaaatcagtaataattgttagtgccagaatttgaatttgaactcaggtcttcctgcctcagtatccttgtcctcttaattaaaagcctaaaatgtctggaatgagtaaaatctaaaaagattgaaaatgacaggctttgagaagagacatgtaattaatttttttttaaatgtatatgggctgggcatgggggctcacacctgtaatcccaacactttgggaggcctaggcgggtggattgcttaagctcaggagttcgagaccagtctgggcaacatggcaaaaccccatctctacaaaaaatacaaaacttagctgggcatggtagcatgtacctgtaatcccagctactcaggaggctgaggtaggaggattgcttgaccctgggaggttgaggttgcagtgagccatgatcacatcattgcactccagcctgggtgacagagcaagtccctgtctcaatcaatcaataaaaggaaaataaatattatacattactatttttattttaaaatataaaatctgtttctttagtgaattaaaattttaatttcctcatcatagatatttttattgttttctcagttctttcccataagtcaattttactttctggttgcttttatacttcctgattgtaggttcctaacatgtcagcagtatcaggtaatagaacaaatggcggtcatatcatgttacattaaagctatgtgtataagttatgtgcatttttcaggttctaggtttataggccttcttttattgaagactcccaatttggtgaaataatttattttttaggaattattgggttgaagttgaatctagcaacgtttgatggcatattaatttatttagaggttttgcctcatttaaatagaaatcttttatgtctatcctatttcttgtatttttattttctatgtggtcaaaatatgaccgcatggaaacagactctgaaatacctggttttctctagtgcttagaaaaagaaactttgataagtctgaatacaaaacatactttaggtatgctgataaaatgaagatgctttcccttttctattttttttctcttctaaattgctaaatattggagtcttccagggctcagccctcagaccttcatttctctatattcactcatttatttgatgattatctcaagtttcacaatttaaaagaccatctgtatgctaactcccagatatcaaaagataacacctctataccactaccctagttgcaatcactattttctgcagtagcctcctaactggtctttcttccactctgctactgtattctcatttctcttgctgctcgattaatctgttaaaaaaatcaatggtttcttctcacattcagaacaaaatgaaaactccttatcatgaccttcaaggatacattgtatatcactctgtcctcagctttgattactttgtacctctagcagcattggccttcttgctattcctcagacatactaatcccttttcccattcaaggcctttgctgtttgttccctctttttataatgttctttcttttgtcctctccttcagatatttgcatgactcactttctaccattgtttaggtctctaataaaaatgtcaccttcttagagggatcttccctgtcctcttgtgtagtttctgtaatccccatttgaattaaatttattgaggttaatgactttatcttgtttgtcactgtatttctcactccctaaacagtgactggctgctctacatagttcaacatcataaatgctcaatgaatatgttaaatgagtggataagtgcatgcccaaataaatgctcacagaatttgagcagttttgcaaattctcaaatagctctgaatcttgcatattaatccttttttttttttttttttttttttgagatggagtttcactcttgttgcccaggctggagtgcaatggtgtgatctccactcactgcaacctctgcctcccgggttcaagctattctcctgcctcagcctcccgagtagctgggattacaggctcccgccaccacacccagctaattttttgtatttttagtagagacggggtttcaccatgttggccaggctggtcttgaactcctgacctcaggtgatccacctgtctcagcctcccaaagtgctgggattacaggcatgagccaccactcccggccgcatattattcttttatattagaacagcagtagttggctgtggttcacacctgcattccaaacactttgggaggcccaggcagaaagagtgcttgagcccaggagtttgagacagtctgcgcaacatagcaagactctatctctacaaaaactaagaaaaaaaactagctcactgtggtggcacatgcctatagtcctaactacttgggaagctggggcgggaagatggcttgagcccaggaggttaaggttgcagtgagctggcatcgcaccactgcactccagcatgggtgatagagagtaagatcctgtctcttaaaaaaaaagaaaagaaaaaaggcagtagtctcgtagttaatttagcttaacatttggtaactaggcctaaatattgaatagagggtcatatttagtcatagaaagtctcagtttattctctaatatttctgggaaagcatattagcagagtgagttagttattcactggagaagtagggtaaaataatgtgcatttttctgcaactccataccaccaaccatttagtgttcttccataaatgcattaagtatgtaaggtttcattcgaactttttgtcttaaaaccaatataaatttgagtggctgaacaacagaggggaaataatgtaggctatggaatcaaatctatattggattcctggttttgcatttaactgtgtgaccttagggaaataatttctctgacttacactttcctcacctgcaaaatgggaataatggtacctgtctcatatgtttattgcaacacttaacgtgttaatctatgtaaaacatctaaatgccttacatttagtaagtgcttaaaaaacaatagttttgtttgtttgtttgtttgtttttaataatagcaataaacagcaccaggtggcaatctgtttggcactcttgccttaaccattaaagaaaggattacagtgtatttgagaaagatccatacattcaagggatatgattcaacaatagttttaacacttcatttataaactacagttgatctcaccctataggaaagtttcttacaatcagcatgaaagaaaaataaatttccttcacagtattggctatgaaatttgctatcgaagaatgttattttcataatagcttttctgtttataggtaatcatataatttgtgtatttcaaatgcctgctgctattcagtataatttcataaagcagaaaccttttcaacataaattttaaataatgtttttagttaccttactaaacttattcaatgctagagcttttgagagatcacttatttttatgtatagaaaagatttttcttgatttgcaccctgaacttaaaactcaagttgaactcatagtagcgtctttatttactgaccttcaggcagtgtcatgacactctcagtaccacttttgagttccagagtaaaagggccaggggttgggagaatattgatgcaatttctcttagagggtttggcctgtaattgtgattaataacagttgctttcactatctggcaacaggctggtttgtctgcctacaatcatgctgtgataaatggagctatgttaactctggttttgtgtatcagagaaaacagatgtagtctggaactggaggctataggaaatataaagcctacttaacttaatcttcatagtgcttgtttttgtaactgatgagctggtcagtttcaatagcaaagtttatgtcagccatgtatttaatttcaatttatgacttaagtttttaagttgttcatttgctaaaatcatacctaagtccttgtcaggaagttaaaaaccttgattaagtataaccagccttagtttaaatattgattttttttacctaaccaaaattactccctattataattatagggcagctgctgttacctttttttggtagtcttaccagaatctaatagtattagaaactttaaaagtaaaaggaaactactcaaagaagctgaacaaaaaaatcagtttagggccatttgttaatttgtagtgtgaaacaaaaggcatatagattggaaaggaggaagtataactatccctatttgtaggtgccattattgactatatagaaaatcccaaagaatgtacaaaaacagagtcagcaagatttcaggatacaagatcacacacaaaaatcaattacatttctaaatactaacaattaagcatatagaaaccaaatctaaaatataataccacttgcagttgttccaaagaaaatgaaataggcataaatctagcaaaatatataccgaatttgtattctgaaaattacagaatcttgatgaaagaaatcaaaaaagacctaaataaatgaagagacatacagtattcatggtttggtagaaaactcaacatagtaaaactgtcagttctttccaaattgatctatctgtttagtgcattttctgccaaaatttcagcaagatgtttaaatagatatagaaaatattattctaaaatttatatggtaaggagaaggaactagacagctaaaacaaatttgaaaaaatgaataaagtaaaagcagtcaatctaccttatttcaagacttactatatagttacagtagtcatgactgtgtgttattggaggaggacacatagatcagtggaacagaatagagaacccagaaatagagcacacaaatatgccaagctgagtttgacgaaagtacaaaagcaatctagcggaggaagcatagctttttcaacaaatagtactgggcggagggggcggggggaagaactctgacctaaatctcatacctatacaaaaatttaactcaaaatgaataatgaacttaaaagtaaaacaaaactataaaacctttagaaaaatttaaagaatatcttcaggatctagagccaggcaaagaattcttagaccggacactaaaagtacaatttataaaaaattgataaactggattttatcaaaattagaaacttttgctctatgaaggactctgttaggataaaaagataggttatagagtaggagaaaatatgtgcaaaccttatatccaagaaaagacatatctattatatataaatctcatagctcattagtaaaaagcaaatactttaattagaaaataggcaagagacatgaagaaaaatttcactgaagaagatatacagatggcacataatcacatgaaaaaatgttcaacatcgttagctattagggaaatgaaaattaaagccacaggagatatcactacacacctatcagaatggctaaaataaaaaaatagtgacaatatcaaattctgccaatgatgcagagaaactgaatcactcgtacattgcttgggggaatgtaaagtggtacagccattctggaaaacagtttggcagtttcttatgaaactgaacatgtaatcaccactcaacccagcaaatgcacatgtgagcatttgtaccagagaaatgaaaacttatgttcacataaaaaccttaacataaatattcatagcagctttattcataatagcataatagacccaaactggaaacagcccagatgtccttcagctggtgaatgactgcctacacatactgtggtacatccataccataggaatactactcagcaataaataaaaacaatgaactatcgatacatgcaacaacttggaataactctccagggaattatgttaagtgaataaaatccatcccaaaaggttacatactgcctggttctatttctataacatttttgaaatgacaaaatcttaagagtaaaaaaaagattagtgatttccaaaagttgaggctggagagggtgtgactgtaaacagcgcagggatccttagtttgatagaactgttcttgactatatcagtgtcaatgtcttattcctttgatagctaccagatgagtttagcctttccaacactgaatctttatcagattactataagatagaaaatttgttttgccttttaattttttcagtttctttgactggccttttctaacaaaacgtatatgttgattataatatttttccattgaagcaatgttgtagttagagtgtaagaacatactgtggaaaccaacttaacccacaatttaactgaacattaaactattaatatttcagctgtagcataggttaaacagatttgagagctgacagaaaaatctgtagcaagaagatactgatccctgctccccaccccaccatccccccacccctgtgtgactacaggggccaagcccaagacaaaagggccagggacaacattgtgttggctgtctcttaccacatgctgtacctttagtagcttctagcctcaggtatatcaccaggagagtgagtataggtggcttggataatatcacttagctttggatctctaaagagaactttttctctttgacaattttatgtctataacttaaaaataatatgtttgttaatctgagaatgcctgtattacattattacattgttacagaatacttttatagttagtttcatgtgattagcaaacagttaatcctgggaagaggttggttgtcccctctaacactactttcttacataatccagcagtagtttggtcagattaaattaaatcttgaaatacaaagtcaatgctcagatcactcgtataagcagctaagtctgggttttcttcttaaaatctgacctatagaatagtgctaaagagatatccaggatactcaaactagaactttcaaaatatagttgttataatggttagatgctttttgctttggctgaagtctacttctgagcttcaccttcaatgatcttctaaatgtatggcccatttcataatttgttctttttaataagtctataatctttttgacttataatcaaatgtgtgattcaaaaaattaaaatttagctagagacctctgtgaccagcagacgctggatttatcccttttagattaggactgtttggtagtttctgctaaatcttcaatccgttaagcctcaaagagtagtttcagaaaatttttggtggccagattggcctccatgtccacattttccatgtacatcattttatctcttataccttgcgtacatgtctgttcattcatttatgctgttgatcataccacaacttctttcttgcattctttcttgaatctcttagcatccaggggaatagtgagcctgtaatttgaaaaactgtacttgaaagttttcatattctctgttccaaaagtaaagttttaaaaatgtactatgtgttgtggaagaatacacacaacttgtttgatccagtctctatatacattattagaaattaaattgtaaaacagtgaactccatttttaatttaagcacagccccccaccccccgccccattagttttctttcttttcttttcttttttgtttcttttttttttgtgagctatggagtctcgctctgtcacctgggctagaatgcagtggcatgatctggactcactgcagcctcaaacttctgagctcaagttctccttccgcccaatctcctgagtagctgagactgcagatgcgtgccgccacatccagcttattttttatttttttatttttatttttttagaaatggggtctcactatgttacccaggctggtcttgaactcctgggcttgaacacctcagcctcccaaaatgttgggattacaagcatgagtcactgtgcctggcctagttttctgtaatattcagtatttggcccatcttttttatgtcttataaaatacatctaaatacttaagtacttaaggaatcatatatttagaataatagagaattatggaatgcaaggtacttatcttgttttcagagatggtgatcttggctttttgtagctctagtgttgactctcaggttagatttatacttctagagcatcagaagtcaaaggaatatgttgggtcagtagctatgaatatcccacatcagatgattcaggtctaaaaaagaagaataggctttatgtggtatgtgtacacatgcctttcagtagataactatcacatacaaggtaaattgaaatagttttaggccacctgttatttgctgtcttcagtaattcattttcccttcctttaatatggtgtgctacataagggacagagtataatttcttccctttctgaaaatgagctttacaggtgtttaataaggaactgctatatagttgtatacccatgtgtgttaacatgggtacagatcagtatggtcagctaatttctgaatgcccagcagtacaactaagaattgtacaaagggcattattagtggtggtgtttagctctggaataaaaatcttgtactttgaagtgtgtttcttctccaagattaaggcctgtggtgtttgttgttttattgatccatgtggggtaactacataaggttctccagaatctcaagaagactccaataattgtcttgttgttaaggcatattgaacgtttttgtttgaatgtgttttctacctgtatatgtatcctgtgaagtagttgacttaaattgttaaacaaagccaaagatttctagtacctttaattgcataaaccaagatttctgaccccatttcaaattctgttatcagtggcagaagaagtgccagacctctgccacgaaggggttaaatgcttttatcaaatgtgtttatgaggggccacagctttgttggccgtactgccctttttttttttctactttctacttcactaatcaaatgtatattagattgattattgtaaaagtataaaccatagaaaatttgacaagatagatgtgtaaattatccttctgacagaagtaatgatgcactccaagcaccttctgttttccagcgcttggtgagtgacttcattaaatatgcaatggctgttgggtggcttctcagacgatggttcagttccttgtggaattgcattattactagaggtgtaaaaccaggcagacaagctagctgttgggcatcctgctgaggttctaatgtgctccatcttgttggagcagttgtttgcagtcttttcaggacaattacatccataaccacaggatacattcagtgaaactgtattacagataacagtggagactggtattcactgctcgtcacccctctctctcttcagctgcctcagtgtgggcagcttatagtagtatggtaaagccccttttaccattcacagagtagttgtttaaaaaaaaaaaaatcctgtggagcaaatctggaaaaaactgatttttaacttttttaaaaagtgcttaaaatcatagaatattagagttgaagagaccttataaagtctaatccatttgcaagtgaaaaaacaggctgaatcatagtcatgggcagtcccttaggagataatagaaggtcctggtagaatatcttttaggtggtagagattgcaggaatagggatttatttactcttagcttctggttttagagctatctcaaacaaaatttttcattttgaatttaaggttttttttctgctgaacttcatttccccccgtcttaataccagcaatacctttttatttctgaaagccaagcagataatttgctttctgagattatcacagtatttattattttgatgacaatttgatggtttcttagagaactggacacaaaagatggttttagttgagctcgaaatggtatttaaggtttccaaaaggcagatgctatgatgtatcactatagcctaataaatgggaatgcattatagaatgacaggctgaatactttaatgaaagaaggtttcccatttcagttggtcaattaaatcactgttgatgactttggatcattaatgaacatttgtagaaaatgaccgtttgaattcaattagtatgataataggttttttggagaagtacaagtacaaataatcctaactgtaaattaaaagatttatccattttgccacagataagttagcatattgcttgctttttaataccagagcaaactgacatttcagaattcttttacagattaagtacatattctttcttacaaaagttctacttacaaaaggttatgtttttcattgagtaccttttgaaatataatttatgctgctaaccattatgttacttcactattctcagaacaaattagcaagacctagaaacaaaaaaagggaactttgtacagtatgtaaaagcaaaagattaagtttacgatggattaggtatttgatttatttaatgccttaggaaaaaaattctaaatctggaaaaacagtaggaagaaagtaaccattatttgggaacatgcaaatttatttaaaagtactgtgaaaagaaaatgtaaatagaagcttaatagccagaattttttcttgagcctattaaagtttcaaattttcttattatttgaagcctttatgttcgttaaaatattttaaggatatatatcctgtcatttttgctgaatttacccaacaaattcgtctcaatgtgatgtttttctttagttaacttcattttctctaaaacttgggtgtgttttggtagttaaggcagaggtgggttctttcgaaatgcacgtttttctcattttgttatttgtaaaatgggctataatctctgtccaagcttccttcaatctccatttcatagtttacagagaaaggagacactgtggagcacagacttcccctgggaatacattgggcttaatgagcttgatagtctggtgggctcaataaatcaaataaagcaaaacatttctcatttttgaataaaagcatttatcacacagtgtttgttcactcatggtcacaagattgattggttcccagtatcatagcatatattgaagcatttttgattttgtttttccagtgggcaagttacggaagcaatggctaaaggaaagtatctctgatgtcggctttgggatgctgaagtctgtcaaggaatatgtggaccccaataacatctttggaaacagaaaccttttataaatccattagtaccattacaaaaaaatgtcaattttttttttaagttttcaactgtggttatactagtaatcaaatatatcatggactatattttggatacatttgtttctttggtttaaaataagtttgttttcattctgtagtttgttttgtttctacatctatggattgacagatagtattcctaaatctctctcattgtaggtacatcattttacattcagcggttgtcatttcaaattttagtcaggcagcacaaagctgtcaattattccagaggaagctgctgccagctgttttgtattgttgcttcctcttggggaacaaagacagatttggtatcattgattgctcagctagcctctttttaaaagaacgtttctgggaatcagatgtctagggaaggattccactgaggagtgatacacgtgtacattgtttaagagcatagtctagtgtgagtaggccattaaggggaaggatattcatgaaagaatttaggcaacctgttatttagaaagccttcacgtctgtaaggtgcttggcctacttttttttttaaattagtatacatgcataaaaccttgtatcatcaatatacaaattattctgttaggggacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatggtttaatgccttttttgaataactggtttaacctaattttttttaaatgtaatgtattaatgcatataccataatcaaaagtttgaaatatcctgtttcttaaataatgagaacattaatcacatttagcaagcatttgtacattcaaacctggatattaaagtgaaatgattactttgaatcactgtctgccaaggttcatgattcacattttgagatggattcttttcttaatgcaatacctaacttttgataattttttaaaactaatatttgatcagataatgtaagtcaaaatgcagacgatcctttaaaaggatgcattgtctgtgtatgtagcaacagctccaaagtatttttgggcagtttgataccttttatatctgaagtagccttaaccagaaaaatggtaatttaaaattgacaaaatgatatttttaagacttcaaaatgataaataatttttaactattaaaattggcctcaaactaataaatctgtaattaaattagaattaaatatcagtttaacaacaaaatgaaatatttattttttagaagctgcctctcttcattggtcatttatttttaattataaaatttccaacagatctttgctttaagcccttgatatttgacctagttggacacttgatgaggaagttgcctctagaattataaaaatctcagctttataaaatgcatctgttcacgaaggtaatttctttaattggtgatcaaaatataaaattaaggtactaatgtctcactggaagtatatatatatatatatatatatgtatgcatgtgtgtgtgtgtatatatatatatatatatatgtatatgtttctgagtaatttttaaaaaataaaacaggttaataagaagatccattcctttgcatgtgattgttataacattctttcccagggagttcaatttcagcaacctcagaaa

SEQ ID NO: 13591 - DNA, 29122 bp, Human
tctcaggaatatgctggtaaaataaaaataacctttagagatgcccaaactgttttccccagaacaccagcattcattaggtgttcattcaatagattcttcaaaggattccaaaggcaaagaagtttggggaacagtatatataattacccaaccctttgacattagcatactaagggccctgagaagttttggattaagaaagttttcaaattaaagtaacccagaattttctaagattatttgaccatgaaacatatgtctccccacaaagcacatattcctatctccttgaacttgaggataattagacgtacgtgggtagagggtaggggaagggggtatggcatagaaagagcaggaccttgggagcaagaatatctaagtttaattcctgactctgctatttattaactaaccatctttgccaatgttgcttaagcttttttggctacatttttttatttgtaaagtaagtttaataatcactcatctcactgggctataatgataagtattaagtaaggaagatccacatatgtgagttgctggcttataattcacactcaagagatactgattttgtcaattgtcctttcccctttttttctctcttccctccttccattccttcttcccttacctctcctttccttccctcacaccccttttccttccttctttttacatttttttatttaaatgaacttttcattttggaatagttttaggatttcaaaaaatttgcagagataatacagagaatgcccatataccatcctccttatcccacttctttttgtgtctattagatgctcagagtgtgtgcacaaggctggcacgcccagggtcttcctcatggcactaacagtctactgaaaggtggaacagagacaagcctatcaacacctacaagactggtggtaagtgcagtgacagatgcaaaacacagggtgatggaaagccctcaggagggtaacctaacctagatttgagggcccaaacaggctccagaagaaaatgtcaactgagaggaagcctgaaggatgaacagtgggctaagcaaagggttattaatgtgttattaatgggttgaatctaattgggaagggagagaggttgcagagtgaggtgcagagcttggtggacgatgccaaaggaatactgaaacctttagtgtgtccagtctggaactgcatccaaattcaggttcagtaatgatgtcattatccaaacataccttctgtaaaattcatgctaaactacctaagagctatctaccgttccaaagcaatagtgactttgaacagtgttcaccagagcacgaaagaattacaagatttttttttaaagaaaattggccaggaaataatgagtaacgaaggacaggaagtaattgtgaatgtttaatatagctggggctatgcgatttggcttaagttgttagctttgttttcctcttgagaaataaaaactaaggggccctcccttttcagagccctatggcgcaacatctgtactttttcatatggttaactgtccattccagaaacgtctgtgagcctctcatgttgcagccacaacatggacagcccagtcaaatgccccgcaagtctttctctgagtgactccagcaattagccaaggctcctgtacccaggcaggacctctgcgctctgagctccattctccttcaagacctccccaacttcccaggttgaactacagcagaagcctttagaaagggcaggaggccggctctcgaggtcctcacctgaagtgagcatgccagccactgcaggaacgccccgggacaggaatgcccatttgtgcaacgaaccctgactccttcctcaccctgacttctccccctccctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgatcccgctgggcaggcggggcagctccggcgctcctcggagaccactgcgctccacgttgaggtgggcgtggggggcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaggaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgctatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatcccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttccacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataatttaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagcagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacacattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaccactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaaaaaaaaaataaataaaaaaaaataaaataaaataaaataaaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacgtttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtctagtaattttacttcaaaaataaaagagaattttctttaccatcaaacaacgttgctgtaatgagtggtgatatatttagtcctagaggaccaaagagaaataaaatggctttgattatgctggtttaagaaaatatatccgattaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttccattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatactgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagactagcctggccaacatggtgaaatgccgtctctactaaaaatacaaaaaattagccatcatagtggtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgttccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatacagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacactttgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatacttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccacctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcttggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattagtagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagtaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaaccttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtcttccttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaacatctgttgctgttgattatgtctgctcttggtgtaaatatcattcctttgtaggtaatctgtaattttttttcctctggtaatttttaaagcttcccctactactttcctatgtgttctgcagtttcacaacaatgactttcaatgtgtatttatttttacttaatctatttaataagatttaattagaaaggcagggctttcatcatttctggaaaaaatcccagctattttctctttaaatagtgtttctttaccattctcattctcttcttctgaaactgttgttattatctgttgaagcttcttgagttattttctaggtctcttaattttttttaaaacaataattgtctccgtatgttgcattttaggaaatttctcattactctttttaaattaactgttagtttttactaagcccggctagaatagtctatccactgaggtatgtattttgttttctatatttttcattcttaatgtttcttattgttccttttacatttttacttgtatatgtttcattcctgctttttttaattttctttcttctttctcttttctctctttttttttttcttcttgcagtgcagacagactttattagtacagcagaggtgcccacagagcaggcagaagggatcagtgcctggatctgtcccttcctccttctgccctcgctgagccctagtgtgtccggaattggtgggtt

SEQ ID NO: 13592 - DNA, 17886 bp, Human
aaagagttctggataatgaaaataatcacacagtgatagtaataataatgatgatgaaattagtatttattgagaacttagagtatctctgccactataaattattttaaacactttaaaaaacccaatctctataagaactccatgaggtatgtcctgatatcattactgttttatagtaaggaaattgtggtttagagatgttaaataactgaaatcacacagcttttaactgttggagcctggactcaaatccaggcagtctgacttcagagtctaagctcataatcactgtgatctgaaatcttcgttgtcctaaatgtatcagttcaaggctcttggacaagtcacttcaactccttaagccttggtttccttgtcagttgaagataatattacatgccttgactttaaaatatgtcatctcaattgcagttttatgttctttgcaaagagttattttacatgaagcactgctaaggaagttttaggcctttggcaagatgcaggtttgattttgtgggaatgttttggcagaactccaactctgtaatagctattttatttccctacttctcagatgtttccttaaaagaactgccttttttatatggatttggaggtgcaatcagttaacccatttagaagaagaaattttctcaatttgaaatcctaattgagatctcaatgccaggcagataactctgggtgtccttctcttaacggaacatttcgacctaattgtgattagaaaagtggaagaggtcttgaactggaagccaaggggtggctaaagagtacctgatgtctggctggagctctgcctctaatgccctgtgtgcccttgagcaatcacttcctgattttcttatttgtgaaaatgagagcattggatgaaaatgtcctctaatatgccttcaatttctcaaatttgtaagttgataggctgctccagcctttctaattttatgaaaggatccaagtataagatccaagtataaaatgggttatttaaaattttgttttattaccaaagaaatacacattcaatatagaaaattaaaaaaatatgacagaaccatgggaaaataattaaaaacacctataaaacccaccacttcataataacctcagtcaacatcttggtaaatatgattaatctttttgcaatgcataaaaaatacatttttaatgagatttacaatgttactttttctaacctattactcttacataagaactaccttttgcttatcctcttactctacctttttaatggcagtaaagtattctaccatatgatatataatccatcaggctcaccctcacttgttggactgttagcttaacagtgacttttattaacggtggataattgcagcccctaaaatttaaagcaccttctcagaaaattttatttcaaagcttctctgagggtaaagtaaaagtcctcatgattcaaaaagatttttccattaaacacttgaccattttaacatttctaaatttttacatgctgcctgtccctcaaaaatctagctttttgaaaaaatttcaaaaaggtatagcatatctagaaaaatgtgcatttgggttgatacagacaggaaaatctagatgcttctttaacataaggtaggcaacttgtctctgcaaagatctggtctcagactctggatttcccatctgtgctctgcagtttgtttattcattcactggctctatccacctttaaagtgctcacgagaacacatgatatgccggtcactacactaaggttgtatcaacatagaagtcagagtttcagaagtcagagtttcagcttactgaaagcttatagtgtaactaaagtacttccagatacatgctatattagataagggtcagaggatagcactaggacacagaggagggcccccaaacccagccttggaggtgggagttgtcaggtaagtgccacaaatgcccaattacagctgaggctgcttcctccctgttttctatagaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcaggtgaggaaaattatgattggaacataacaggacacagattaggttcctctgtgttcatgtttatccccagattgtctatctctttctgcccagaagttatgtaaccttgttacaaatagacctctaatgattaaggtccaggagtaaatgccaatttcacatataatgtagacagattatctgatgggcatctatcagatacaaagtctgcccctttttcatgtcctttttgtctaaatatagtcattatcatcatcatcatcatcatcaaatcatttcatcaccatcagaaatgcttatacattatcctgatgtataccaaagctactgtttggaaagaaactaaaataaaagtccaggtcacttaaccatacagggctgatgttagatgaaagcaagcatcgataccaaatgcaattttacataatattacctgtcaacaaaatatatttggacagccgcatggtaattttacacattatgtgtaaacaaagtattggtggcatcacatggtaaaaactcagtaatttcacctcagaaattcttcttcacatcagaaatgtagtttgtgcattgaggctatctgattgatgtttatgcctctctgcttgggatatattcatgagaataaataatagaaacctctcccaatgaatgcagtctgtctgaattcattgatctttatgcagtggagatattctgcacaagccgctattttatgggtccatagtagccatggctgttttgtagttctaaaatagtcactgcagtgcaatttaaaatctagtaacaataattttttaagaacttcaccttaatgattttttttaaatgcagctgactaatttaggcaaatgtcttaacagttgattggtatgaacttatccattagaaatcaagcctcaagtggttatttgtagatgcaatgcttttgcttataatagttagaaaataatgctcatattcttttgggtaggtgatgactttaaaagtacagtttaaaggatttataagacacaaaatgccatttaacaaatatgtaaaattgtatacattctttcaacaaataattattgagtgccacatatgtgccatgcaatttgctatagtgatggacaagacagacatgatctctgccctaaaaaagctcatcaaggaacataggagataaaaatacaaagtaaagttgactttcccccaacatctcctgttatttggaggcaattcaggtctttttccaatcaactgcagaattttgcttaagagcatagtggcaatgagactcaatatgtttattgttgctgataatcagaagaggaacttcccatctcaatgacttaaccttttgtggcttggctgtaattgattcacaagttttgggagatgctgactcataatgtgttgaacctttttagggggtgatggtgggaatgggacaaaaagacagctacgtgggtgacgaagcacagagcaaaagaggaatcctgaccctgaagtacccgatagaacatggcatcatcaccaactgggacgacatggaaaaggtatgggaggtttgctgcagcttgggccctcaggatgcataatccctgtgttctctgatacagaacaccacactactgctggggaaataactggctcacattgctcaactgtacttttacttgttaatgttcattctgggttattacccattgaaaaaaaaatccttgtagccataaaaaatgatgagttcatgtcctttgtagggacatggatgaagctggaaaccatcatcctcagcaaactgtcgcaaggacaaaaaaccaaacaccgcatgttctcactcataggtgggaattgaacaacgagaacacatggacacaggaaggggaacatcacacaccggggactgttgtggggtggggggagggggaggaatagcattaggagatatacctaatgtaaatgacgagttaatgggtgcagcacaccaacatggcacatgtatacatatgtaacaaacctgcacgttgtgcacatgtaccctaaaacttaaagtataataataataaaatttaaaaaaaaaagaaaaaaaaatcctaaaatgtttctttaaaaaaaaatcccttgccaggcatggttgctcacacgtgtaatcccaacactttgggaggccaaggtgggaggatcgcttggcccaggagtttgagaccaggctgggtaacatagtaagatcctgtctctacaaaaaataaatgaaattagccaggcatggtggcacacacctcagtcccagctacttgaaagattgaggtgggaggatcacttgagcctgggatatggaggctgcagtgggccaagatcctactccagcctaggtgacagagtgagatcctatctcaaaaaaaagaagaaaaaaatcctgcagggcacagtgactcacacctgtaatctcagcactggatcacttgaggccaggagtttgagaccagcctgagcaacatagcaaaaccctgtttctactgaaaaaaaaaaaaaaaaaaaggtttaattaacagtgtgtggtggcatgcaactgtagtcccagctactcaggaggctgaggtggtagcatcattcgagcccaggagttcgaagctgcagtgagctgatcataccatcagctgttgcactccagcctgggcaacagagcaagactctgtctctaaagaaaaggaaaaaaatgtccttgcctattaggttttattaactaattaaaggatgatagttctgtagatgagaagagtagccctttgccactgcagggaattaatcatctgttgctcacgtcaactctgttgccctcctaggacaagcagtgcatgagcagcagctcagagaatgaaaaccctcctttcattttcatcaggggctgcatggttatccctctcagtgcaatatagctaaaggggcttgaaatgctgggagtagtcttaaacagcccattcttgaaaggttttcattaactcactctaaacatctaaattaaaaatgtttttgttttcactatagtaaacaggagtgtaacattgcaggtttggtacatttctgaatgcctctccacacactgaagcacaagagccactgaaaaaagctatatgataaatattttaaaaattatttatctgtgttgcattacatgaggccttatctcccagacacttaataaaagagctaatgagaagaagagctaaattctaagattttgatgtttggtcattaaacattacagacaccagtgatcagagaaaaaaacagaagaaataatgagaaagtgacataaaaaattttaaatgcagcaagatatatcagaatcacgatatctggccttttatttatctatcggctcactactactactacgcacacaatttatcacttaaaagaaaaatacataatgttgttagaatttatcagcagtaatgctccaagctctatctttctacaaaaatttcatatcagtaggtttgcttgaggattctagatttggtaagattgcagtttgcacagagaaaaagatatcaatatcaataggaaaatattcttttagaatttctccatggagctgacaacatcttagaatgtatcgtcctagacagagactattggaagaaaaaactttccttatttctaaaatttaaattcaaagtatcttctggtggggacgaagagagagagaggagaaaggttgcttgctgtgactggcaggattttttgagcagtctgctgctttcactccactaaagaaacaaaactttcagaagtttcatttcccttctataaaccacaaatccaaaacaaaagaaagtggaataagatagtctttaaagctaatcttggttttgctaatttgtaagctttcaccagcagttcttgttttgctctgttttgattttgagtgaatctcatattcctggctctggtggagaattttcgtgcttttaaagattaattaatttagtcctttttgcaatggtttgttcttttcggcatctaggaattaaagaaagtgctcaaccataaataaatgtagttatgtccaaagtaccttcacatagacacactatacacaggcgtgggccttttggaaacacctgaaggccaaatgtctgactgtgagtggaagatccagagtgtgctgatagaggaagcttttctcatccctcgagagcaaagagggtgatggaggcaagagtcagagagccctgttctcttcttcatgtacactgcaaagggcaacttctctagaagcattaaaagtgtcaattaggttttcaagtaagcgtcatttattcatatatacattcatttgtctttttatttacaaaattaaatcattttcccatgaacattaaaatgggaagagagaacaaagaaaatagagttgaataataataacattgattctggaccagacactgggctggacaataactcgagggttaccttatttatttacacaaagacccgatgaggtacacactaattattttcatctccctattaccaatcatgagactgaagctgagaagggttaaaaacttgcctaagctcacacaactaagaagtgtccgagctgggctttgaacccaaggtttgatcaagggttgtgcccttaactgccataccatcctgcctcacagatctgggttagggattctgctcagtcacttagtagatgtgaatcctttgggaaggtacttacacactttgagcttcagtctctgcatctataaaaccatggacacatgcatgagtacttgtagcatttcctttggtcttggtttcaagtagcttctggtccctttttgggaaatgcaggacctcatgacagcacatcattgtgtttctcctctgtcccccaactcactagatctggcaccactctttctacaatgagcttcgtgttgcccctgaagagcatcccaccctgctcacggaggcacccctgaaccccaaggccaaccgggagaaaatgactcaagtaagtatgctaccccagcacacaacactgtggggtctggggaaacttctgttagaaggaggctatgcagcacagcagagagaaggccggagctaggagtccaccaacagactaacagccttcagtgaactcagggatcccaaaggacaggaacagcttgaaagtacttgcatccttcctgcagggaccagccctttgcctccaaaagcaataggaaatttaaaagatttcactgagaaggggccacgtttaagttataatgtctaaggagaagtcacttcaaaatgcagcatcacatacaataggaatttgggttccagagtcagacatatctaggtttgaaaactggatctgccacttatcagttatgtgaccttaaagaactccgttaatttctcagagcctcagtttccttgtctataagttgggagtaatattaatactatcatttttccaaggattgatgtgaacattaatgaggtgaaatgacagatgtgtatcatggttcctaataaacatccaaaatatagtacttactattgtcattattattacttgtttgaagctaaagacctcacaatagaatcccatccagcccaccagacagagctctgagttttctagtttggaagagctattaaataacaacgtctagtgtcaattctatacttgttatggtcaagtactgggctcagcattttacattcattgtctctttaagttctagcaatgtgaagcaggaactatgattatattgactacataaatgaagaaattgaggctcagatacattaagtaattctcccagggtcacacagctagaactggcaaagcctgggattgatccatgatcttccagcattgaagaatcataaatgtaaataactgcaaggccttttcctcagaagagctcctggtgcttgcaccaacccactagcacttgttctctacaggggaacatctgtgggcctgggaatcactgcacgtcgcaagagatgttgcttctgatgaattattgttcctgtcagtggtgtgaaggcaaaaaaaaaaaaatggttggaaattatggcttgctagcaaatgatgtcagacattctggttaatagagtaggaagggtcttacagatggagaaatgaagacccacggacatctcctgatgcacaaacttctcacaagtgacctggaggggcttggttctaatcttgtccctggactgcaccaactggggcactgacattctatgtggtcctctattaccattgggctggtcctgtcttccaggaaccagggcctctcccactgcaaccagaatggcctcagattctagggttagcattgacccagtaactacataaaaaagtggaatagattaaatagaacctcagacaaatcacagaaatggggctaaacctagccagcctgagcttcagatttaaaagttctctttctttataccagggaaatcaaaacctggatgttgtcttctctttttcttctggctttgacatagttaacaagccctaggatgtctgcactggaaaaatgggagatctcatttagtccaaactcctcctctgttaagagacctggaataaagccactattaatcaactattagtttggtgactattagtcaaagccaggaccagagccagaagctggactttcctttcccctggccaaaccttgtgtgcacactgtttcttcccctccccaccctgtcaggccattgatgtgatggctccccattcacaccttcatttctcctctttaacgtgaccagggctgttctgaacctccttactttggcctcctctgcccagaacaggtcaggcccctctgcatccatcaaccaggtgtgctctcctgaccattctttgtcagatgggcaccttcactaactcagctctttggattgctttgcagattatgtttgagactttcaatgtcccagccatgtatgtggctatccaggcggtgctgtctctctatgcctctggacgcacaactggtaggtggctgggcgggacagcaagctggttggagcgcactgccagagatgggattgaatggtcgttaacacgtgggggtgacggactggagttgagttagaatggacacggctgaacccagccctaaaagatcttcttctagtgttcaaaataagcccttgatctcatatttctagcagaacttttttctactgttttcctcttcctgttctttactttttttcatcttccccgagccctgtcccacctcacctctcctatcacatgccctgttttctctttttaaataagaggctcggaaattccctctcccccaaggcttccctctacttgtccagcaagtaaccacatgccagctgccatggtgacttatcacgcccaattgtctcccaggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactggtgaggcctgtgggagataagggggagaggggagcagtgtgttgctcagtaacttccaggaccatcctcactatccaaggagatgatgggatgaagttttgcaaatggcaaggcctggctctaatgcacagagcaaagcacatctttctttgctgtgtgaagttgcaaaatgattacactatttccttgaggagaacagttatagacacccagtgttatgcattagtcagtgttgtataattgatctttttttaatcccctccattagcaaatagaagaagattgtgcagagactgaagatggcatggtgtggtgattggcaggagacattgtgataggactcgagtcccaactctgctactcagtagctctgtgagcttggacaagttaaccaaccatagtctctttatttgtaaaatggggataataatagaccctatatcacatgattgttatcagtattaaatggaagaacgcatgtggaatacttgacatagagtaagcattcaataattgttagctattaacagtgatacttattaatagctaacacagtgacatatgtgtattcagattctaagccggtgcacccagtcctcccttcacaagaggaaagtgtcagcattgccagaaacattgtatgtcctcagtgctggtggctccagctacctgtcctccccttagcaatttggtattgtccaaacatttaggtttctgaacatgcctgaggcttattttatgctccaaatttgaggcttgagacttgaaccctgccaatgttaaagtctccacttgcaatatgaagttgaataattgcattcctcctctgctccctacaaagaatcccaagatgcctctaaaaggttcctagagcctcagatataattaatagcctagaacttcagagagcagaagtctgaaaggtctctccctgcccacttcttccgtatctcgttcagtatgcaccgctgaaaccttctggactaggcctggtcctgagacagcaccacctctttcctggagggtgagaaatgtgccaaaggtttaacctgctatccactggcccaggcaacaggatctcagactttttgaaaattgtgaggcccctgaggagctgattcagcataagatatcctggttaactgaaaatacaatataacaaactttctgtcataaaataattataacacagagtagttatcctgcccacccaccccaaaaaatgttatggtacaaaaggatccgctactgtgtgcctttctctagctagctcattttattcttgttatgcatttcccagacaatgcatgctgagggcctactatgcatgagacactgtcctaggaacagaggtggttccctggtggccctactacgtcattatcattgtggattttggattgcagaatattgaactgacacattttttgatggcacatgtcttgagggagagactgcagtagggcaggtgaatctttgccacctgtgcagaccctaatgtttgccacaatgtttgtatctggttgacagctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcggtaggcaacaaacgcccttttcctgggaaggggagtcattgtcttcttccatatcaagccagcctccagaacatggagacaagtgacggttgccccaagaccaaaagcatttctaaaccagaaaaagggaaagtgccacattttcaaggcgagaagacataatgaggccaggaaaaaggttttcttcctaagaaaacactatctatgttgcagttaagcccaaagcattcatggtgtatgatgaaagaattaaataatgcctgtgctttggagacagcggaaagggtagcaagggtgtgctgaaggctgagaatttgggaatgctgggggagagaaaaatagaagagcactcaaagtgagtctgttcctacattcacattgtcttggagagacaggtttgcatagttgtttacagaggcaggctctgagaggggtgagcctgggtttcagtcttagttctcttgatcttgggaaagtcacttaacctcccaactagtctcctcatgtataaagcggagactgtaatattacttatgtcctaggatggctgtgagaattacaggagatagataaagagcacttagcccactgcctggcaaaagcaagcattcaataattatcagatatcactagtaattaataatcaggtagtgctattgttaacgttatcattacatcacagcactgcagaagatgaaagggcacctagaggttttttgaaaacacctgcgtcagaaattaacaaaagtccagacccccacccccacccaaaaaaaatgttagcaagattggaaaaatgagccttttccaacaggataaaaaatagagtaagtttccctgataatccagccccattagctttgggggctggggcagatgcaacgtagctgttaaatggagacctgggagagctctgaagagttgttgcaacattggctcagcgtggaagctttgcagggaattggaaggcttcatcccttatttaaaccacatggagtgagtagtgagtctattaaaaaatcagtgatacctgttgtagcccacacctcaggatgctgcagcaggccttcctcattagaaggcaggcaggaagacatagagcataacaagacccttttgtctctcagacaggtggttcctagattattatgtcttcccagcctcagtccactgcaagatcatccagatgttcaagtctggtcttccatgtctagcctgggttttactctccacttaaggaccatggcctgtgtctcttttccagggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaaggtactgttcagtgacagacccagtggcaatgccgccagcagtgtcagccctataaccacagataagaactcttcagagactgtattttggtgacatgcaattgtgggttttaggggtaggtaatggacacaaatctcatattttacaggatgtaagtcaatctagttcataagaaaaattgagttactttatataaaatttgatctctatttatccttgtctgtcagctactttcagtagctgcagtcaaagtcaacagagctccccacatgctcatctctctttaaaatatgcattttgttgtttttctcgacacaaaaatagtgcatcatgcatgtaacacattttttaaaaatactgatgacctagacttatttctgaagaacttcaaacactgtagatttaggaggagcttatactcttcctccactactaacctcaatcctgtggccaagaattcaaattttatcctcattcctctgtctagcacatcttttggtacaggtgctcaaaagcacagaatgactctaggatgaccaagctcagtccctgagccacccaggacccctgtatgtggtgtgaatgttgagccctagtgaagggaactcggggattaaatggagataattctttggaggcaaacttaacctgtggctgggtcacttctcaaaggttattatcactctctgaagtcagaaggccacacttgggaccctctgacccatgtcacaggaagtagaggggcaattctagtgcagttcacacacgtgggtatttaaacaaattatctcctctttgcactcccttctgtttttagaaggagtatgcagctaacactagagagtgtgctagactgaaacatgcacactttctctctccatgataggctctggctagtcctgccctaaaagacttcagcatgagagaagagagactgttttccaacagcgtttgtgtttcttggatgccattctgatcagctcttaccccccttacttccacacaagagggaggtgaatgaagccagtagctgggctcactactgagttgatctcatgagggtcgataacagaaagaggctattgctagagttgggcagttcctagttctctaaacttggtttcttgaatagaaattaatgtgaaactctgggccccgatgtaatgagatagtatagagaaccaagaaaaacctaggacaataagatgataacatttggcaaaaatgaaactggatgagagacctatgggaactcccatagaatttgtcataggctgttcttgcgttgctataaagaaatacctaagacttgggtaatttgtaaagaaaagaggtttaactggctcacagttcagcaggctgtacaggaagcatagctctagcatcagcttctggggaggcctcagtctcagaaagcttcgaatcatggtggaaggcgaagcaggggcagacacctcacatggcaaaagcaggggcaacagagagggcaggggtggggggagggtgccacacactttgaaataaccagatttcatgtgaactcggaagaagagctcacttatcaccaaggagatgtcctaagccattcatgagagatccacccacgtgatccaaacacctcctaccaggccccacctccaacacgggggattacatctcaacatgagatttggaggagatatccaaactatactaaattctttacaacttttctgaaaatctaaaattgttccaaaataaaaaggttatttttaaaaccaaaccaaaacataaaaccacctgggagaacccaggtttgaatatcagatctgacactgatataaccggtgttacctgggccagttacttaaactttctcagcctctgtttcctcatatgtaatatgggagtaatttaagacttattcttcaagatgtttatgagaatcaaatgagataatacatgtaaaatgcttagcatagtgcctggcatataattacatgctcagtaaatatcagtactttgtattaagaagtaaatgctcagaagataaagattaaactggttagccagttttcactgttctctgtgcctaaaccattcatttatttaagaaacatgagcatgccttgcaggttaggcctgtgcactgggaaaggccaaccagtgcagcttaagaggcacctattgcaagggaatgtccccagcaggggaccctgagttccccaatgttaaacagagcatctgggtgaaaagtggtagttcacttcaccacgtggaaacacatttgtatactaagtcctagcacaattaaaacttctcctttgaataggctagggtttgtttctacagaaagtgtatcgtgttgaattctgaggcagagttcatggaaatcagaggcattgccagggttcttaagtgggggccatggctggatttggagccaactttcagtttgctcaataatgtggtcgaagagttacaggtgagaaaaacgaatgtgcttactgaagaatttctaaatccatggctccctctggcggtcctgccaagaacatgacacaattaggacacaattggcatctaacagacaagcctgtgtccctgctgaacaagaaactaggccatggtagaacatccaggctctgtcctaccgcactaacgactgcactaatgatgacattaatgaccattctttttcatcttgactgacagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaacttcttgcgttggcctccgatcaatactcgactgataccatttgttaggttgacctcacccgttacaggatggctccctctagtggtccagctgagcacatggcaattaggatggatatgtttctcaggcaaagggtagaatcacattacctgaagtggggagctgcacttcggttctgtaaagaggaataatttgagaatacattggagattttaaaaaataacatggattaaagtgtatcaatgggataatctacagtacctcacaacttgcaaagtgattatattactttacactcataaccccagtactggtaacctgatgggtgaaaagaaaataattacacacacacacacacgtatatatacacatatacacacatatatatgtatgtgtgtgtgtacatatatatatgtatgtgtgtatatatatatatgtgtgtgtgtgtgtgtgtgtgtgtattagagataaggtctcactctgtcacccaggctggagtgcaatgatgtaataatagctcattgcagccttgatgcagccttgaacttctaggctcaagcaattctctcctcttgactttccaaaatgctggaattataggcataagccgctgtgcctatatatcttaaaagtcatatcttgtatattaaaagtcacacacacacatatagatacatttcccatacatatatacatatatatgtgtgtgacttttaatatacaagatatgacttttaatgcatatactatgtattaaacttatatacatatatatacacatacatatatacatatagaaacaggtggtctgacttttatgtttattgagggaaacatggattttttaaaaaacattgagaaacactgccttaaaatctcactacacatctggaccatctgtttcccttctcttgatctatctgtctttgaaaaggatactatggatatattcacgccagaaggaatgagagagagaacaatactttccaaggaccattagcatcaatcatcaggtaagggttttacacatatcatctctcagctgttcttcacaactatctggggaagtattatcagcgcactttataattgaggagacagagattgctctagaaatgcaatgggataggagagctaccaacttccatttggcctgaaaggcacaaagatataaaaaaatactgaccctgctgttcagggtcttagcctcagagcactccttgcccaggctgttcaccatcctcagttgctcccaagctgggagctgcttgccctccagtgcatagtgtgtgtcggaagccactggttgtcctgaggagttaaggtggctctgtctgtggcagcacctcactgcagagacctccaggcccaggactgagtgtctgtttggtctagaaaacccgaactcccctagtcttctctggccctgtaacttgcagataattaggattaataccacaaataataagagctgggatgtactggtgcctgccatgaccagagcctgaatcaagctctttatattaggatcccattttctcctgcaacagccctgtgaattttgcctgactttaaaaaaaaatagagatgggatcttgccatgttgcccaggctggtcttgaactcctgggctcaaacgatcctcccactttttggcctcctaaagtgctgggattacatgcgtgaggcacagcacctggccattactgcctttttacagaagagtaactgaggctagcagcagcccaatgtcatgctgctggcagaagtatcagcttgctccttcttgtgcttggtttccaattcatgtttttagccattaggccagcatttcccaaagaataggctacacggaccaacctcatcggaagctcattttaaatgggtagagccctgggtcacatctaacacccgctgagctagaatctctggagctgaagctggaaacctgaacttcaatcagatttccctggtgattcttatgtacatcaaaatttaa

SEQ ID NO: 13593 - DNA, 104077 bp, Human
  misc_feature (1)...(104077): n = A,T,C or G
aagcttttgcatgtctctatcctagcattcacttgtcacattcatgacatatttgcttgtattacaagatgggactcagccttagtttttgccaaggaccaaaaagcagccaatcccacaatccaaagtgaggtgctatatgcctagacaaaacttgtagagaagaaacaagctggctcctggccatatccaggccattttagtgatggttaagaattcagtcaataaattggaatctaggaaaaataatttctttggagagtgttattagtatgctgtgggcctttcctaccacacagaagagaggtagagggttctttcccattcctcaagcctagcaatcagggctttgatgagctaagagagtctgatctatgcctcttgcagttcaggggacagagcagcaaaaactccagaaggatttaagggccagaaactgtgacaattagccaaagacagtagagcaaagagagctcaaccagctgcattgggagccagctgcgttgccttgacagttcagtgttctaggtttcttttcgtctgagacagagagagttgcagagagagagacagagagaccataccagtttagagccattttaaattccacccaaaaggactttatggaggggcagttattccaactgagagatggcccattcgactgccaggcttggaggtaggagatataagcagccactggaaagaaaacgcatcactcatgtcagagcagtttgctttgcattcctacggggagccttcaaataacccacgtgacagactgtcagccaaacacttgccctggcccaagggagccaacatgagattacctgaaagccagccaagccctttcctgcctcttagaactccagccctcaccttcaccttgggctccagccttagaggaaccagatgcagccgggtgagtgggagaagaggggcagagcttcaggacaggggcatggagaagctgtctgtgcctcgggagcaggcttaagctagtagaagggaaatcttgatctttcaatgaaatctgaaacaagccctgttgtctctggaagtgaccagaaggcattatttggaatataccagaaagatcacgagacgtgtcctagatttcttccaaaggtcaggaagaactttttttcccttgaatataaacttgaagagtgaattagaacaggtaattgggaataagaggataacattttctaatcacagccttgagaccccttgtttaacaatgcctcatgtgtccaatttctctaccagaatgagctctccttaaggtgaaggaccgtcctacccaattttatatcctaaaatattcttagtgtataggcatacaattaaggtctgagagttggagtacatataatggaaatacactatagtttatttaaccctttaggtctcaaatgaattagctccctacgttatcaattccaaaggactgtaaaacaagtacctacatgttgaagagagaaggtatatgcacgttgaagaaagaaaataatttatcaagagtaagtattgaacattgctggtgagattgagttacttttcatttatagtacagctttctccaactattaatctatttatatcttccatatgttctactgataggattttaacttttagcccaactttataagataagcaattaattttggaacatcccttaaatttattttcctctgagatattaaacaaggcctatcaagagaatccaaagttctgttcctagcatgagaaattttagacttggtatgtctctgaggattctttatctctaacttcagactgaggtagactgctataaatattctgcaggcacacatgcacatatacattaccctgagcatttcagggtcccagttgtcacccttgtaaaatgagaggattggacaagttgacgaaggtccccaggtcccacagatttaatctaatcatctctgactactcttggaccattacatttattcaagggagcgaaaggagaagatgtttgaaaaaactgactctgctaatgaggtgagaggttgaatatgtcaaccctaccaattctccagtggctgggtaacttccagagttaatgtctatcattctttttgaactggggcagccctcatctggaatttgtttccaagttatactaaggaatgtgtatgttctatttgttctgagtctcaaatcaagggtttggaagcccccagaatcattgttggagcactgtgccatggagcaccttgaagatccacttccaggtaatggagagaggccttggttgtatagtctgttcagaggactaaccgttcagaacatttttctttgatcgaaactttaaagctcattcgacttaaactgtgaatctgatttttacttccatattattcaatgagaaacagggaaactaattagcctgcttgctgcctctttaattcttgttttctcattagattcatcctgaccatctctcagtttagtgtagttacagcattaaataaatttagtggcaaaatttgtagttaattttatagaagtcaggaaatgcagagtatcaaagagtaaatttatgtaattctatcatcacatgttgctgctattactacttctattagtttgctagagcttccatagcacagtaacacatactgagtgggttgaataataaagtaattgtctatccatcctggaggctagaaatccaagatcaggatgtcagcatggttggtttcttctgatgcttccctctttggcttgtaaatggctgtcttctcccttgctcttcatagggccttttctctgtgtgtctgtgtccaaattttctcttcttataaggacaccagtcatattggattagggcccatcctgatgatctcattttaacttaattgcctctttaaaaaccctgtctccaaatacagtattattctaagatactagaggttaggacttgaacagatgatttgggtggtggaaggacacaatttaacccagaacattactttagtgtatattttttgttattgttattattatactttaagttctggggtacatgtgcacaatgtgcaggtttcatacataggtatacatgtgccgtgttggtgtgctgcacccattaactcatcatttacgttaggtatttctcctaatgctatacctcaccactcccccaaccccacgacaggccccagtttgtgatgttccccatcctgtgtccaagtgttctcatagtttaattcccacctatgagtgagaacatgtggtgtttggttttctgtcctcgtgatagtttgctgagaatgatggtttccaccttcacccatgtccctgaaaaggacatgaactcatccttttttatggctattccatatacaccatggtattccatggtgtatatgtgccacattttcttaattcagtctatcactgatggacatttgggtcggttccaagtctttgctattgtgaacagtgccacaataaagcatgtgtctttatagtagcctgatttataatcctttgggcatatacccagtgatgggatcgctgggtctaatggtatttctagttctagattcttgaggaattgccacactgtcttccacaatggttgaactaatttacactcccaccaacagtgtaaaagcattcctatttctccacatcctctccagcatctgttgtttcctgacttttttttttttttgagacggagtctcactctattgcccaggctggagtgcagtggcacaatctcagcccactccaagctccgcctcctgggttcacaggattctcctgcctcagcctcctgagtagctgggactacaggtgcccaccaccaggccaagctaattttattgtctttttagtagagtcggggttttaccatgttagccaggatggcctccatctcctgaccttgtgatccacccaactcagcctcccaaaatgctgggattacaggcatgagccaccacacctggcctgtttcctgactttttaactatttccattctaactggtgtgagatggtatctcttttttttttttttttatactttaagttttagggtacatgtgcacaatgtgcaggttagttacatatgtatacatgtgacatactggtgtgctgcaaccactaactcgtcatctagcattaggtatatctcccagtgctatcgctccccactacccccaccccacaacagtccccagagtgtgatgttccccttcctgtgtccatgtgttctcattgttcaattcccacctatgagcgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctgtcattgttggacatttgggttggttccaagtctttgctattgtgaatagtgctgcaataaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaagttgcgaaaattttctcccattttgtgggatgcctgttcactctgatggtagtttcttttgctgtgcagaagctctttagtttaattagatcccatttgtcaattttggcttttgttgccattgcttttggtgttttagacatgaagtccttacccgtgcctatgtcctgaatggtaatgtctaggttttcttctaggatttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatggttgtagatatgcggagttatttctgagggctctgttctgttccattgatctatatctctgttttagtaccagtgccatgctgttttggttactgtagccttgtagtatagtttgaagtcaggtagcatgatgcctccagctttgttcttttggcttaggattgacatggcgatgtgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaaggttctttcatttgtttgtatcctcttttatttcattgagcagtggtttgtagttctccttgaggaggtccttcacatcccttataaggtggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaagaagattttgggctgagacattgggattttctagatataccatcatgtcatctgccaacagggacaatttgacttcctcttttcctaactgaataccctttatttccttctcctgactaattgccctggccagaacttccaacactatgttgaatgggagtggtgagagagggcatctctgtcttgcaccagttttcaaagggaatgcttccagtttttgcacattcagtatgatattgactgtgggtttgtcatagatagctcttattgttttgagatatgtcccttgagtacctaatttattgagagtttttagcgtgaagtgctgttgaattttgtcaaaggccttttctgcatctattgagataatcatgtggttttcgtctttggttctgtttatatgctggattacatttattgatttgcatatatcgaaccagacttgcatcccagagatgaagcccacttgatcatggtggataagctttttgatgtgctgctggattcagtttgccagttttttattgaggatttttgcatcaatgttcatcaaggatattggtctaaaattctcttttttggttgtgtctctgcccggctttggtgtcaggatgatgctggcctcataaatgagttagggaggattccctctttttctattgattggaatagtttcagaaggaatggtaccagttcctccttgtacctctggtagaattcggctgtgaatccatctggtcctggactccttttagtgggtaagctattgattattgccacaatttcagctcctgttattggtctattcagagattcaacttcttcctggtttagtcttgggagagtgtatgtgtggaggaatttatccatttcttctagattttctagtttatttgcatagaggtgtttgtagtattctctgatggtagtttgtatttctgtgggatcagtggtgatatcccctttatcattttttattgtgtctatttgattcttctctcttttttttctttattagtctagctagtggtctatcaattttgttgatccattcaaaaaaccagctcctggattcattaattttttgaagggtttttgtgtctctatttccttcagttctgctctgatcttagttatttcttaccttctgctagcttttgaatgtgtttgcacttgcttttctacttcttttaatttgatgttagggtgtcaattttggatctttcctgctttctcttgtgggcatttagtgctataaatttccctctacacactgctttgaatgtgtcccagagattctggtatcttgtgtctttgttctcgttggtttcaaagaacatctttatttctgccttcattttgttatgtacccagtagtcattcaggagcaggttgttcattttccatatagttgagtggttttgagtgagtttcttaatcctgagttctagtttgattgcactgtggtctgagagatagtttgttataatgtctgttcttttacatttgctgaggagagctttacttccaactatgtggtcaattttggaataggtgtggtgtggtgctgaaaaaaatgtatattctgttgatttgaggtggagagttctgtagatgtctgttaggtccacttggtgcagagctgagttcaattcctgggtatccttgttgactttctgtctcattgatctgtctaatgttgacagtggggtgttaaagtctcccattattaatgtgtgggagtctaagtctctttgtaggtcactcagggcttgctttatgaatctgggtgctcctgtattgggtgcatatatatttaggatagttagttcttcttgttgaattgatccctttaccactatgtaatggccttctttgtctcttttgatctttgttggtttaaagtctgttttaccagagactaggattgcagcccctgcctttttttgttttccatttgcttggtagatcttcctccatccctttattttgagcctatgtgtgtctctgcatgtgagatgggtttcccgaatacaacacactgatgggtcttgactctttatccaatttgccagtctgtgtcttttaattggagcattgagtccatttacatttaaagttaatattgttatgtgtgaatttgaaccagtcattatgatgtcagctggttattttgctcgtcagttgatgcagtttctttttagtctcaatggtctttacattttggcatgattttgcagcggctggtaccggttgttcctttccacgtttagtgcttccttcaggagctctttaagggcaggcctggtggtgacatttgcttgtctgtaaaggattttatttctccttcatttatgaagcttagtttggctggagatgaaattctgggttgaaaattcttttctttaagaatggtgaatattggcccccactctcttctggcttgtagagtttctgctgagagatccgctgttagtctgatgggcttccctttgtgggtaacccgacctttctctctggctgcccttaacattttttccttcatttcaactttggtaaatctgacaattctgtgtcttggagttgctgttctggaggagtatctttgtggcgttctctgtatttccctaatctgaatgttggcctgccttgctagattggggaagttctcctggataatatcctgcagagtgttttccaacttggttccattctccctgtcactttcaggtacaccaatgagatgtagatttggtcttttcacatagtcccatatttcttggaggctttgttcatttctttttattcttttttctctaaacttcccttcttgcttcatttcattcatttcatcttccattgctgataccctttcttccagttgatcgcatcagctcctgaggcttctgcattcttcacgtcgttctcgagccttggctttcagcttcatcagctcctttaagcacttctctatattggttattctagttatacattcgtctaaatttttttctaagtttttaacttctttgcctttggtttgaatttcctcctgtagctcatagtttgattgtctgaagccttcttctctcaactcttcaaagtcattctccatccagctttgttccattgctggtgaggaactgcgatcctttggagaaggagaggtgctctgctttttagagtttccagtgtttctgctctgttttttccccatctttgtggttttatctagttttggactttgatgatggtgatgtacagataggtttttggtgtggatgtcctttctgtttgttagttttccttctaacagagaggaccctcagctgcaagtctgttggagtttgctagaggtccactccagatcctgtttgcctgggtatcagcagcggtgtctgcagagcagtggttttttgtgaaccgtgaatgctgctgtctgatcgttcctctggaagttttgtctcagaggagtacctggccatgtgaggtgtcagtctgcccctactgggggatgcctcccagttaggctgctcaggggtcaggggtcagggacccacttgaggcagtctgcccgttctcagatctccagctgcgtgctgggagaaccactgttctcttcaaagctcagatggaaatgcagaaatcacccgtcttctgcgtcactcacgctgggagctgtagaccggagctgttcctattcggccatcttggctcctcccccatgagatggtatctcattgtggtttgatgtgcatttctctgatgaccagtgatgatgagcattttttcatgtgtctgttggctgcataaatgtcctcttttgagaagtgtctgttcatatcctttgcctactttttgatggggttgtttttttctcatgaatttgtttgagttctttgtagattctggatattagccctttgtcagatgggtcaattgcaaaagttttctcccattctgtaggttgcctgttcactgtgatggtagtttcttttgctgtgcagaagatctttagtttaattagatctcatttgtcaattttggcttttgttgtcattgcttttggtgttttagacatcaagtccttgcccatgcctatgtcctgaatggtattgcctaggttttcttctaggatttttatgattttaggtctaacatttaagtctttaatccatcttgaattaattttcgtataaggtgtaaggaagggatccagtttcagctttctacatatggctagccagttttcccagcaccatttattaaatagggaatgctttctccatttcttgtttttgtcaggtttgtcaaagatcagatggttgtagatgtgtggtgttatttctgagggctctgttctgttccattggtctatatctctgttttggtaccagtaccatgctgttttggatactgtagccttgtagtatagtttgaggtcaggtagcgtgatgcctccagcttcattcttttggcttaggattgtcttggcaatgcgggctcttttttggttccatatgaactttaaagtagttttttccaattctgtgaagaaagtcattggtagcttgatggggatggcattgaacctataaattaccttgggcaatatgaccattttcaagatattgattcttcctacccatgagcatggaatgttcttccatttgtttgtgtcctcttttatttccttgagcagtggtttgtagttctccttgaagaggtccttcacatcccttgtaagttggattcctaggtactgtattctttttgcagcaattgtgaatgggagttcactcatcatttggctctctgtttgtctgctattggtgtatagaaatgcttgtgatttttgcacattgattttgtatcctgagactttgctgaagttgcttatcagcttaaggagattttgggctgagacaatggggttttctaaatatacaatcatatcatcctcaaacagggacaatgtgacttcctcttttcctaattgaatacactttatttctttctcttgcctgattgtcctggccagaacttccaacattatgttgaataggagtggtgagagagggcatctctgtcttgtgccagttttcaaagagaatgcttccagtttttgcccattcagtatgatattggttgtgagtttgtcataaatagctcttattattttgagatgtgttccatcaatatctagtttattgagagtttttaagaaaaagtgctgtcgaattttcttgaaggccttttctgcatccattgagataatcatgtggttttttgtcactggttctgtgtatgtgatggattatgtttattgatttgcgtatgttgaaccagccttgcatcccagggatgaagccaacttgatcgtgttgggtaagatttttgatgtgctgctggatttggtttgccagtattttattgaggattttcacacgggtgttcatcagggatattggactaaaattctctttttttgttgtgtctctgccaggctttggtatcaggatgatgctggcctcataaatgagttagggaggactccctctttttctattgattgtaatgattccagaaggaatggtaccagctcctctttgtacctctggtagaattcagctgtgaatccatctggtcctggactttttttggttggtaggctattaattattgcctcaatttcagagactgttattggtctattcagagattcaacttcttcctggtttagtcttgggagggtgtatgtgtccaggaatttatccatttcttctaagttttctggtttatttgtgtagaggtgtttatagtattctctgatggtagtttgtatttctgtgggatcggtggtgatatcccctttatcattttttattgtgtctatttgtttcttctttcttttctctttattagtcttgctagtggtttctcaattttgttgatcttttaaaaaaaacagctcctggattcattgattttttgaagggtatttttgtctctctttcaattcttctctgatcttagttatttcttgccttctgctagcttttgaatttgtttgctcttgcttctctagtttttttaattgtgatgttaggatgtcaattttagatctttccagctttctcttgtgggcatttagtgctataaattttcctctacacactgctttaaatgtgtcccagagattctggtacattttgtctttgttcttatggtttcaaagaacatctttatttctgccttcattttgttatttacccagtagtcattcaggaacaggttgttcagtttccatgtagttgtgcagttttgagtgaatttcttaatcctgagttctaatttgattgcactgtggtctgagagatggtttgttgtgatttctgttctttcacatttgctgaggagtgctttacttccaactatgtggtcaattttggtataagggcaatgtggtgctgagaagaaagtgttttctgttgatttggggtggagagttctgtagatgtctattaggtctgcttggtgcagagccgagttcaattcctggatatctgtctaatattgacagtggggtgttaaagtcttccatcattattttgtgggagtctaagtctctttgtaggtctctaaggacttgctttatgaatctgggtgctcctgtattgggtgcatatatatatttgggatatttagctcttcttgttgaattgatcccttatccattatgtaatggccttctttgtctcttttgctctttatttgtttaaagtctgttttatcaaaaactagggctgcaacccccgcccttttttttttttttttttttttttttttgctttccatttgcttgctagatcttcctccaatcctttatttttgagcttatgtgtgtctctgcatgtgagatgggtctgctgaatacagcacactaatgggtcttgtttctttatccaatttatcagtttgtgtgttttaattggggcatttagcccatttagatttaaggttaatattgttatgtgtgaatttgatcctgtcattatgatgttagctggctattttgcccgtttattgatacaatttcttcatagcatcgatggtctttactatttggcatgatttgcagtggcttctaccagttgtttctttacatgtttagtgcttccttcaggaactcttgtaaggcaggcctggtggtgacaaaatctctcagcatttgcttatctgtaaaggattttatttctcctttgcttatgaatcttagtttggctggatattaaattctaggttgaaaattcttttctttaagaatgttgaatattggcccccactctcttctggcttgtagagtttctgctgagagatcaactgttagtctgatgggcttccctttgtgggtaacccgacctttctctctggctgcccttaacattttttccatcatttcaaccttggtgaatctgacaattatttgtcttggggttgcttttctcaaggaatatctttgtggtgttgtctgtatttcaggaatttgaatgttggcctgccttgctatgttggggaagttctcctggataatatcctgaagagtgttttccaacttggttccattctcccgatcactttcaggtacaccaatcaaatgtagatttggtcttttcatagagtcgcatatttcttggaggcttcgttcatttctttttactctttttttctctaaccttgtcttctcactttatttcattaatttgatcttcagtgactgatactctttcttccacttgatcaaatcagctactgaagcttgtgcatgcatcacgaagttctcgtgccatggttttcagctccatcaggtcatttaatgtcttctctacactgtttattctacttagccatttgtctaacttttttcacggttttcagcttccttgtgatgggttagaacatgctcctttagcttggagaagtttgttattaccgatttctgaagcctacttctgtcaactcatcaaagtcattctctgtccagctttgttccattgctggcaaggacctgcaaacctttggaggagaagaggtcctctggtttttagaattttcagcttttctgctctggtttctccccatctttgtggctttacctaccttggtctttgatgttggtgacctacagatggggttttggtgtagatgtccttttgttgatgttgatgctattcctttctgtttgttagttttccttctaacagtcaggtccctcagctgcagatctgttggagtttgctggaggtccactccagaccctgttttcctgggtatctccagtggaggctgcagaacagcaaatattgcagaacagcaaatattgctgcctgatccttcctctggaagctttatcccagaggggcacctgcctatatgaggtgtcagttggctcctactgggagatgtctcccagttaggctacatggggttcagggacccacttgaggaggtagtctgtccattctcagagctcaaatgccatgctgggagaaccccttctctcttcagagaaggcagaccaggatgtttaagtctgcagaagtttctgctgccttttgttcagctatcccctgcctacagaggtggagtctatagaggcagtaggccttgctgagctgtggtgggctccacccaggtcgagcttcccagccactttgtttacctactcaagcctcagcaatggcagatgcccctctcccagccaggctgccacctcacagttcgatctcaggctgttgcactttctccatgggcatgggacctgccaagccaggcatgggagagaatcttcttgtctgccggtggctaagacctcgggaaaagttcagtatttgggctggagtgtcctgttattccaggtacagtctgttgcagcttcccttggctaggaaagggaaatcccctgtccccttgcacttcccgggtgaggctatgtcccaccctgcttcagctcaccctctgtgggctgcatccactgtccaaccagtcccagtgagatgaaccaggtacctcagttggaaatgcagaagtcccctgtcttctgcattgatagtgctgggagctgcagactggagctgttcctattcagccatcttggaacagagcaccactttagtgtatattcttatatacctcaatcatacacaaatatttttactttacaaaattagaccatgcatcagattatgctatggtttgaatgtatatgacaaaattcacatgttggaagcttaatccccaatgcaacagtgttgggtggtgaggcctaataagtggtgaatggattagtgtagttatcacaggagtgggtcagttatctctagagcagcactctctcccccatgtgctctcttctgccttccattataggatgatgcagcacaaaggcttttctctgatgctggccacatgttcttggacttcccagcctccagaacagtgagctaaatttccgttcattaaaaattactcagtctctctgtctcagagcacaccgactgactgttgatgtgtgtaacaaagtgtttattttcttcaaataaccagctctataataattctttatgtttccagaagtctgtttagctttcttcaaaggaagatttttctcatttggggggttttcttgattttagggtggtaagatttctttcttttttccttttctcctaaaatcaatgcaggtgagagtggatgggtaaaggattttgtttttaaacagcatgttaggtatacttgtgtgggtggaagtgttgttagtatttttctatgaatcttgattaatactgtctattagctctcatggctggtcagcaaaatgcgtgaatgtttagctgtagaacatatgacacagttgagtcttttttttttaagaaaagtgaacacagaattgaaggaattaacatgtacatgttgccttttgttagaatgactaagttaaacctcttgatttttatttgtccaaggcaaacatgacataaggattatgcactaccaaaataacactcatggtcacagaaactatgctgcaagcacacctggggttcttttaaatggtcatggccatgatggtgtgaattccatcaattcagcagatgggtggggaaatgaaaattttcctctaaacttttaggcaaaggtaggctttttttaaattgtgggttttttttttttttattatttttgccttcatttttaaatcttaaatgctactactgcaggccacaacatgacaaacaatgagcagctaaagaaacaatgaaaaagcatttaaaaaaactcctgtgttagctaacaggtttctagaggtatcactgtggtccacagagaagactgcagaaggtagcagaaagatgttgtattaactaccacagccttaaaacaaagttggtatatctttggatcataaaattgttcctaggcagcttattttattttttggttaatcaaataaacaagaggtttgtttcatggcaaatattaaataaacaatatcctagtctcaggtattctgttatagtaacagaaaataaaagagataacataaattaatatattaaatttaaaattttaaatgtgaaacattcatctaatatgcttaaaggttgaatgccaactcattatataaataaaaccttcatactacagagtgcttcacattgtaaaatatgatgtatgtcttagtttaatcccagggagggtgataataacaatactagataatattaaaaggcaaatgatggaaaacacactcaaagggggaaaagtccatggtaatttcaaatctacatgaagcaaccctgaaatatacttcttaactcaccaaatctgagcatttattacataattggctcttagcccaggggccagggcttcaagtgaggaaagaaacaaggtccctggcctcatggagcttccacactatggtgtaagcaaagacagtgacaagcaagcagataagtaaaattgtagactaggctaaacatgagggaagggaaaacagagccatcaaagaggaacacacaggactggcttagggaggccagggagcctttcgtgaagaagaggcctttgagctgagacccaaagccaagaagggccagccacttgaacagccaagcagattggtcacagggccactcttcttcctggttaaacaagaagagttggacaggctcaagcactgatagaaggcaagcggggctggaacatggtaggcaatttggtttccctttgtgaaaatcagggactagaactttggtaaacaagacctcaagtgtgggtgagagagtgggaaaatagacaatgctcatattaaacatttcaaaatatatcactgacatttcaccgaagaagacctacagatggcaaataatcacatgaaaagatgcccaacaccattaatcattcggaaagttcaaaataaaaccacaaaatgtagcactgtacaccgattggaacagcttaaattaaaaaatgctgatgacactaagtgctgtgggaatgctgagaaactaaacaactcatacattactgatggggatgtaaaatgatacagccactctggaaaacagttttgcagtttcttaaacatgcaactgggcacagtgactcatgcctgtttcccagcattttgggaggctgaggcgggtggattaattgagctcaagaattcaagaccagcctgggcaacatggtgaaaccccatctctacagaaaatacaaaaattaaccatgtgtgttggtttgtgcctgtgatcccagctacttgggaggctgaggtgggaggatcacttaagcctgagaggtggaggttgcagtgaaccaagatcatgccactgctctctagcctgggtgacagagtgagacacagtctcagataaaaaaaaaagaaagaaagaaaagaaatgatagacacttgaatgaatgacattcaagtgaacgtgctttagataactccagctcccagattttgtaaagccaccttcaaacttgcaacagtttggcagtttctttttttattattttttattttatttttatactttaagttttatggtaatgtgcataacgtgcaggttagttacatatgtatacatgtgccatgttggtgtgttgtacccatcaactcgtcatttaacattaggtatatctcctaatgctatccctcccctatccccccaccccacaacaggccctggtgtgtgatgttccccttcctgtgtccatgtgttctcattgttcaattcccacctatgaatgagaacatgcggtgtttggttttttgtccttgcgatagtttgctgagaatgaaggtttccagcttcatccatgtccctataaagaacatgaactcatcctttttcatggctgcatagtattccatggtgtatatgtgccacattttcttaatccagtctatcattgttggacatttggtttgttccaagtctttgctattgtgaatagtgccgcaataaacatatgtgtgcatgtgtctttatagcagcatgatttataacccttgggtatatatccagtaatgggattgctgggtcaaatggtatttctagttctagatccctgaggaatcaccacactgacttccacaatggttgaactagtttacaatcccaccaacagtgtaaaagtgttcctatttctccacatcttctccagcacctgttgtttcctgactttttaatgattgccattctaagtggtgtgagatggtatctcattgtggttttgatttgcatttctctgatggccactgatgatgagcattttttcatgtggcttttggctgcataaatgtcttcttttgagaagtgtctgttcacatccttcgcccactttttgatgggcctgtttgtttttttcttgtaaatttgttggagttcattgtagattctggatgttagccctttgtcagatgagtagattgcaaaaatgttctcccattctgtaggttgcctgttcactctaatggtagtttcctttgctgtgcagaagctcttcagtttaattagatcccatttgtcaattttggcttttgttgccattgcttttggtgttttagacatgaagtccttgcccatgcctatgtcctaaatggtattgcctaggttttcttctagggtttaaatggtttcaggtctaacatttaagtctttaatccatcttgaattaatttttgtataaggtgtaaggaagggatccagtttcagctttctacatatggctagccagttttcccagcaccatttattaaatagggaatcctttcctcatttcttgtttttgtcaggtttgtcaaagatcagatggttgtagatatgtggtattatttctgagggctctgttctattccattggtctatatctctgttttggtaatagtaccatgctgttttggttactgtagccttgtagcatagtttgaggtcaggtagcgtgatgcctccagctttgttcttttggcttaggattgacttggcaatgcaggctcttttttggttccatatgaactttaaagtagatttttctaattctgtgaagaaagtcattggtagcttgatggggatggcattgaatctataaattaccttgggcagaatggccattttcacaatattggttcttcctacccatgagcatggaatattcttccatttgtttgtatcctcttttatttccttgagcagtggtttgtagttctccttgaagaggtccttcacatcccttgtaagttggattgctaggtattttattctctttgaagcaattgtgaatgggagttccctcatgatttggctctctgtctgttattggtgtataagaatgcttgtgatttttgcacattgattttgtatcctgagactttgctgaagttgcctatcggcttaaggagattttgggcagcgacgatggggttttctagatatagaatcatgtcatctgcaaacagggacaatgtgacttcctcttttcctaattgaataccctttatttccttctcctgcctgattgccctggccagaacttccaacactatgttgaataggagtggtgagagagggcatccctgtcttgtgccagttttcaaagggaatggttctagttttcacccattcagtatgatattggttgtgagtttgtcataaatagctctcattattttgagatacgctccatcaatacctaatttattgagagtttttagcatgaagcgttgttgaattttgtcaaaggcctttcttgcatctattgagataatcatatggtttttgtcattggttctttttatatgctggattacgtttattgatttgcatatgttgaaccagccttgcatcccaggaatgaagcccacttgatcatggtggataagcttcttgatgtgcttctggattcagtttgccagtattttattgaggatttttgcatcgatgttcatcagggatattggtctaaaattctctttttttgttgtgtctctgccaggctttggtgtcaggatgatgctggcttcataaaatgagttaaggaggattccctctttttctattgattggaatagtttcggaaggaatggtaccagctcctccttgtacctctggtagaactcggctgtgaatccatctggtcctggactttttttggttggtaagctattaattattgcatcaatttcagagcctgttattgtctattcagagattcaatttcttcctggtttagtcttgtgagggtgtatgtgttcaggaatttatccatttcgtctagattttctagtttatttcatagaggtgtttatagtattctctgatggtagtttgtatttctgtgggattggtggtgatatcccctttaacattttttattgcatctatttgattcttctctcttttcttctttattagtattgctaatggtctgtcagttttgttgatcttttcaaaaaaccagctcctggattcattgattttttgaagggttttttgtgtctctatttccttcacttctgctctgatcttagttatttcttgccttctgctagcttttgtatgtgtttgttcttgcttctctagttcttttaattgtgatgttagggtgtcaattttggatctttcctgctttctcttgtgggcatttagtgctataaatttccctctacacactgctttgaatgtgtcccagagattctggtatcttgtgtctttgttctcgttggtttcaaagaacatccttatttctgccttcatttcgttatgtacccagtagtcattcaggagcaatttgttcagtttccatgtatttgagtgtttttgagtgagtttctttattattattattattattattattattattatcattattatactttaagttttagggtacatgtgcacaacgtgctggtttgttacatatgtatacatgtgccaagttggtgtgctgcacccattaactcatcttttagcattaggtatatctcctaatgctatccctcccccctccccccaccccactacagtccctggtgtgtagtgttccccttcctgtgtccatgtgttctcattgttcaattcctgtgagtgagaacatgcggtgtttggtgggttctagtttgattgcactgtggtctgagagacagtttgttataatttctgttcttctacatttgctgaggagtgctttacttccaactatatgctcaattttggaataggtgtggtgtgatgctgaaaagaatgtatattctgttgatttgggatggagagttctgtaggtgtctattaggtccacttggtgcagagctgagatcaattcctggatatccttgttaactttctgtctcattgatctgtctaatggtgacagtggggtattaaagtctcccattattattgtgtgggagtctaagtctctttctaggtctctaaggacttgctttgtgaatctgggtgctcctgtattgggtgaatatatatttaggatagttagctcttcttgttgaattgatccctttaccattatgtaatggccttctttgtctcttttgatctttgttggtttaaagtctgttttaccagagactaggattgcaacccctgccttttttgttttccatttgcttggtagatcttcctccatccctttattttgagcctatgtgtgtctctggtacgtgagatgggtttcctgaatacagcacactgacgcgtcttgactctttatccaatttgccagtctgtgtcttttaattggagcatttagcccatttacatttaaggttaatattgttatgtgtgaatttgatgctatcattatgatgttagctggttattttgcttgttagttgatgcagtttcttcctagcctcaatggtctttacaatttggcatgtttttgcagtggctggtaccagttgttcctttccatgtttagtgcttccttcagtagctcttttagggcaggcctggtggtgacaaaatctctcagcatttgcttgtctgtaaagtattttatttctccttcacttatgaagcttagtttggctggagatgaaattctgagttgaaaattcttttctttaagaatgttgaatattggccccactctcttctggcttatagaatttctgccgagaaatcagctgttagtctgatgggcttccctttgtgggtaacctgacctttctctctggctgcccttaacattttttccttcatttcaactttggtgaatctgacaattctgtatcttggagttgctgttctcgaggagtatctttgtggcgttctccgtatttcctgaatttgaatgttggcctgccttgctagattggggaaattctcctggataatatcctgtagagtgttttccaacttggttccattctccccgtcactttcaggtacaccaatcagacgtagatttgatcttttcacgtagtcccatatttcttggatgctttgttcatttctttttattcttttttctctgaacttctcttttggcttcatttcactcatttcatcttccatcactgataccctttcttccagtcaatcaagtcggctactgaggcttgtgtattcatcatgtagttctcatgccttggttttcagctcctttaaggagttctctgcattgattattctagtttgccattcatctaatttttttttaggtttttaacttctttgccatgggtttgaacttcctcctttagctcagagtagtttgatcgtctgaagtcttcttctctcaaatcatcatggtcattctccatccagctttgctccatttctggtgaggagctgtgttcctttggaggaggagaggtgctctgatttttagtttccagtttttctgctctgttttttccccatctttgtggttttatctacctttggtctttgatgatggtgaagtacagatggggttttggtgtggatgtcctttgtgtttgttagttttccttctaacagtcaggaccctcagctgcaggtctgttggagtttgctggaggtctacgccagaccctgtttgcctgggtatcagcagcagaggctgcacaacagcagatattggtgaacagcagatgttgctgcctgatcgttcctctggaagttttgtctcagaggagtacccggccatgtgaggtgtcagtctgcccctactgggaggtgcctcccagttaggctactcaggggtcagggacccacttgaggaggcagtctgtccattctcagatgtccagctccatgctgggagaaccactactgtcttcaaggctatcagacagggacatttaagtctgtagaggattctgctgccttttgtttggctgtgccctgcccccagaggtggagtctatagcggtaggcaggcctccttgagctgtggtgggctccactcagttcgagctaccaggccgctttgtttacctactcaagcctcagcaatggcgggcacccctcccccagcctcgctgccaccttgcagtttgatctcagactgctgtgctagccatgagcaagggcccatgggcataggaccctctgagccatgcacgggatataatctcctggtgtgccatttgctaagacctttggaaaagtgcagtattagggtgagagtgacccaattttccaagtgccatctgtcacccctttctttgattaggaaagggaattccctgaccccttgcacttcccaggtgaggcaatgtgctgccctgctttggctcatgcttggtgcactgcaccctctgtcctgcacccactttccgacactccccagtgagatgaacctggtacctcagttggaaatgcagaaatcacccgtcttctgcgttgctcatgctgggagctgtagactggagttgttcctattcgaccatcttggttccacctggcagtttcttaaaaacaaaaacaaaagacatgcaactaccatatgacctagcaattgcactcctgggcattcatcccacatgaacactatgttcacacaaaaacctgcacatggatgtttctaatagcttcatttgtaacagtacaaacctggaaacaatccagttgttctttaactgatgaatggctaaacaatggcacatcatacatgaaatactacccagaaataaaacgaccaaattattgatatactcaacaacctggataaatctccagagaattatgctgagtgaaataaacaatttaaacatcttacatattgtgtgattccacttatgtgtcattgggagaaacagtgaaatgcacatgagatctcttaatactttcttaataattgtcagatctctttctgggtattatttcagttgaatatgaatctacaatgatctaaaaataaagtttaattttaaaatacacctctgagaacagtgtttgtgttgggatcaatttcaaacaggtgatacacagcagaagtccatttagtgcaggcctcaggtgtgccacttaatctctcatctcctgccttcacacctgcaaaatgttggggttggaccataaagaagcttcaggacctcctctttgcttctacaattccatgaccttactgagctatacacatttgtggaacctttgttttggccttatatttatcagagaccctctgaaaatctttatggaaacagcagtaactacctttctggcattacaacaaaagaagtaaattctgccttccaccctcctgaaaactgctttgcatgctacagcaagattactggaattacaaaaggagaaacaccaagcatggctttttcatggctaaaatgatccccaaattcacagtgtcctcacaatgtcctcttccacaaagaaggaacttcttccagacacacacaatttgatcaagttaatagtttcttaaaaatattcagatctcttttttagaaactgggggaagaactgggggcctttaggaactctgttttgcattcaatattcaatcattcattcattcatttatactgtaagccctggaggtgccctcagttgtgacatacttctttcttgacatttttataaattcttcaatgtattccttcccttataggcgtaccctttccagttgagccatgcttgtatatacaaacttagtcctcaaatctcaatcttgcgacccattgtattttccaaagatgactgcaaaatcattctcatcccacatgctgttcttacaatgcaactttgacattcttaccatgaagtgatggagactatgtttcctccccttgaatctgagcagagctaatagcacatgttggaagtgacatatgcaacttccaaagatagggcataaaaattccatgtgcatccacctgcttcttggtgatactcactattggaacccagctgccatgctacgaggaagcccaaactcacccaatttaccaaggtaaggaggctacatggagaggctagccatagatgttttgaccaaccactcagctgaagtctcagccaacaaataactagatcagctgatagacattcaagtgaatgtgcctttagataacttcagctcccagatgtaaagccaccttcagcatttgagtgccagataagattctaaacattgtagagacaagccatcctcactatgctgtctgaattcctgtcccacaaaagttgggtgtggaattgatcataataaaattattattttataccactaaatttagaatactttgttgagcagtaatagataactatgattatacttgatagaataaacaccctaacctcactcccctccctctctcaatcttctgctggtgctccccattggccaaacccaactggaatccagaaagaaaggaagcccagtgatgtaacccatataagtcagcttttgggggcaggaaatagagtggagtgtggagctggcaaaactggcagatatccagtgtagtttacactctgccttatttcattgacgatgtaaagtagatggcatgaaagttgaaatgcctaaattttgatcattatggaataaataataaataccaatcatttaatcatccttttcagataaatctgtgaaatgaggtgttccgaagcatagttaacttttaacttcccttttgggtgtggctccatcatgaagaagaagcagagtttaatcactaagagtataggttctggagccagtctgcctgggttcaaatcctggctctgctaccaaccagctgtataaatttgggtagctcccttatcctctctgtgtttcacttccctcatctgtaaggagggataaaaatattgcctcccttataaatttgttgtggagatcaaattagttaataaagataaaacatttagcatggtgctgggtaagagtaaatactccataagcattagccattattataacacctagaagaagattacaaggtgcaaagtgtggcaaagaaacaagaggaaaagtggcaaaatatctttctttttggctttattttcttctgaaaaatagcaatagctgattcaactatctctgatgcttagaaattctttaaaaagaatgactttatcaggatagaaaaaggttcaagagtgagtacagtaggtaagaaggaaaaaaagctatctcatttttttatgaactagaggtgtgatctgttgagttctcatgaaccagtgagacattattagagcatattatctttgaagtaggtctattactttggtcttctcttcccagcttccattcaaaaaattaaaatccaagacaatggttctataaacaacctctagataaatactattagtagcaatgacattcaaggagaaaataaaagacatattcaaattgtgttatgaagagtttattaaacggaatatttataaaaacatgagcaaggcataaagaaagaaactgcaagggatagtttattactctgggactggcagctataagagtactactgcaacccctagacctgaaggtacaagagtacagagtcattggctaaacctggagggaaagctgtatgaacacgactgcagagaggagctgtgtgtggcattagttgtagagatgcagctgattcacataaggagcaagccaggggaaatcaatatcccaacctacctctccatcacacctccagcttgttgtcagagctccctattggggaaacctaaagaagccagagagaacaaaagtggttattgaactccatacagggtacagagcaaagcagagaataggtctggaggggcaatggaagatatagtgaggagcatgcttcagtaatgtgttggataacagtcatccatccccatgggcttggttagaagattccaagtatttagctaagttctaaaatgttttctattacagagtgtgtaatggatagcaattttgtttggttttgttttactgtgttccatgtcccagcatccatttgaggtttttgtgcatgtgtgataatagcactccagttttcctttgcataatgactcttcctccattcttaacccatgcagttgttgtgggtctgactccactctatggatcctagggtagacatgtgattcaatttggccaacccaagcattttctcctctgtctagagggatgaactcttgatccaaatcaacccagtgagcttcagtcctgaagctattgcttcagaaaagggtatctttctttctgttgcagtttctaagcttatagaatctaagcccaaagttagagccatctctgcccccagagagtaagaatctgagaacacagacaacagagagggaagcagagatcagtgatggagaaactgagtcccagagtcccagtggaattgatggaacaccttgaacccactgtgcctaaaaccaagatacctctggatattttagttgtctttttcctacctcagcaatgagaagtctttgggttgcaatgagagaggaggcaggaaggtgcctcagttcatgactacataggctactctggaagctttcacaaaaagagactgcctcagagctctgtttctgctcagtctcatgaaagagttgtggtttttttttgtttgttttggtttggttttttttttaatcagtgaagaatgactcattatttatcttgagggtgtaacaatgaattgttgtaagatttattcaatgtcttgtctttttttttttttttttcctacagctgtggactcttccaggaaagaagaaatcagaaaacatcaccttttctccacacccaccctcaacttccacttctgtactatagaagcaaaattgattaggctggctaatttgaagagaaaaagatgataggggctttgtgctttagaggtagaagagggtaatagtcaggttcactctgacaaagcccactagagatggtagacccactggtagaaatggctacctggatacccaaggagagcattaatcatcccatctcatatctgagctcagtactgggggaggggataatcaggtctcaccaaacctggcagccttccactgtacgtgtgggcaaagaccaacagcagtggtgttggtggtggaagttatccaagtcacatggcaacaagatatgttatcggcagccaatccatttgggtctgtagcaacctcaattcttgtctcctcagaggaatgaatttgaggggcataaggcagaaagagctctaggcaagttttagaacaagagtgaaagtttattaagctttagagcaggaatgaaagtgtacttggaagagggccaagtggacagcttgaaagactagtgcacagtttgacctaatttgaccttttttttttttttttccttttgaaatggagtctagctctgtcgcccaggctggagggcagtggcgtgatctcagctcactgcaacctctgcctcctggctcaagcatttctcctgccttagtctactgagtaactgggattacaggcatgcacccagagttagggtatcctggctcccagtgaagggactggccaattaattttagtcataaaaactacacacccagctaattttttgtatttttaatagagacaggggtttgccactttggccaggctggtctcaaactcctgacctcaagtgatccgcccatcttggcctcccaaagtgctgggatcacaagcatgagccactgcacctggccccagtttgaccttttgacttgaggttttatacattagtgtacttccaaggtcctgcatcccttctcctctaattcttcccttggggtgggctgtccgcatggcagtggcctgctagcacttgggagaatgcacagtgtgtttactggagttgtacacatgctcacttgaggcattcttcttttaccagttgaatgtccctggaaggtcatatgccagttaaactccaccattttaatgtgcttgcttgaacccgctcacccaattcctgagatctttttgggaagctgctgatcaccagtttcaggtgtttatatttattaggggattgccgttccctggtgccagctgcaaccaattattatttcagcgagacagttaacaaccgccttaccatcacctgatggctgcctgacattcctggtgtgtgtggtgggggtagggggggaatccctatcctgctcagctcctatctgactagctacctactgtaatagtggcatccaaaagtgactcaaaaccaagagtctctattattgtccttgaccattgggtcagaagggccataaaaacagggagatgctgacagttgtatcaatcttgatgaaggaagaaattaacttcatataattatttttagaaaaatagacacgatattttttatgttcagtattatagattgattatctctgttaactttatgtaatttatatgccagatacctaaggtatctaataatagtacaagatagaaaaaatttttatacacttcatgagggttctgcaagacctaactgtggtatttacaagaaatatgccataaatacattttttaataatttcaacttttattttggattcagagagtacatgtgcaggtttgttaccctggtatatggcatgatgttgagttttggggtatgattgatcccatcatgcaggtactgagcatagtacccaatagttaatttttcaactgctgcctccctgcctccttcctccttcctctagtactccccaatgtctgttgtttccatctttacgtccatgagtacccagtgtttagctcccacttgtaagaagtgacagcatgtggtatctggtttgctgttcctgtgttaatctacttaggataatggcctccagctctatgcatgttgctgcaaaggccacaatgtctttctttttatggctgtgtagtactctatggtgtatatataccatattttcttcatacattctgccactgatggacacctaggctgattctatgcctgctattgtgaatagttctgtgatgaacatgcaagtgcgtgtggttttttggtataaaaatttattttcttttggaagtaatagggttgctgggtcaaacagtagttcctttttaagttctttgagaagtctctaaactgctttccacagaggctgcactaatttacattcccaccaacagtgtagaagccttcccttttctccacagcatcaccatctgttagtttttgacttttaatagcagccattctgactggtgtgagatggtatctcaatgtggttttgatttgcatttctctgatgatgtgatgttgaacatttttttcatacgtttgttggctgcttgtatgttgtcttttgagaagtgtctgttcgtgtcttttgcccattcttaatggggttattttctttttgcttgttcaattgtttaagttccttatagattctgtatattagacctttgttggatgcacagtttgtgaatatttctctcattctgtaggttgtctgtttactctgttgttagtttcttttgctgtgcagaagctctttagttcatttaggtcccagttgtcaatttttatttttgtttcaattgccttggaggacttagtcataagttatttcccaaggctgatgtccagaatggtggttcctaggttttcttccaggattcttaatttggggtcttacatttaaatctttaatccatgtttctttcttatgcatatggctagccagctatcccagcaccatttattgaataggaagtcctttccacattgcttatttttgtcgactttgttgaagatcagatggctgtaggcgtatggctttatttctgggttctatattctgttccattggtctatgtgtctgtttttgtaccagtaccatgttgttttggttactgtagccttattgtgtagtttgaagtcaggtagtgtgatggctctggcttttttctttttgcttaggattgctttggcaattcaggcttttgttattgttgttccaaatgaagtttagagtagttttttctagttctgtgaaaaattaaattggtagcttaatatgaataccattgaatctgtacattgctttgtgtggtatggccattttaatgatattgattccaatcatgagcatggaatgtttttccatttgtttatgacatctatgattactttcaggcggtgttttctagttctccttgtagagatctttcacctacttggttagattattcctaggtgggtttttttgtggctattgtgaatgggattgtgttcttgatttggttctcagcttgaatactatttgtgtatagaaatgccacagatttctgtatattggcttttgtatcctgagattttactgaggtcatttatcagctccaggagccttttgaaggagtctttaggattttctaggtatagaatcatatcatcagagaagacagatagtttgacttcttcttttcctgtttagatggcttacattttttctcttgtctgattgctctggcttagacttttggaactatgttgaataggtgtgatgagagtaggtatacttgtcttatgccagttctcaaggggaatgcttccagtttttgctttttcagtataatgttggctacgggtttgtcatagatgactcttattattttgaggtatattcctttgataccaagtttgtttaaggtttctactctgaagggatttttggtctaattgagagttttttctgtgtctattgaaatgagtgcaaggtgtcttagtctgttctcatattgctatagcagtaccaaggggaaaatccactctcatgatccaatcaccttccaccaggccccatctccaatactggggattacaattctacaagagatttgggtggggacacagatgcaaacaatatcatgtggtttttgcttttaattctgtttacgtggtgaatcacatttattgatttgcatgtgtggcacaaatcttgcatcccaggaatgaagcctacttgatcatggtgaactaacttttttaagtgctactggattcagtttgctggtatttacttgaggatttttgcatccatgttaatcagggatattggcctatagttttctttctttgttgtgcctttgccaggttttggtatcagggtgatgctagctttgtagaattagttaggaaggaatctctccttaattttttgggaatagtttcagtgggattggtagcagcttttctttttaggtatggtagaatttggccatggacccatttggtctagggcttttctcagttggtaggttttttattactgattgtattttggaactcaatattagtctgttcagggtttcaatttctgcctgattcaatcttgggagattgtgtgtttctgggaatttacacatttcttccatattttctagtctgtatgcatagaggtgttcataatagtctctaagggctttttgtatttctgtgagattggttgtaaggtcacttttgtcatttctggttgtgcttatttttcctgtttttttcattttttattaatgtagtctagtgtctatcaatcttgttgatcctttcaaaaaaactgcttttggtttcattgattctttgtatggatttttggatctcaatcattcagtactgctctgagtttagttcttttcttctgctagctttggggttagctcattcttgtttttattattcttatagtgtgctgttagataggtaatttgagatctttccaactttttgacataggcatttagcactattaactttcctcttaacattgcttttgctgtatcccagagattttcattgtgtctctgtccatctttatttatttcagagaatttttgaatttctgtcttacttttgttgtttacccaaaagtcatataggagcaacttgtttaattttcatgtaattgtgtgatttgaaaagatcatcttggtatttatttctatttttattccaatatggtctgagaaaatggttgttatgatttccattttttattttattttttaaattattatactttaatttctagggcacatgtgcacaatgtgcaggtttgttacatatgtatacatgtgccatgttggtgtgctgcacccactaactcgtcatttacattaggtatttctcctaatgctatacctcaccactcccccaaccccatgacaggtcccggtgtgtgatgttccccaccctgtgtccaaatgttctcattgtttaattcccacctatgagtgagaacatatggtgtttggttttctgtccttgcgatattttgcgagaatgatggtttccagcttcatccatgtccctacaaaggacatgaactcatccttttttatggctgcatagtattccatggagtacatgtgcaacattttcttaatccagtctatcattgatagacatttgggttggttccaagtctttgctattgggaatagtgccgcaataaacgtatgtgtgcatgtgtctttatagtagcatggtttataatcctttgggcatataccaagtaatgggatggctgggtcaaatggtatttctagttctagattcttgaggaatcaccacactgtcttccacaatggttgaactagtttagactcccaccaacagtgtaaaagtgttcctatttctccacatcctctccagcacctgctgtttcctgactttttaatgatcactattctaactggtgtgagatggtatctcattgtggttttgatttgcatttctctgatgaccagtgatgatgagcattttttctgtgtctgtaggctgcataaatgtgttcttctgagaagtgtctgttcatattctttgcccactttttgatggggttgtttgattttttcttgtaaatttgtttgagttctttgtagattctggatattagccctttgtcagatgggtagattgcaaaaattttctcccattctgtaggttgcctgttcactctgatggtagtttcttttgctgttcagaagctctttagtttaattagatctcatttgtcaattttggcttttgttgccattgcttttggtattttagtcatgaagtccttgcccatgcctatgtcctgaatggtattgcctaggttttcttctagggtttttatggttttaggtctaacatgcaagtctttaatccatcttgaattaatttttgtataaggggtaaggaagggatccagcttcagctttctacatatggctaggcagtttttccagcaccatttattaaatagagaatcctttccccatttcttgtttttgtcagatttgtcaaagatctgatggttgtagatgtgtggtattacttctgagggctctcttctgtttcactggtctatatctctgttttggtaatagtactatgctgttttggttactgtagccttgtaatatagtttgaagtcaggtagggtgatgcctccagctttgttcttttggcttaggactgtcttggcaatgcgggctcttttttggttccatatgaactttaaagtagttttttctaattctgtgaaggaagtcattggtagcttgatggggatggcattgaatctgtaaattaccttggacagtatggccattttcatgatattgattcttcctacccatgagcatggaatgttcttccatttgattgtgtcctcttttatttccttgagcagtggtttgtagttctccttgaagaggtccttcacatcccttataaggtggattcctaggtattttattctctttgaagcaattgtgaatgggagttcactcacgatttggctctctgtttgtctgctattagtgtataggaatgcttgtgagttttgcacattgattttgtatcctgagactttgctgaagttgcttatcagcttaaggagattttgggctgagatgacggggttttctaaatatacaatcacatcatctgcaaacagagacaatttgacttcctcttttcctaattgaataccctttatttctttctcctgcctgattgccctggccagaacttccaacactatgttgaataggagtggtgagagagggcatccctgtcttgtgacagttttcaaagggaatgcttccagtttttgtccattcagtatgatattggctgtgcatttgtcataaatacctcttattattttgagatacatcccatcagtacctagtttattgagagtttttagagcgaagggctgttgaattttgttgtaggtcttttctgcctctattgagatcatgatgtggtttttgtcattggttctgtttatatgatggattacatttattgatttgcatatgttaaaccagccttgcatcccagggatgaagccaacttgatcgtgttggataggctttttgatgtgctgctggatttggcttgccactatcttactgaggatttttgcatcaatgttcatcactgatattggtctaaaattctctttttttgttgtgtctctgccaggctttgttatcaggatgatgctggcctcataaaatgagttaaggaggatgccctctttttctattgattggaatagtttcagaagtaatggtaccagctcttctttgtacctctggtagaattcggctgtgaatctgcctggtcctggacttttttggttggtaggctattaattatcacctcaatttcacagcctgttattggtctattcagggattcaacttcttcctggtttagtcttgggagggtgtatgtgtccaggaatttgtccatttcttccagattttctagtttatttgtgtagagttgtgtatagtattctctgatggtagtttgtatttctgtgggatcagtggtgatatcccctttatcatttttattgcatctatttgattcttctctattttctttattagtcttgctagcggtctattttgttgatcttttcaaaaaaccagctcctggattcattgatgttttggagagattttgtgtctcttatctccttcagttctgctctgatctttgttattccttgccttctgctagcttttgaatgtgtttgctcttgcttctctagttcttttaattgtgatgttagggtgttgattttagatctttcctgctttctcttatgggcatttagtgctataaatttccctctacatactgctttacatgtgtcccagagattctggtgcattgtgtgtttgttctcattagtttcaaagaagatctttatttctgccttcatttcattatgtacccagtagtcattcaggagcagattgttcagtttccatgtagttgtgcagttttgagtgagtttcttaatcccaagtactaatttgattgcactgtggtctgagagacagtttgttgtgattgctgttcttttacatttgctgaggagtgctttacttccacctatgtggtcaattttggtataagtgcactgtggtgctgagaagaatgtataatctgttggagcattctgtagatgtctgttaggtctgcttggtgcagagctgagttcaattcctggatatccttgttaattttctgtctcattgatctgtctaatgttgacagtggggtgtttacatatcacattattattgtgtgggagtctaagtctctttctaggtctctaaggacttgctttatgaatctggatgctcctgtattgggtgcatatatatagttaggatagttagctcttcttgttgaattggtccctttaccattatgtaatgaccttctttgtctcttttgatctttgttggtttaaagtctgttttatcagagactaggattgcaacccctgctttttttttgttttccattttcttggtagatcttcctccatccctttattttgagcttatgtgtgtctgtgcacttgagatgggtttcctgaatacagcacactgatgggtcttgactctttatccaatttgccagtctgtgtgtttaaattgggcatttagtccatttacatttaaggttaatattattatgtgtgaatttgaccctgtcattatgatgttagctggttattttgctcatcagttgatgcagtttcttcctagcattgatggtctttacaatttggtatgtttttgcagtggctggtacaggtttttcctttccatggttagtgcttccttcaggagctcttgtaaggcaggcctggtggtgacaaaatttctcagcatttgcttgtctgtacaggattttatatctcatttgtttatgaagcttagtttggctggatatgaaattctgggttgaaaaaaaattttttttaaggactagaatagtgtttaatatcaatttctgagaaatcacatttatataaaagaaataaaacaggccagcagaagtccaaaaaagattcagcttacattattgcacttggatgaaatatgctatttagagtagcataatattcaggccaggccaggaggagaaagagacaaatggagaggacaaacctccaggtagtatttattctggattccaaactctcctgcggcctaaacagtatttagtctattggaaacattcagcaaggtctttacaaaaatgactgcagtatcttcaacacatttgagttgcactcatactttgttccagtcatgtgcaagtttaatgcacagctctacctcacaaaatgggacatctatgacaccagaacttccctgtgcccaaggtcatggacaggaggggaaggcagtgaatttctactttatgcatattttagggagcaatactgtggctatcatttacccttttgagcaatcttgattttggtcatttataattagtacatgagaaaaagtgacagtgaatacaagtgagtactaaccgaattcctcggctggtactagaaaataatcttttcgttaagaatgtggaatattggcccccattctcttctggcttgtagagcttctgctgagagatccactgttaatctgatgggcttccctttgtgggtaacccgacctttctctctggctgcccttaacattttttccttcatttcaaccttggtgaatctgacaattatgtgtcttggagttgcccttctcaaggagtatctttgtggtgttctctgtatttcctgaatttgaatgttagcctgcattgctaggttggggaaggtctcctgggtgatatcctgaagagtgttttccaacttggttccattctcctcatcactttcaggtataccaatcaaatgtagatttggtcttttcacatagtcccatatttcttggatgctttgttcatttctttttactctttttttctctaaacttctcttctcacttcatttcatacatttgatcttcaatcactgatatcctttcttccactggatcgaatcagctactgaagcttgtgcatgtgtcacgtagttctcgtgccacggttttcagctccgtcaggtcatttaaggtcttctctatgctgcttatcctagttagccattcttctaatcttttttcaaggcctttagcttcctttcaatgagttagaatatgttcctttagctcggagaagtttattaccaatcttctgaagcctagttctgtcaactcatcaaagtcatcctccatccagctttgttccattgctggcaaagagctgccatcctttggaggagaagaggtgctctggtttttagaattttcagcttttctgttctggtttctccccatctttgtggttttatctacctttggtctttgatgatggtgacctacagatggggttttggtgtggatgttcttttgttgatgttggtgctattcctttctgtttgttagttttacttctaacagtcaggaccctcagctgcagttcttttggagtttgctggaggtccacttgagcccctgtttgcctgggtatcaccagcagaggctgcagaacagcaaatgttactgcctgatccttcctctggaagcttcatctcagaggggcacccagctgtatgaggtgtcagtcagtccctactgggagatgtctcccagttaggctacttgggggtcagaaacccacttgaggaggcagtctgtctgttctcagatctcaaactccatgctgggagaaccactgctctcttcaaagctgtcagactgggacgtttaagtctgcagaagtttctgttgccttttattcagctatgccctgcccccagaggtggagtctacagaggcaggcagacctccttgagctgtggtgggctccacccagttcaagcttcctagctgctttgtttacttagtcaagcctcagcaatggcggacacccctctcccagccttgctgctgcctcacagttcaatctcaaactgctgtgctagcagtgagcaaggctctgttggcatgggatctgctgagccaggcacagggtataatctcctagtgtgccacttgctaagaccattggaaaggcatgttattagggcaggagtgtcctggttttccaggtatggtctgtcatggctttccttggctaggaaagggaattccccaaccccttttgcttcttgggtgagatgatgccccaccctgcttcatcttacactcagtgggctgctcccgctgtccagccagtcccaatgagacgaacccagtatcccagttggaaatgcagaaatcatctgtcttctgcatcactcctgctgggagctgtagacgggagctgtagactggagctgttcctattcagccatctgggaacaatcccaatttccctttttttaaacttactgagccttgttttgtggccaagcatgtggttgatttaagaatatgttctatttgcagatgagaaaaatatataatctgtagttgatgggaggagtattctgtagatgtcctaggtccaattgatcaaatgttgaagttcacaatttctccgttagttttctgccttgatgatttgtctgatgctgtcagtagggtgttaaaattccccaatattattgtgtctatgtctaagtcttttcataggtctagaactacttgttttatgaatctgggtgctccaatgttgggtgtgtatatatttaggatagttaagtcttgttgaattgaatcttttatcattatgtcatacccttctttgtccttttttactgttgttgttttaaagtgtttatctaatatctaaagtattatctaatataagaatagtaacacttgcccttttttgttctgtttacataacaaatctttctctgacatttactttgagctttggggtttccttatgtgtgagatagatctcttgaagacagcagacacttgggtcctgtatttttattcaacttgccaccctgtgccttttaagtggggcatttagaccatttacattcaaagttaacattgatatgtgaagttttcatcctatcatgaagttagctcgttgctttgtagtttccattgtgtggttggtttataggttctgtgggctatgtactttagtgtgttttgtggcagcaggtatcattattttgtttccatgtttaaaattcctttgaggctctcttgaaggttggtctagtggtaacaaattcccttaatgcttgcttgtctggaaaaggattttatttctccttcacttatgaagcttagtttggtgggataagaaattgttggctgcaatttcttttctttaagaatcctgaaaataggccaccaatctctcctggcttgtaaggtttctgctgggaagtctgctgttagcctttgtacatgatctgagcttttcctctagctgcctttaagtcttttctttagtattgaccttggacagtctggtgactacatgccttgatgacactcgttttgtatagtatgttgcaagtgttttctagaatgtctacctctctagcaagataagggaaatgttcttgaattgttccctgaaatacgtttattttctttttttccatttctctcaggaatgtcaataattcataagcttggttgctatacataatcccatgtttctcaaagactttgtttattttttaaattcttttttctgtatttttgtcttactgagttagttcaaaagactagtcttcaagctctgaaattttttcttctacttggtccagtctattgctaaagctttccattgtattttgaaattccttaagtgagtttttcaattccagaagctctggttgatttctttttaaaatatttatctcttccttcatttcctggattccctttgaagtttctttgtgttgattttcaaccttatcttgtatctcattgaacttcctaacaatctatcctttgaattatttatctgtcatttctgagtttccattttggttagggtccttcgctggagaggtagtgtgatactttggtgtcactacattcagatttttcattgtgccagaattcttgtgtcagttccttcttacctagagatgctagcacttctaatatttgtaattattttcatgtgggtaggattttttgtttttctttctttccctataataataacatttttttccctttcctttccccgacttcctagggaatgtgactgtagagaatcctaggtagggtcctttggctttgcttctatagtcctgtgcatttctgtcagcaggttttattttactctgtgcagttcaaactacaagccatagatggcacttatgggtaagagccagctgtggccagtacagctgggtatatgtgtgatccttgtttactgagagaagctctctgttgcctcaggaaatgggcttatttatggggttcacagtggtctgagctccctccttacccctggagaggcagggggcaagatgtgtggggctggaccaggcaggtctggacctacaggtcccctgatggcagacacaagcaccagcactgaggggagaatccagtggccagccaccaagccctcagagatatgcctaggcatgaagctgggaagcctcctcaaccccaagttctctgcatggggatggcgatggcctaaacttctgatccaacagagtgcatgctgcaggtgcctggagatctgcctgggggtaaaacagagagggtcccactgcaccataatctacgtacaggaagcatgaggtggctgaggctgttgatccaggccagggggtactctgaatacctagggatctgcatgggcatggagcagagaaggccccgctgcaccaccatctatgcccatgaagagtgcggctgctcaggctgctggtccaggcaaggggatggtactctgattgcctgaattttggcttgggggtggagtggaaaggggccctactgcatcacggtcttagggtagcagattggtgtacccagcaatgacacatacacacctattccaggtcaccagctggccctagctgtaagattcgttgtctgagagaaactatagctgtagcagctctcttcctgctccaggtctgtgatgggggagagcaaaattccagcacctactgctgaggtacttttcacagttctggctgtggaagcttctacccaactccagagcatgtgctccaatctgtggcccaggactgaagttcctgagcagccatgctgctgggttgccaaagaatggcagactttgtatgtgcctgggttaaaaatggtgtcctgccctcagttccaggtctggaaaaatgcttacagcttttctcagtgtctttccctcatagcaccttcaagcctttccccagtatagctccagggcctgggaaaacaaagtgctctcccttggcctgaattgcttggatccccagtggaaaggtgagtcacagagataggctctctgcctctcttgtgtactggtgcttcactcactttaatcagccccatgtcatcacaggggctgtttgcccaccccttctcctccctgggatctggggtttcctttgtgattctagtggattcccattttccttcttgaaatgaagctcaaagagttgatctttgtgtactaccttgctgtttccgagtggatgaggcatgctgaaagcctctaatccaccatcttggaaaaaataaatttttttttaaaaagcaaaatccaaatatgtaggataaacaaattgaaatatctagtgtacaatgtaaggactatagttaatagcgtattgtatttgggattttgctaaatgagtagactatggctgatgccacatggaagaggaataggtaactatgtgagatgatagaaatgttcatttgctccactgtagtaaccattttacaatatatatgtattttataatatcgtgttgtataccttaaatatacacaataaaatttatttttttaaagaaaccaaccagaacagttccccagatttactcatgaagttattctctttctccaccaccaaccaacagcattccctcatcaattgtgtgctctatttttttggcagccaatgcatgagtagtgagattattattatataataaaataatatgttcaaatttttaaaaaacagatagtttaaagaaaaagggaaaattattatagcttgtaaacatttaccttaagaaaactagagtgatgtttcaggacaagaaataatactagagataaagagaaatgtcttatgatgataacagagtatttaatcaagaatgcctcataaatgtgcatgtatctaattacagagcttcaaatatacatgaagcaaaagctgacaaaagagaaataagcccacagtaatacttgggaatttcaaatctcttctctcagtagttggtaaaacagaaaactcagtaagaatatagaagaatggaatagcagtatcaaccaacttgatctagatatttacagaacaacatttctaggatgctccatggaacaacaataacatatacattattttcagatgcacatggaacactcatcaaggcaacatatatgcaggattatagtctaaacaaatttaaagcactaaaacaatatagactgtgtcctctgactacaaaagaatcaattagaaattaataacagatattgaaaaatccacaaatgtttggagattaaacatctctaatcatgtattatagatcatatcacaaagaatatgaggatatatttttacctaaataataattaaaatacaatacatcataatttgtaggatacagctgaagcagtgattgggggaaatttagagctttaaatgcttacattagaaaggaataaaagtctaaaattaatgatacaaaattttacattaagaagctaaaaaaacagaagaacaaattgaacccaaagtaagtaagtagaaggtaagaaataaaaatatgaataaaataaatgaaatttgaaaatatttaattaacaggaaaaaaaccaatgaaaccaaaagcagattctttgaaaaattgttgtttctaattagaccaagaaaaaaaggatatgagttactaaattcaggaatgaaagaggagacatcactgcaggcattaaaaagataaaagtggactattatgaacaaatgcatgcaacaaattgaataacttagaggaaatgggcaaatttattgaaagacataagctaccaaaattaacataaaaagaaacagggaaacctaatagcactgtatttattaaagaaatttaatgtgccaaagtaattaaaagtagaaaagatttttcattaaatagtgcttgaaccactggatgcctatgtgaaaaaagcatgaacttcaactcttacctcacagtaaatgcaagactaattataaatagaatagagacctaaatgtaaaaataaaaattataaaatgtttacaacaaaacataggaaaatgtcttcttaaacctggagcagacaaagatttcttagatatcacataaaatatgaaagaataatattaaacattccatatttcaaaagtcacctttaaaaaataaaacaagccccaacagatttgttgtttgtgttacttttatctgatgaaagacctgtatccagaatatataaagaacatttacaacttgataatgaagacaacacagttttaaaattgggtaagtcatttgacattttaaaaagatgagaatgatcaatatatgcatagaaagatgttcaacattttcagccataaagttaaagccacattgatatatttttacatacccatagaatggctaaaaataaaaccaaataactgagaatgtcatgggtgaggttatggagccactgaaactctctcatatattgctgagacaaatgtagaatggtacaaccactttagaaaacagttgaacagttccttacttatttacactgccatgtatctgtcaattctattcctacatatataccaatgagaaataaaaacatacatccattcagagacttatacacaaatgctcatagtagctttattcataatatcctaaaactagaaacaacccaaatgtccataaacaaatgaatggttaaacaaattgtggtatatcattacaatagaagactatttcataataaaagacaacagactattgatatacagagtgtggatctcaaaaacaatgctgagtgaaggaagccagacacaaaagaatacatgctgcataattccttttatgtgatattttagaaaaaggaaaactaacccatagtgacagaaaataggtcagtagttacttgtgtctggtggttgggggtggtattgacaataaagaggcctaaaagaacttttcaggataatggaaatgtcctatagcttgatcggggtggtaggtgcacaaatgtatacatgtgtcaaaactcaaactgtatatttaaaatgtacacattgtatgtatattaaacctcattaagattgatttatatatcattgtgataatcttacaaaatactaaaatataaagtttaagaaatggtttatattttcaaaatataaaatatgagaaaaattcaaagatgaatccagaatattaggtccacaatccaagaaaatgggaaacaagattgggcacagtggctcacacctgtaatcccagcacaagcccctgaagtccggggtttatgcccagcctgggaaacatagaggagcttgtccgtacaaaaaaaattaaaatatcagccaggcgtgggggcacacacctgtattcccagccactcaggaggccgagaggaagatcacttgagcccaggagttcgaggctgcagtgatttatgatcgtgccactgccctccagcctgggctgcagagtgagacccaaaagactgtctctaaaaaataaaagagagagagagagagaaaagaaaaatgggaaacaaggagagaaaggaagaaacaaaacaaacaaaatcccattattttcctgagtataaagaaaacagaaatcttcagtttcaaatgttgttgatttattcattgaattcattgattacttggttctcttatacttccattgtattaataacagggccacaacgatgtttcaggtctctaagtaccaattttaactcagtctcctttccttagttcacatttgtttgtgtaaatggcctgtggaaaggctaggggaatcatcccagtgtacacttgcaaggctgctgcagggggcctggaacctggccttttcatccatctttggcctctggaaactggacaatggatcatgactatatattgaagaaactgccgtcaacctcccaatcaggcatccttgatttattttactcatgtagatggaatcatacccttcttggctgcccttctagtttttcctcagggacactgttttctattaatcagctccacaattctctgcaagtcagatccattcattacattttgtccttgcattaagataattgccattacctggcttctgatgagtaagaaccaccacctgttttctattgtgtgcattgagcggggcaggtcctgttatcagtaagcccaggtctttagtggcattttctactgacagcctggcctgctgaggagtgctggcactgaacttcttactgatgctggagcttctcacaccaggaaaattcttattgcttcagtaacacagatggctagtgggctttccagccttacacagcatactcaccctggtatgtgtacttctctgagccttttattcttttctaccatctaccttggcaactctggtatttaccttactgagtgtgagctattgacctttccatgcctctaagagccatcttaggggtgtgtttgcaccatctctttgtgtccttgctagaatttcaagtcgcataccctagaagagtctcccaaactgctaaattctcttttcaaacaacatgctctgacaccttgatccagaacccttagaaaccaatactatctatactcttctagttcttgtttataaaaaatggctaggtcctgaagttcctttatcacttctaagatgcctctggctgtttttgcagcaacttaaccctaggtataggcccatggccaagtatgtaggtggcccttgatcctgagatgggcacctgttatcttgaaaaggaaaagcttctgcattgcctttgagcaaggggagagggctaacccttactagggaggagtgaactacttctaatttttttttttaaggagtctccctgtgtcacccagattggactacagtggagcaatctcagctcactgcaacctctgcctcccaaattcaagcaattctcccacttcagcctcccaagtaactgggactacaggtgtaagtcaccatacttggctagtttttgtatttttagtagagatgaggtttcaccatgttggccaggctgatttcaaactcctgacctcaggtgatctgcccgccttggccttccaaagtgctggaattacaggaatgcgccaccgcactcagctggagtaaaccacttctgtaggaatcagaggaaaatgaagattcaagatatggggggcatcaactgcaatgttcccataccacgtgtcagggtcttatttttactcaacaaaggccctgaccctggcatagcaggtctgcctatgttatgagttgaacctcctttgggattcattactcttattttctgggcttgatcctcaacttttttggaccttctgtgaaggaaacaagagcttcttcttatgctactaaggagaactctgcctttcacccctagcttatctttttattcaaggccttaattgagcttggtgaagccacccgattctattgcctctctagttagtattttcctcattatttctccaatgtcagatatcagcattttcttccaccagtataccatccaacttcatcaactgtgattgttttaacaactaaacaaccatctcacgctgggattgtatgtcctctgcctaccaccagcagtaccttctgccacagattggactctctaggaagcagactctagataaagactatcatatagaaggtttatcaggaggttcccttggctccaacacctggggaagaaaggggactgaggggagagaggggaaagaaggagactgggcagaggaagaaattgagatatgatgcagactaaataaagcttcagttgaccctttggccatttctgaaaatggaatgacccttcagagatattcctaattggggtgagaaggctgagcctttatactcccatgttaaacagtcattggatgtggacgaccttgagaagggtggctgtcttcacctggaggcactcccagtagctggggcaatagcttcttcattctggggagagtttgaacacattacagctatcgcacagcaaccatccacctctttcttccattcaaggactaaatatgccgtgtgtgtgtgtgtgtgtgtgattgaaagtaaagtaaaacctgacactctggccaggcgcagtggctcacacctgtaatcccagtattttgggaggccgaggcaggcagatcacgaggtcaggagatcgagaccaccctggctaacattgtgaaaccccgtctctactaaaaatacaaaaaattagtcgggcatggtggcgggtgcctgtagtcccagctactcaggaggctgaggcaggagactggcgtgaacctgggacacggagcttgcagtgagcagagatggcaccaatgcactccagcctgggtgagagagcgagactccatcacaaaaaaaaaaaaaaaaaaacctgacgctcaatgtgctttccaaatatcttggagctccagtgaccccttcacttcctagaacttcctagtcataaacacttctgtgaccacagcaatgaggttgttttctttctttttcttttttttgttggtctttcttttttgttttggatatgttaatacttactatttatcaaacatttactatgagccaggccctgtgcaagggtatatatatggataatctttcatgaatgatctcatttaatcatcacttcaattctattttgtaaacttgagtaagcctttagtaagaaaatagagattgaggttgaattgtgtttccaagtcacgctactagttcttattggaatctgtgtggaacccagatctgactccaaagtcaatcttagtaatgacactgcaattggccacctgcttctttatctccaactgcctcagccaaaggtcaacaggtacactgtaggccactgttcttgatcaagccctgttccctgcagcatacattcctaaacaatgccttttgaggtacaacttatagaatcattttattaaagttctgatcttttttctatacattcccactgtgttcaaacctaagactcagctgtcctcccaggctcaattgaagtctcctttctagctgtacttttcttaggtattccagaccagaatagcctcccagtgcctaacaaagctttcccaccagtgagaaggatttagccacatttttactgcttagtatcttcatatatgtttctgttcccttcaacagattgtaaacatcacgcacggtctttcacaccactaccctatataatgtattgtacataggagacatttagaagcagattacattaattttgtattaatgtcatgaattacttagtgatatgcccttgggctctcttctgtttcctcattctctaataatgatataatttttatattttcttaggtttcccatgatgctgaaatccttatctatcctatatatttgtcactctgcacttcctctcttgcatagctctgtcctgggaaccccaggcagttaagtttattagtgatgattaacacaagctggttatgttccatttaaggctaacagttctcatggttataattaaactttttctgttttaggtacaattaaacccacagattaaaccttatattttccagggaaaatattgtatgatctattgtacctagtgactaaagtgaaattttagaatggtttgaaaccttgctgcaaaaagtgtggtccatggaccaggaacagcagtgttacctggaggcctgttagaaatgtagaaaattgtcccccacccagatatgcaggatcagaatctgcattctaacaagatctgcaggtaattcctatcaatatttaagtttgagaagttctactttaaaaaataatttaatggcagctctatataaaagtggttctccattagtgcctaccatgggccagccacatgtttgatgcttcatacagttctaattatcccaacagtcctgaaggtgctatttctgtttacagatgaaaaacctgatacttagaggctaacttagccaagatcgttctgcttataatcagtagtgctgatcttggagtgtagcaccatctgcttcgaagactatctttcaggctttctgttgcagatgcagcagatgctctcagagcctgcctatatgtccctgccccttagcattccagagtgcaggggctggactggtccttgcctcccctgcagcagtgagaggtgatggtgtgctggcagcccttgcagcccttgcccactctcagcacctccttggcctcggtgcacactctggcagcacttgaagagcccttcagcccaccactgcactgtgggagcccctctctgggctggccgaggctggagctggctccctctgcttgtggggtgatgtggagggaaaggcgcaggtgggaacctgggctgcgcccagtgcttgtgggccagcacaagttctgggtgggtgtgggcttggtgggccctgcacttggagcggcaagcagtgaggagcttagcacctgggccagcagctgcggagggtgcgccgggtcccccagcagtgctggcccaccagggctgcgctcgaattctcgcggggcctcagctgcctccctgtggggaaggcctcaggacctgcagccctcccggcacaagccttcccaccccctgcccaccgctgcccccacccccccatcactgcagccccccgccccgcctacagccaccccaacccccaccccaccatgggctcctgcgaggcctgagcctccctgacgggcaacgccccctgctctgctgcgctgggtcccatcgactgcccaagggctgaggagtgcgggcacaaggcacgggattggcaggaagctccacctgcaccggggtgcaggatccaccaggtgaagccagctgggctcctgagtctagtggggacgtggagaacctttatgtctagctaagggattgtagacacaccaatcagtactctgtgtctagctcaaggtttgtgaatgcaccaatcagcattctgtatctggctaatctggtggggacttgaagaacttttatttctagctaagggattgtaaatacaccaatcagcactctgtgtctagctcaaggtttgtaaacacaccaatcagcactctgtatctagctaatctggtggggacttggagaacctttatgtctagctaaaggattgtaaacataccaatcagcaccctgtgtctagctcaaggtttgtaaatgcaccaatcagtgatccgtgtctagctaatctagtggggatttggagaacttttgtgtctagctcagggattgtaaacgcatcaatcagcactctgtcaaaacggaccaatcagctctctgtaaaacacaccaatcagctctctgtaaaatggatcaatcagcaggatgtgggtggggccagataagggaataaaagcaggctgccagagccagcagtggcaacccccatgggtccccttccacactgtggaagctttgttctttcactcttttcaataaatcttgctgcttctcactctttgggtccgcactgcctttatgagctgtaacactcaccacgaaggtctgtagcttcactcctgaggccagtgagactagaaacccaccagaaggaagaagctccaaacacgtcagaacatcagaaggaacaaactccggacgcccctttaagaactgtaacgctcaccgggagggtccgcagcctcattcttgaagtcagtgagaccaagaacccaccaattccagacacagcagttctcaagcaaagaccgatgagagttagtgtctaaattccctggctcccttggcgctcaggtgagataattttgtgctgtgtttacactacagcttacagtttccctgcgagattaatgtccaatgtactaatctggaagctggcttaataatgcaccttttattaatcccacctcatctctacttccctgcatttcttagacaccataattaaatccttatctcaggctccacttctggggagaccagcattaagatagcagaagagtaaccttggctgctatgagaaattcctcataccacaagaaaagaagcactgaaaagtgaacaattaacttctcttgaatacaatgagtataacactctcaagaatagtgggatcttcttatgagactgctgacagatgaaagatgagattctatgacgtttattaaaatgaagaattacaggggaatatacagaaaaacagagttaacttcttcctcataggaattctcctcctcattgttagaatatattgtcttttttatataactgtcttctatgggaggaatgaacaggtgtctttgggacatacatactttctatgcctcaaatcttcatgtataaaagtgagggaaaactcgttgtgtaaatgaagtatctcatcctgtctgtggcataaagtttttccatatgctgatgtttgtactcagggccagtttcgagggcatgtgacagacggccctgcacttggtttgatactctgctgtcactaccttgaaattcttaataattgtgaacaagacaccccacatttttattttgcaccagatcctggaaattatgaacccggtcccatttgtattaattaaaaactctttgaagtacgaattttcatgatacaagcaagagaagtcaggttaaaagaatggtaagaggaagagcaaagtagctttcaggaaaactagatccaacaaaagctggagtttctagaaacttctggcagttatgaaagatttgctgcagagagagtgggaggaaagccgtggtatcaggacgttctgtactacttctgaaatgtacatatgcagaggagcaggcacagatgggatggctaagacagcaagtttgacttggagccagcagggaaagttcaagtgacccaggaaattagaagcaaaaagaatgagccacttgaactagctgttctgcattaggcaaacaaacagattctgttcctgattgttcctgatgatatccagcatttaccaaacatttactctgtacctggaactgttaaaaagggacttatagtcatctcatttaatctgacaacaaccctttaaggcatgtgctattattgttcctataccaccagtgaagaaagctaggacaaaataagattaaatcattgcccagggcacctagcaagtgctggagcctggactttaaccctgacagactgtggagcccaaactcttaattatgacatatagctcccctaccaagtaaaatggctctccactctaaaaggcatgatggagcagatattgtgcggaaaggaccccagtggagaagtgaaaagagaaaggctgtgtccctgtggtgcaatcctttgtggagcaaagttccccatttcttcaggggtaggggttagggtgggggcaaccaaacataaacatccacagaccttggggagcccacacggggttttcctggacccattttgcttcacaagcacattttccatggattttcattaggctgtgtcagagtgtcagtggtcttcaaactgttctactgatcccttggttcaacttttgtagctcaactgtcttccacaatgagagggaactgaatggaggggctcaggctcctgcttcacttgcacagcttccctttcacttattttcatctgaatatagggattatggataaaaatttgtttgcaaaaagaagatgaggttctacagctaaaaatacactataaaaaccattgctctgggcagtcacttcaactgggagaagacgaataagctgtaggcagatcacagggctcttgcacacacattcctccctctcctcccccaaacacaactcagattcaacctgggtcagtgaagaaaggctaatactggtatttggtgtttgtagaatcttgggcagaaagtatttgaatcttctctatgccacagacttgttcactaactgtgagtttgtttctcacttaagaacagtttttaaacatacagtgttttcatcaggaaaatatatatatatatttgcagggtcaattcagacgcctttacaataatagtggttctgaccttcctttcaggtaggagccagaattaattgttctttcctctgctttcctgcagcaaccaacaattatttgaatatctatcaagtgtaaaacagggtgatcctgccctcaaaggactcaccgtctagtagtaaaaggacctaaataattcctgtgcctgtcatgacgatggtcactttctacctcatgttacagaggcaataggaagtgcagacagctgaaggacatggaaaaaaaaattgatggaagaatggcagccaggtttggccttaaagaaactgcatttccctaggtggatgtgtaattagttttccaagagaagatgatataatagctacacaaaggtagcaatagcataaacaaatcctacaaaccttgaaaagtcacctttgaggataggaacctggttttctaatatttcccttgaggcctctctcatctcacatgctcttcaaaatctggacctatgcgtcaagtttcatagactaatgattcagatgatcctctgtataattcagttcaagtttggtgatgaaggcacaccttcctatacatataattctaataaaagtatgtgtcagcaggaagtgttggtgaacagacaaatttcttccgtcccgcttcagcaaatggccttatgggataaactaaagcctaactagaaaatacacatttaaaattttctaaaacatccaggattagaaacgtgtgttcctacctcttgtttaccagttcattcaggggttaagaacataactgttactaaagcaaaccattgcacaaaactttgacttgctaattggcaacattccttcagattataggaactagaaaagaaacaaagtgtaatttaagacatttcagctctaaaactgttgctatgtttttatctcttggaccatacatttttttctccttttaaaaattggattatagcaataaaatttacataacataaactttaccatcaaacctgttttaaatttaaaaaaaaaaatccttgaggtgcaaaatgtgagtattgaggctcttgaaatttccttttcaatttgtagcttttgtttctcttagtaagacataaaatactaggctatttcagagcctcctgtcccctcaccccctaatattagagtgcatttccttggcccttttaatcctaaattaccctctttatagcaaggagtaaaacttattaaccaatcactacaaaacgtaacaacacaaccttaagaatggttttagatatccaaccagttgtacttcttgagttaggttacaaattatgttatttaaggtaattttgggtgtcgggcctctgagcccaagctaagccatcatatcccctgtgacctgcacctatacatccagatggcctgaagcaactgaagattcacaaatgaagtgaaaatagccagttcctgccttaactgatgacatcccaccattgcgatttgttcctgcctcaccctaactgatcaattgactttgtgacaatacaccctctccacccttgagaagttactttgtaaaatcctccccacccaatcaagaaggtactttgtaatatcctccccacccttgagaatgtactttgtaagatccaccccctgcccacaaaaaaattgctcctaactccaccgcctatcccaaacctataagaactaatgataatcccaccaccctttgctgactctcttttcagactcagcccacttgcacccaggtgattaaaaagttttactgctcacacaatgcctatttggtggtctcttcacatggacgcgcacaacattgggattccaagacatgtcccaaatcttcatttaaagttaagagtggcaactctccacacaaatacttactggcattgttcaaagtccagtcagagacttttcacaaagggaaggaagatgttgcccctacgtgaggaactctgttaacaactaaagcagcatgaggtcaagacaggagtttggcaggcttggttttacaaggtacaggtcagaaagaaccctctgataaaacaagatgcagtaaaaaaagctggccaaaacccaccaaaaccaagatggtggcaaaagtgacctctggtcatcctcactgcttatctgctaattatagtatattaccatgctaaaagacactcccaccagcaccatgacagtgtataaatgccatgggaatgttcagaagctactctgtatggtctaaagaggggaggaaccctcagttcctggaattccccacccctttcccagaaaactcatgaaaatccaccccttgtttagcatatgttcaaaaataaccataaaaatagccaaccagcagccctcagggctactctgcctatggagtagccattcttttattcctttactttcctttactttcttaataaacttgttttcactttactctgtccacttgcccttggctcttgaattccttccttcatgaagccaataaccccaatggactcccaggctgaaccccaattctggagttaaccctgtgacatcatttctggtaacacaaagggacaatggagacctccccttggactccaaattaagactgatcagcaccattcagacctgacagatgggcatgtctccttttgtccagattcaactcactatccttttttatcttctattttggctcctctgtcctttcctgtattctttattttggacagatggagaagtggccacgagacttctagcttgatagcctgtttgcagtctcccattgtctgggtgccccatagcagcacacctggccaaccatgttctttataaccccctttgtcacctcttctctccaaccgtttctctttagtttctaacaaccagccattttacttttctcctctcagtgccaaaatgcttgcttatgctcatgtcattgtggcatttattgtcttcttttgctatttgggcaattgtttaaggaaggatgctttcttgtgagaggtcccccattctattgaccctaggatgcgagagtcatgttgttctgtggccccagttgtgttaggtctcgtgcctctggtgtttgctgttggccaccctggagatgctctagggtttttggcatttggtgtgaggatcttcactggctgatacttgggtattttgggcttttcggcatttggttctgtttactgcccccgaaatgctctgtggtgtttggcattggcattctctctaggattgtgggttacagtcccaccctaggggaatcttagttttgcctttccttgttttctaccctaaagttttcatttttctgtaacagtattttcttttcttattgtctctttatttaatgctttgctataggaggtgaaaatttgcaggggaaaatagctgggttcttgaaagacttagaaaaacttctatatctagcagagatccttgttagacatggggacaatggtgaatcccaaaggacttgtcactaaggtgccttttaagcaattggagcaaattcaaatgagaaacaagtttagctaggtactgaaggaacatacctcaaaataatgagacatctatgacaaacccacagccaacattatactgaatgggtaaaagctggaagcattcaccttgaaaacctgtacaagacaaggataccttctctcaccacttctatttgacacagtattggaagtcttggccagagcaatcaggcaagagagagaaataaagggcatccaaataggaagagaggaagtcaaactatccctgtttgcagatgacatgatcctatacctagaaaaccacataatctcagcccaaaagcttcttgagctgataaacaacttcaggaaagacacaggttaccaaatcaatgtgcaaaaatcactagcattcctatactccaacaactgtcaaaccaaaagccaaatcaggaatgtaatcccattcccaactgccacacacacacatactacacacacagtacctaggaatacagctaaccaggaaggtgaaagatttctacaaggagacctacaagatactgctcagagaaatcagaggtcacacaaacaaatggaaacacatttcaggctcacggataggaagaatcaatatcgttaaaatggtcatactgcccaaagcaattgatagattcaatgctattcctattaaactaccaaggacattcttcacagaactagaaaaaacttctaaaattcatatggaaccaaaaaaagagtccaaatagccaaggcaatcctaaacaaagtgaaaaaacctggaggcatcatgttacccaacttcaaactatactacagggctacagtaaccaaaacagcatggtactggtacaaaaacagacacataggccaatggaacagaatagagaagcaagaaataaggcagcatgcctacaactatctgatcttcaacaaaactgacaaaaacaagcaatggaaaaaggactccctattcaataaatggtactgggataactggtaagccatatgcagaagactgaaactggaccccttccttacaccttataaaaaaactaattcaacatggattaaagacttcaatgtaaaactcaaagctataaaaacctggaagaaaatacaagcaataccattctggaatggacaaggatttcatgttgaagatgccaaaagcaattgcaacaaaagcaaaaattgacaagtgggatctaactaaactaaagagcttcagcacagcaaaagaaactatcaacagagtaaacagacagcctacataatgggagaaaatttttgcaatctatgcctctgacaaaggtctaatatccagcatctataataaacttacaagaaaaaaaccaaacaatcccactaaaaagtgggcaaagggctaggcatggtggctcatgcctgtaatcccagtgagaggtgacagcatgctggcagtcctcagagccctcacttgctctcggcgcctcctctgcctgggttcccactttggcagcacttgaggagcccttcagcccactgctgcaccgtgggagcccctttctgggctggccaaggccagagccggctccctcagtttgcagggaggtgtggagggagaggcgcgagcaggaactggggctgcgcgcagcgcttgtgggccagctggagttctgggtgggcgtgggcttggtggtcctatagtcagagcggtcggccggccctgccggccctgggcagtgaggggcttagcacccgggccagcagctgcagagggtgtactggatccccaagcagtgccagcccaccggtgctgcgctcgatttctcaccgggccttagctgccttcccatggggcaggcctcgggactgcagcccgccatgcctgggccttcctctgcctccgtgggttcctgtgcagcccgagactccctgacgaatgccgctccctgctccacggtgcccagtcccatcggccacccaaggcctgaggagtgtgagcgcatggcgcgggactggcaggcagctccatctgcagccccggtgtgggatccactgggtgaagccagctgggctcctgagtctggtggggatgcggagagtctttatatctagctcagggattgtaaacacaccaatcagcaccctgtgtttagctcaagatttgtgaatgcgccagtcaacactctgtatctagctgctctggtggggacatggagagtctttatgtctagctcagggattgtaaatacaccaatcagcaccctgtgtttagctcaaggtttgtgagtgcaccaatcgacactctgtatctagctgctctggtggggatgtggagaacctttatgtctagctcagggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaaactgtgtatctaactaatctgatggggacgtggagaacctttgtatctagctcagggattgtaaatgcaccaatcagtgccctgacaaaacaagccactgggctctaccaatcagcaggatgtgggtggggccagataagagaataaaagcaggctgccggagccagcagtggcaacccgctccagtccccttccacactgtggaagctttgttcttttgctctttgcaataaatcttgctactgcttagtctttgggtccacgctgcttttatgagctgtaacactcaccgcgaagatctgcagcttcactcctgagccctgcgagcccacgagcccaccaggaggaatgaacaactccagatgtgctgccttaagagctgtaacactcactgtgaaggtctgcagcttcactcctgagccagcaagaccacgaacccaccagaagaaagaaactccgaacacatctgaacatcagaagggacagactccagacgcgccacattaagagctgtaacactcaccgcgagggtccgcggcttcattcttgaagtcagtgagaccaagaacccaccaattccggacacaccagcactttgggaggctgaggtgggtggatcacctgaggtcaggagttcaagaccagtctggccaacaaggtgaaattccatctcccctaaaaatgtaaaaattagccaggagtggtggcacatgcctgtaatcccagctactcaggaagctgaggcatgagaagcatttgaacctgggaggtggaggttgcagtgagccaagactttgccactgcactccagcctgggtgacagagtgagaccctgtctcaaaaagaaaaaaaatagtggacaaaggacatgaacagacacttttcaaaagaagacatacatgtggtcaacaatcgtatgaaaaaaagctcaacatcactgatcattagagaactgcaaatcaaaaccacaatgagatagcatctcacaccagtcagaatggctattattaagaagtcaaaaaaaaatagatgttcgtgaggttgcaaagaaaaaggaatgtttataaagtgttgttaggataaattagttcaaccattgtggaagacagtgaagtgataccttaaagacttaaaaacagagataccatttgacccagcaatttcattactatgtgtataccaaagggaatataaattgttctattataaagacacatgcacacatatattcattgcagcactattcacaatagcaaaggtagggaatcaacctaaatgctcatcagtggtagattggataaagaaaatgtggtaaatatacaccatggaatactatgcagccataaaaaagaatgagaacatgtcctttgcaggaacatggatgaagctggaggtcattatcctcagcaaactaacacaggaaaaaaaaactgaataccacatgttctcacttataagtgggagctaaatgatgagaacacatggacacgtagagggaaacaaccgacactagtgcctatcagagaatggagggtgggagaaggaagacaatcaggaaaaataactaatgggtactagacttaatacctggatgttgaaataatctgtacagcaaacccctatgacacaagtttacctatgtaacaaacctgcacatgtacctctgaacttaaaataaaagttaaatttaaaaaaaagaaattttctaagagaaataatttgaatccacttatattttatgaaatagtttgtgttactatctcaagactagagttccaagaaaaaaagctattgggtcttttgtgtgtgtgtgtgtgtgtgtgtgtgtgtgtgtgtgtgtgtgtatgtctaaatgtgttttatgtgtatttacattatgtcatatattgtatctacagagtgccaaattggcttataaataagtgttcccaaaaattaaagaagtccaagcatttttcaagttcacatgacttaagttcactaaaatttaaggttactaaaaattcatttgtaattctgtatataaaatatgccaaagaagatattcttttattttaaaaaaaattggccaattcagatgttatttaaagtatggtttaaaatacggatttaggaaaaacaacatggcactcacttcatgctatagctcagtagctaaggctttgctttttcatgatggtggcctgggttcaattcctggcttagggaatgaattctttctggtttgatacctgtgggacttttacaatttatttattcttttcccctccatggatagcttctgatttcctgacttgaattttcttttctttgagggacattaggggtgattctaggtcttgtgaaaaccatgtgccatctgtttagagacaccttgtgcatccatggttaagtcataaccttaaggcttattggcttcaattagaaaaatatctttgaggaaaacaaagggcttgcttaaaagccagaggtgttggctgtttgtcctagctagagtctggtaattagagatataaaaggatttttttaagaggcgtatggttaaaagtcatcttaaaaatggataaaaagttttatgctttttctcttcttggctcttgttttttgttgtttgtttgtttttcttttcagtcaactggattatttccccaatctgtcttcttatcaccttcaatgtcccatgagaggacctattataatttctgacagcctagaactccttgggataaacagagaaggtgccacagaccccattttggggaaaacctgttttcttcatggaaccacagtaattgaaagtggacaggtctgtctcaaaatctacggccgtcctatattttgtatcatgttacctcacctttttgacttttgggggtatcagaaattactttgcattatgagacaacttttagccttggtgtgtaatagctaggtagaacatatactttcagggatggctaatagcagttgcttacagtgagtcattattaccacaggccaatatttctttcttcttttatttaaatttttaaaaaggtgctattgggcacctaaaagacagaaaatggagatgggctgattatagaatgagctgattggctttgggttggccactagtcttggaggaacattcttgcaatgaaaaatctgatggctactgggttttcttctgcctgtctgtgtagttagatatccgttgtgtgtgtgatgtctataacaaggagctctaattaatggacttaaagaagaataagtgcttggatcaaatattttttaaagggaagataaaagctgtggtaccctttaagttcatgtaactttaatctttgagaaataaaaacagccttaaagattattggcaatgtagatgttgtcaaaatgtaaatatttacctagggctaaagggttgttttgaattagaaaagataatgctgaaagttcaaacaagttgtgaaaatattgtaaaaattagcttgcaaaagaaattctgtgtgtgaacatattaactaaattcaaaaggttattgtatagttttcctgtaaattaagcattgaaataaaaacacagggtactcttaaggcactaatcagctcttaagcaaaatttgtaaagggttataaaatgtttttgcttttttaaaatttctgagtcatcattttggcaaagtaaataatttaaggaaatccggaattctatctaataacatcaagtgttttaaacctccaacttttttatttttttattataatactttaagttctaggttacatgtacacaacatgcaggtttgctacataggtatctatcccatgttgatttgctgcacccatcaactcatcatttacattaggtagttctcctaacgctatccctcccccagccccctacccctcaacaggccctgatgtgtgatgttcccctccctgtgtccatgtgttctcattgttcaactcccagttatgagtgagaacatgtggtgtttggttttctgtccatgtgatattttgctgagaatgatggtttcctgcttcatccatgtccctgcaaaggacatgaatgcatctttttttatggctgcatagtattccatgtaaacctccaacatttaacaggcttcccagaatcaaacttcagtttcaaaattagctttactgacacctagctttttaatgctacagagggcccctagagcattcagaagagaggtaaacaggattacctggcatgtttaggtacatgggattgccaaaatgatgttcaattttctttaggttatattttagtgaaaaatattaacatatattccaaaattgtatggggtttctaaaattctaatgtctgagtatatgctattgatcacaattaaggttgttatgttaagttattgtaaaccacagagataaccaaatttctttgtcaattatgttactggctgtaactaccctggacattttgctactcacagaaaattgtactgttttgatcctctgcaaaagatggtttataatcagctacagaactttgacaggtactctcaaatgcaggtttctgataattttggagattatgacgttggaataaaggaaaaatgtacaggactcatgaagagctgaaatgtttacaaatatcaagcaaaactagagttaactggatggactgaaccaatagaaaactgaagtaatgttttttgcttttgcttggaacattgctgatccttgctttgttcttcagagtcaaggaaacttattttgagctatttatggcctttaataattgagtaagttatactcctgtgaccaaaatttggggcatatttgtctctctctgcctggcttctccagaatttggaaactacttgcaagtattcttaacttatggcaatataattgtttgcatcagtgcaacaagaatccactttcttgcaaagctgataaaagccccttgggaaaattggcctcataccttgtttacaccatccttgtccagggttcctgacctgtggtaagtgaaaaatgtcactttctgacaggtccaggagctccaggtttatcttgggaccttaagaggagaggattacccagctcataggtatttgatggcaaaaacccatggatgggctcagctttaaaaagtcctatctgagattccttgtgaaacagagttccatcaaagtcaatctaaaaggcttatgtaaaaataattattcttgctgcactgtacacaaataatcaggccaagtataagacttataagcctaaagtctattttgcaaacaactccgtcctatcatgatttgtttttagcagaaatgaggactggagagagagaaattatgtttccaaacttatcatacatttgtcattaaattccagactcattagttgttttaaagtttttgcctacatcttagactaaccctgcttattcccgtgaacaatccagtgacctctgactgcagctcagaaggaacaaaagcatagatagcttttatgggtaatgtaaaaatctggatcaatattctaattctgagcaattatcctgcaaatcttgccaggtgatgggaaaaaataggatgaccatcacctggaggttttctttttgggaggtaagagcaaggaagctaaccaaagccaagcatcatgcacccaaatcttagcaagcctccttaaccatagccaccagttatctgggtgtgtcacaggttgtcctttaacctgccttgttggaggagaactcaattccatagcttcaccttagcatttggattataataaggagttcatccaacccccaccaagacacatttttggtcccaaactcaattctaagctttgagttgaagccctaagaaagaaaactagatctgaggggtccggaggcagacaataatggaagttaaaaggcacagtgcaggtgagtgtgactaattcctgccaattaagccaagcttcccatttcatggataaaggtcatgctagtatccatggcataaatgaggtctaggaaatgcaaatactattgacagcagtggaggtaggacgtacatgggtcagagtggatattcccaccacctaggcctttccattaatatgagtgaaagccactttgatgcccatgagtagcaagcaccctgtaatggtcactgggactcagggatataagaacagaagaaagaaagaggaatatctcactttctctccctcatgtacctcgggtatttgctaggaagagaagggaaccagggagacctgctcccttctttctagatgagtagctattcaccttcagactttacccctttcggatgcatcctgaacccctgggactcctttgaaaaaacctccttttttccttcttcctcctctgtcctcacttcactgataggtaatcatgtctccatactatgcgacactcccctcagatgcatcctccaaactgggaaaactcaatttcccaaaccttaaactggttggcttaggattgggcctggggaatggaacccagaagactgacatgctggcaaaagggtaaaagtccttttttaccagtcaggattttggcctccctctccctgtgcaaactggtaaaaggcctcaggattcttgagctgactttatccaccccccttgttttattttgatatatgtttcctaataacctggtttgtctattctcacctttagactatcaaactccaaacagtcatgcaactggagccacagatgatggccctgtttgccagggacccttagatagccctctgagggagctctgacttctgccttcccaaaacagcgccccctgtcagcaggaagcagttaagatcagccttcattcttatccttatctttgttctaatagcagttaagtgtacttctttaggcagggaatgatagatgcaggaggcagataaggggaagggtccctggagaatctctgagccacctgtgcactgggagaatggggtggagccacgagaatttcatgccttctgtagggggaaagagtctgacctcttcaggtcatgtgtggtggcctggaatcaatctgtgaggtgggggcctgttagcaggacaccctctcactgtactgagagtttttcttttttctttttctctcctaataagttcaaccctacccacccttcaatgtgtccatgtgcctaatctttcctggttgtgtgacaagaacccagttttagctgaactaaggagcaaaaattctgcaacagcattcttattctctggtctctgcagcataatcacacccccaaattttacctggtatagaatcatgtagaataaagctgatggtttccaacctctcctgcaactgaatatggcttgataactacatctggccaataagatgtaagcagaagtgtcgcatagcagtttctgagaccgaaggtgcattttgaacttccttcatcatcttttctttgatcctgccccagcaaatgagaacttgaggctggaactccagccactgcaagggctacactctgaggatggcagagcagtgaggccatagggccttgagtgcctggattgtggagaagagctgccatcagctgtggatggtctccaaactgacatttgttgggaaatgccccactgtctcactgaaggcacccacattttggccctcagctactcatccaattctaactaatgtcaatttatacaaacaaaatgcttgctttccccccaacccccagaggctcttaaggagtcaatctctgggtggaattttggaaagctgaataaggaccattttcctgatgaggaagtgttgctgctgttgctcaccccactaaggatgcaggccgtttgcctcccaaaggttgtcctttaattcaattacagcctcaacactttgtgaagtgaccctctccagactgaattatattctaattagaaagttaaggttttctcaatgtattatgctattggagtccccagaagtctagtaatccctattagctatgtgtctgactcatactgcatattttacagacactcctctactctgtggttttactaaaaattccaaagttgtgtctccctggcatgctgttaaggaccttttattttttttaattctgatgagtgccaagccctagaaattagacctgctacccctttaaaaatgatgtactcagctacctgaaaatgctctgcttctttgcagagaaggttttagatcaatctctttagtacaagcaaataaccccaaatgtgttagcgctaagcactcagggagccttagattattctgcttttttgcctgttatgagcaatgctggtgactagaaccaacgacttactcaagggtaacatcctgaaaaatagctatgccaatccagggtgatatttatcattcctaaccacaggccaggcatagacacagagagtcagatcagaccttggctgtgtaaaccactgatatagccaaactgtacaaaccagctgactatcagccaggtgcaggttgattattaaaactaagggctcttgacttggaatggcaagaaagtgggaaggggatgaatggtgagaaattatttaatgggtacaattacattatttgagtgatagatacactaaaagccctgacttgactgccatgcaatctatgcatgtaacaaaatttcacttttaaacctacaattttatacaaataaattttaaaataaagaatatagaatatatattttttaaaaagacaagttttctttcttttttttttttttttttttttttttttttttttttggaaaaggagtctttttttttcaccaggctggagtgcaggggggcaatcttggctcactggaacctttgcctcccgggttcaagcaatttttttggcttaacctcccaagtagctgggactacaggcacccaccaccacccacagctaatttttgtatttttagtaaaaacggggtttcaccatgttagcctggatgggttccatctcttgacctcatgatccgcctccatcagcccctcaaagggctgggattacaggtgtgagccaccatgcccagccgggctcttataaagccttcaggatttatttctggcttttcctttcctttatttctggaggatggtttttagcctagacaccctttcctcccctcccctcccctccccctctcttcccctgtcttcccctcccctcctctccctccttcccctctcctgccctcctctccccttctccttccctcccctctccctctcttctcctcccctcctcctttcccctctcccttttcctctcctcttctcctgtgatgagaccccctggccttccctttcactgagattaaaatccctccaaatttttcacattctcacttctttacttgaaaacaaaaacaaaaaaaaacctatcccctaagtgaaatatgccagtcacagaagactacattttacacaattccattcaaataaaatacagaataagcaaatgtatagagaacgtaggttagtggttgcttggggttgggggagtgaggaaataggggagtgatagctaaagaacccccaggtttctttttgaggtgatgaaaattttttaaatgctctgtggtgatggttacacatatctggaaatttctaaaagcagttgaattgtacactttaaatgggtgaattgtatttgtaaattatatatcaataaaactgttaaatgccattcaagcaagtatgatctagagaaatatgtgctaaaatacaagttaccaagtggttgccaattgactgaatattggctattttgttggattaacgttgtttaaaacagttgtcaaagtttaaaaataaagaaatctcccacaaaaatccagctttttgccatcagaatctctggtatcaatggctctatattcctgcatggggagaagtgcctggctcaagggatcttgggatcccttcaaatgagacctgagttcttccaggaaccacctcttgctaagatttgacttaattattatactattactccccataagagttagcatcctccaaactagatcctttttaattcaacaaatacgtattgagtatgtattaggtgccatgtaccttctctctttcctcctatctgaggacaaaaacctcccaaacctctacaatcttttcccactatcctctcccccattagcctatagaccttttctggtctttcttatcataaaaattgtcagccaattaaacaatcttctgttgaatccgctgctttctgaagtcagctgtctcatctcttgcattcatttcaagcataatctatgttcactggcatttctttgcctcctactcgttgaactggttgcaattttggtttctattactctactgaaactcttctattaaagttcactaaaggagagtagtgagtcatcaaatccagtgcccttttcctcagttctcactttcctcaatgctttgccttttttcggcctggaaaacatagaaaaaaatggaaagaaaaaaaacatcattctattctcctaatataaaaatttaaaaagtcggtggaaagtggattttctcttgtttttcccagacagagctcttctgatcttttgtagatctccctcaaggatgaataccccctccctctatacattggagctgacccactcattcaataaagctgggccctgtggacaaacaaagcctctgtcctcatggagtctatagtctggtggcatattggatgaatatataattactaactgggcagcactccaagagagacagtatgattcttaagagaccatgcaataacaaaggaaggtgacctagatcgggtaggcagtgggatcaggggagacattcctggggaatttatgtttgtccagttcatttctactcatcctttgcttttcttctcatagaaagtgaggagagagagagcaagagcaagggcaagagagtaaattccaggcagaaaaataaaaccagcgtgggggaagcttgacgtaggaactaagagaatacagaaggggagagtggtgaaagatgagtctagataaatcagacgggatcttgcaggtcatggtaagaggtttgttatcctaaagccaatagtaagacatggaaagttaaaagcaagggagataacatgattacttcaacatattttttaaaaatgcttctgctgcaatatgaagaattggtgcagggggccagggaagagacagggattctaattagtaagttattgacagagggtaggtaagagttggtggttgttaccagattccaacatatgtagacaatgaaatcaacagaaggaatgtggacttttggaacaccaaccaaactcagaaaatttcaaggctttcctccattccctccaaattcaagaagaaggtactcataactaggtcatggctgaagatgccattataatagtcatgctgttactggggttgaagcttttaatgtaagcaacaaagccttgaaatgcttccttctagacaaactgaataatctaactgtgacatgtgccctcctcagctcttccttaggtcagagagccaaggaagaaccacagttagattaaggtggccattgggaaagcttctactttaatccctgggctagaaattgctcttagggcttattttttgtccatctggaccacttgaataaatttaggcccaacctctttccatgggaatgaaacagggatcaatatagccaaggtatgcagcttggtagggatgcaaaatccctgagtgatgccttccatccttcatctcccaacacagttctcttcttgctcccttactcctgccactctcatgttttgaaagccagactcaagcatgaccactgtgtaagccactgcctccaatagagaaggaaagaaaggagagtaagggttggagaacaattttcctgaacatactcttcaaccatttcagaatgtatcactccttcctcttcacttccttctgcacgtcaatgtgggccttcttgtgcagtgccttttgtgcacctcagggtactgagttctcctttcccttgatcccagaggcagctgcaataagaatacaaatggctatggggctttgttgtcacttcaccaatgaaacagcacacaaattcttatttgcattgaccgggtcctctgactggcagagaaagctctaggtgcttatctccatcaaggtcctttctaggccgttataagtggcacctgttagcaatgaaggataaccatcgatctataaggtactcttcatgggctaggtgagtttgttattatttgctttgttttctttgtttgttttgttgtttgttgctgtttgggatttcagtgagcccatgcagggaactacatgggacactctttccctctaaatcccacttacttccctttaaaactaagaaagtggcagacaggcaaggtaagacccagtggaaatgggctaaggatgccactgagattgttctcaaaaatgaaggggcaacaggagtctatggtggaggtccattccatgccattgatttaggacattgcattcaagtgtagggccaaagcacagaccaataacatgattccatggcctagatagtctttaaatatcattcctcaaagactatggtggccacaatagatggctattcaagatttgtatcccaaccactgatgagcacgcaccttcccaactcctctcacatcacagttctgttcttattgccttggtctattcaccattcccccaacatgccctaagtccatcagcatgccttgtcttcattagacagttgatgggactcatgtgggttgagaacagggaagaagatcattcaggtaaaatatttcattgatgttgttctaatatgcaaaaaatacaaaaagtaacactctttcctcagctgctaccagaaatgaaaataatctcaacatttgacagaaagtaaaattagattgtttcaaagtcttctaaaaatctgagttctccttagaagagacatttttaacagtttggagacactggatagaagccatggctgaatttgagtttctagggcacaggaaatgctgaggagtgagctgagttgggagaaggagcatgatgatcagcccagaagatccagtgccttgactgtttgggaaagctggggtcaggaagaaattgcctggaaaaaagctggaaagtccagtcaagggcttctgcccctcaggcgagtgctgggagaaaagttgggaatgccaatctgctttttctcctctaggtttttttcactaatggcaaaaggaaggagaaatactaggcatcacaatccaagaatataagattcaattaccccaaccctaaggccactttcatgacaaatatgacttacacttgtctagagcccaatatatgctctaaagattttttcttctttaaagacttcaaatgaagtgtgctcatggctggctgagcacatcatgttgccatgagctcatgactacttgcaagctttcctgaagtagagctccaaatcacacacgtctggccaccatcttacagcatgactgcatcctggaatcccatcaggccactggaaacaggctttatcaaagctgttttctgaaacctggctttaaaaattgggagaaaggcttctttattcaataaaaatcttgatcttagcattctggttatttaaaacctctcttcaggtatggatgcacaggagcagggggacttggttaatgtgaatcaggaattttaatttaatgaaaaattattgcaaacgatgtttatttaaatcatgattaaatctcaaggtctgcagagcaggttgcggctgatgtcattggctgccatttactgtccagaaagctgcactactgattcctaaacgtcctcagccacatcgtgtgagtctttctcataacatgcacaaaaacgagaactagcagtctgggtaacaaagcctttgacctgctgatgggtgaaagctgccgttagctctgtgcttgcttcagagctgccactcctttcctttcctacaccagtctcagagagacgctgtgtcacccagtggacactaaagtgatggctttttaaacctaatcaatgactaatgataggtcaccatagtctcttgaagaatattttcttagaactagacttttgtggtaaaacacctggttatctatgctttgggtacttcaaaatatttgagaagctataataggccccaaagcagctgagtgatcatctttctgcttccatagggcacgcggcaggcctcatcatgagggatgaaatctacacttgctggttctcctgtggacttggaatttaccatcacaaagataattcagacctagcacttcccagaggttgagccccagtacattgattgaggaactgtcaaaacaggcttgcaaaaatatagtatattttgagtgtttacatttaataaattaacacttgtgaaacactataaacaatgcaacataattgtgtgatgacttgtaaaaattaattcaggctgtgcagttttataatggggtaattgtatagttgcatgagaaaaaagtccttttcacatttatcctgaatctcagtgaccatatgcataacctcgtttgaagttaaggtgaaagtctaaatttgacatattttgtgaataagaggcctggaccaatgccatcctagataagctacttgttctccctgttctcaaagggacacaatgaaatcacatgtaaaaaatatttttgagtaacaagataattgaatttggtgagagagtgctgttcttaaaatcggtatgttggcaggatggttctttccatctttgctgaagtttgctatatctccggtcctaacgtttttgagcaaagtttactgcatatctcttgccaggtcagctgaatatgaacttaaagggacctaacaaaacaggcagtatgcatcgatgatttagaattccactgtgcccacgaggacaagtaagagcaagcgccttgggcaaaggacatgggtattacctccataacatgctgtgctaggctgcatattcaggacaggatctctgacagtggagaaataacgactttctgatggactgctagggtgccagcatggattttcctggcttcagtggaataactcatttttccatctgtaaatagagtactgagacattatcttcatatatgcttgatgttagtcaggggcacttcggggtacaattttgaagctctagggaaattttatagcaaaggttaaagtccagagaggaaaagagtctagatagcaattgaaaattgggcacaaatgaagtatagtttgacccccacatctcctgcctacaaactgcagacccagctgcagtaggtggtagtgaaataagggaagttctaggggggactccgtcctcttcagcaagtgacagatggtgtgaaaccacacggtagcttggcagtatggggcggctgctgcttagtcactcctaactcaggaacctagtattgaaacttgaacagccttccctgtctggctataatgcagcccagacatcccttgtcaacaagttagtcaacagtgctctgaacaatatccggtaagtctgatgtcttacttgccgaaccagtcaaaacaagaaaagtgggctctgttggaacattccctttggttaactgaagatctctagtttcatttctccccaccaccatcccctttgttcattcacttgtgcattcagtcagcagaggagccagggggatatgacgaactttcactggttatatactatgtgctggttacagtttaaggaatacgaagctgtaaggtttgctctctttctgcaggaagctcacagtccagctaaggagacacgtgcaaaaataaacaatggtgatccttaggggtagatacaatactggaggtggtacttggtacaatggtggctcataggagggagagacagaattgcttaattggatccttcacaaaaactgatattcatcatgattcaacttccactgtatgccaggtacagtaccaaatattttacctgttttatctcatttaattctccattgactaccatttcaaagattattaaaacaaagctccaggaaaacaagtaacatacccaaggccatgaaactagtaagaggaagagccaggattcaagtcgaagtcagtctgtcttttcagttctctgatgctcctcaccgagtaatccgttgcaaggataacgagcgtgaaactgtctggtacgttaccctgcgaagcagggtcatataagggaatggcggccatgggggctggcttgagccagaaacaactcctgctcctggctgcagagggaactggatggggaggcagccctcacaagtgaccagcacttgtcactaccctgtccttgcctgcttctttcaagggatgcaggttcccacctactcagcctcatccacactcttgaagggtgctgatgtagggcaccagtatccatggccaaggggattttgatctggcttcctttgcatatcttgaatttttttcttttctgaccctacaaaggattaaaaaaggaaatgcctctttcattaaatattatgacacctacctgaattttcctggagggccatccccccgttctcaccatttagtcttcttagaaaaagttctagtgaacaatcaaatgtgattgagaatttgggtacatactttctaccatttcttaaccccattactgcccctgaggcataagataaactatgactagaaagagtggccacggttggggtaggcggggaagttgattggtcctgacccccagggattcaggtgtgacacctgtccacctttgaggatcactattctggcagttcagtgtcattgctgccttcatatctgtgtcagcttagttgttcctctttgtagcacatcactgacaatgcttggagcctgctaagagagcacagcagaagaattatttttaaatatgtaattttttcttatttgtccttggcatgtgtatttgtcaacagtggagcttctctccacaactacctacctagctaatattctgtcttttggatactcagttctctctagcctgagacatgaatctggctctatcttcattctcttgatccatctcacagatcctctttctctggttcttttcctggattaatttcttgggctctgaccacttccaaccctcccttctcaagcatagataaacgagaacaaagctgaactctcccatagcaatcactgctcactactattaaaaccactacatgtagtaatggaggtgaatcaaactcaggaagactaggatagaaaatttccttttatgactaccagaaatgaaaattacccccatggttgaagcagtttcctcttagccacttctattttcactctgtctagatttctattttaggccgatgtggttggaaaggcttatagaacatataccttttgcaatttatagaaatgcttacaagagccttcctttgatattgggcagagttgaggaaattgtccagagttacagtagtccacccttatcaacagtttcgcattccgcagtttgttatccacagccaatcacagtctgaaattattaaaaggaaaattacagaaataattcataagttttaaattgtgcactgttctaagttgtgtggtaaaatctcatgccatcctgcttcatcccatctgggacactaatcatccctttgtccagcacatccacaccatctatgtatccagccctttgtcacttagtagccttcttggttattagagctactgtctcggtatcacagtgcttgtgttcaagtcacccttactttacttaaaaatggccataaagctcaagagtagtgatgctggcatattgttataattgttctgttttgttactattaatctcttaccgtgcctaatttatacattaaactttattgtaggcaggtatgtatgtatcagaaaaaaaaaacctagtacatatagggttctgtattatccccagttttagacatccattaggagtcttggaacatacaccccacgaataaggtggggggactactatctaccaaagttctactttctgacctcagggctgaacaccaagtgcttgacacagagttggcatttgttaagtgtttgagagatattatatgcttttctggagacatggacattgacagatactcatgttttcaactggcccaagctgtctagtgcttctttcgcatcaattagacagaggaaattaggaagaggttcattccattcaacagacaacacactgaaacactgcctgtgttaccatcagaatagtaattccacttttctctccttttttaattatcccaaacacctacatatacattccccatattcgcatctcccatatgccgcaagtacgtggcccaggtaaatgctctataaatattgatgattgaagcctattgatcatttttattaacataggattacagcctcttggaatatgtagaggagttccaaggtagtcagagacgtttgtactgcgtggctccgggaaaaggtaagatatatttttaattcagaagaggataatatcctaaatttatatataaattgctaaccacctaccacacatgtcagaaatgtcattttagggaatgtctcttctgtctttagaaaccagtttccataggaggaaaaagcagcctaaggtaaaagtctttctcttcccagcagcgtaataagtgagccaaggtcaaaagtcaccatcctacttcaaagaagctgacagctgtgggggattcacagaggcagtttacaggaagtttgatattccagttctttcagctaatgcaagtattatttcttttttaaaataaatgattttcaacagaattgcatgtggcataattcagtaaagtgaaacacagtatcaaaatatgaatcataaacttacctggaaaaacgctcaagaacaggttttccatggacataagtcacatggccattccttctttttctgctcctgtatagaaaaccgaatagtcaacacaatgtccattggcatgacagtagcccatgaattattcgctctcctgtggagatgtcacacactcattctgtgagcaggattacaatagtcttataaattcaaatgggtttggcacatgtgtagttctttgctccaggccccagtacagggccagtatttttattttgtgaccagaatgggcatgttaaatgctattttatgccatgcaaagtttattaataagaaatgttacctgtctcatactatttatttgtttatttattgagatggagtctcactctgtcacccagtctggaatgcagtagtgttaccttggctcactgcaaggtctgcctcctgggttcaagtgattcttgtgcctcagcctcctaagtagctgggattacaggcatgcactccacacccagataatttttgtatttttagtagagacagggttttgccacgttggctaggctggtctcaaactctaacctcaagtgatctacccgcctgggcgtaccatttattacatatactgtactattatattatactatcattattgttatactattattatttagatatatatacattcctactatatacacatactaattatggctggtgtcaccatattaaaaatgtttctcagccgggcgcagtggctcacgcctgtaatcccagcaccttgggaggccaagtgggtggatcacaaggttaggagattgagaccatcctggctaacaaggtgaaaccccgtttctactaaaaaatacaaaaaattagccaggcgtggtggcaggcaccagtagtcccagctactcgggaggctgaggcaggagaatggcctgaactcgggaggcggagcttgcagtgagccaagatcacgccactgcactccagtctggatgacagagcaagactccatctcaaaaaaaaaaaaaaaaaaaaaaagtttctcaaattttagcaactatcataatcacctgggaagtgaattaaacagacacagcttctctagtccaatccccagaaattttgattctgtaatttggactctggaatccacatgtgtacaagtgccccaaatgaccctgatcagccaacaggacccaggccacacttggcacagccctgccccagcttcatatccacgccattcaccactgtggccctgctgccagcaagtgcctgtgcacagtcactgtgcaactaacatccactgaatgacagactttggcatcaggacatctagatttgagaacttattcttctttaacttctttaattgatcacttaaactctgagctccaaatgttcttatctgtaaaaagggaataatgtctgtctacagagttctaggttgtcagtgacaaagaagcaacaccaaaaacatttctggccaccttgatcagaaaagaaataattggatcattatcacatgatccagcaatcccacttctggatatttatccaaaggatttgaagtcagtatgtcaaagagatatctgcacccccatgtttattgtagttttattcacaatggccaagatatggaaataatctaagtgtacatcagcagataaatgaataaagaatatgtggtgcttatacacaatagagtactattcagccttaaaaagaagaaaatcctatgatttgcaacaacatggatacacttagttatgctaagtgaaataagccaggcatagaaagacaaatacatgttctcacttacatgtggaatctaagaaaacattgaaatcacagaagtagagagtggaatggtggttgtcaggggttgggggaaggggaatggggagatattggtgaaagggtacaaagtttcagtttaacaggaggactaaatggtaaatatttgacatgatggatatattaactagcttgatacaattattccactatatatatcataatatcattgtgtgccccataattctatacaattatagtttgtcaatatataatgaaattaattaaataaataattgaaaggacattggacagctcatgaaatccctggcaaggctgaaggactgaggaaaccagggggagctgggcagcaaggaaccatgccaagatcatgccacaggggcaatccagtgaagacatagactttcatcactcaagattcagttttgagtgagaacacgaagctggccatcctgggtcttgtgtactggctgccaggggccttttcagatttcatagtggaaatggggcctcattgtccctcaagatttacacaagatttctccaaaacaggaagttttgaatgctgggcagctaaatgtgcattatgaattaactccaacttaagttggaagaaattcagagaggttaataacgtataaacaagtggcagagctgtggttttaactcatatctctttcctctctttgtacttagaacagagccctcttgaaggtctgttcttttggctttcctttgaatttcagtggtctcaggcaatttttttccctcatcgattcttcccacaccaacaaggtaagaaatgcttgaccttacagaggcgagcagaaagtagaaactgaaaagcacactctgtttccctgattatgcctatgattaatcactttctgacaaaacgaaactgtttctaacctcaaattaaacattttaaaagccaacaaggcttgaaagaacagaatcacttccaatttatggtaagaaggagcagtaataatcattgcatcacatcatctcccatatgtgccctgtattaggaatcatacctaagttcgagagtcgtcactggtgccatcacgatgaatgagtggacatccccgtgagacttggccttccaaagcaaagctggtcaactcatgtggctttgaggaagtcgactccagaataaaagttaatggaaatgcataagcggagcaatgatgagatagaaaactaccttaaatttgaaaatcatttcacattttattaagcactttcgcataccttaacttcttgtaatatccctgcatatccctttttatagatgagaacatttggaactcaaaatttaaatggtcagtttaagaagaatgagctgttaaatctaggtctcttgattctggtgaaaatcttggcatgcttgaagacaagggtgctcttgcagagaagaacatatgtcacagtggtatcaccagttgggcaaaaagctctgtcatcaaccagtcgaggagaggtgaggacgagtgctaccccagaggtggtagcttgaaagtgaaaagacaggggtatttctaacagctattaaggacagaacacagagattgggctgagttagaggataaactggggcagtgcctctctctgagcagcagcaaaaggtcagcattgctgctggctgatgtggaatttataatgaaagccatgccgtagtaggcaaggatgttttgctttaaaaagtgacatttgcctcttggtaatacatgctgcaggtgtaagtgtttgggggctccacattccagtgtgatgcaaaaagcactggacttttaatcaagggagctggcttgagtcatgcatgtctatctctggaggctgccagagtcagtcatgcagaggacgagaggagtgagctcttagccaacttgcttcaagtccatagaggtccagtttctccttctgccctgaaaacctgggtccacagagccatcttaagtacctcaagcccagggcaaaggtcctggtagcaccacttatctggagtacagatcactggagccatttgtctcctctacaaacagggacaacaattaaaataatgagacaataggctggtcaggaagtcccccaatacttgcatcaaaattacccattttagcagcttgttattagagctattgggcatcaacatagctcaaaagcttccctctggccataataaaacatttcatgtcacaaatcccaggcacagtggcctgggctctgttgacaggcagctgggcaggtccaggggcatactgatgccagtgagggccatggggctcatctttcccaggtccacattcaacaacctcattttggtggtttgaaattggccataatccacatggacactgggaggggaacaacacacactgttcaggcctgtcggggtaggaggctggggaagggagagcaccaggataaatagctaatgcatgtgaggcttaatacctaggtgatgggttgataggggcagcaaaccaccacagcacctgtttacctatgtaacaaacttgcacgtcctgcacatgtatcccagaacttaaaataaaattttaaaaaataataaaaattagaaaataaaatacagaaaaatagagggaaaaaaattggccacggtaagagtatgtacatcacagaaatagacaaatgccatgagtcagaactttatattttccagaaagctggttgtaaagcatttaccagcagcacatcatttttggttttaggtgatttttttttttttttttaccagtgacacaaagtccctttgcatatcagggaggcagcatggccccctagtttccattcacttaatgtactacgggcagccgctgtttttgagttatcttctaagacctcttatgctataatcaagaaaacatgttgtcttagaaaatttccaccactctgagacaccttgagtaaaagtatccctagtttgtacttttaaactcagggccaggatgtattgagtttagaaacccaagtacacacactaaggatgctaaaatttcggtaccacagaccacatcttttttgtacattgcttattgcctgcaagatagtttgctcatctgaaggcaagaacagagcaatggccatgatttagttcacttttggaccctgagtaaaattgaaccatgcgggaagatcaaataagcctttctttgtttgtgacacataggagagtatggcataaaagtgtgaaagccacagactttgaatataaatgcagtcatgtaggtgttaatactccacgtatataactttgtcctacttgcctatagggcctctgtcctgcacccccaaagagcaccctaataatgaaacaatactgttggcgattttttgctctagccttcttatcaaaagcatcactgctgtcctgtggaggcttcctgtgaggatgctgttctgtcaccctgagccttcacagtcttggagctatactgttgtctgcagagcagttagagggaaggactctctccccagttttctgtcccacttcctaagacaatgtcccctgggctccaaacaagcatgcttgcatccagagatgtgatcacatagaggctcctcaatttggcactcaaacacctctcccatgggtccaaacagtctttcagcttgggtacaaatggggaattaaccactccctctgttgacctaatcatactcaacaaattgttactttttgcaaacaaaacaaagtcccttttcatattactgaggcagatagaaggcagtataacaagaaatacaatggaatttttcctgttgtcccggaagggagctaagatctaaagctgacaagcaaaaacactaacagtgtgtgtccattaagatgattttctaagtaaccaaaattgctaggtataggttttgtcttgagtaagaccatctctgtatcacctcccacttgtttgtatggctattatcaaaaagacaagaggtaactgttggcaagagtgtagcgaaaagggaacacgtacactgttggtgggagtgtaaattagtacagtcattttggaaaatagtatggaggttactccaaaattaaaaatagaactatcatacgctccagcaatccctcttctgtgtatacacccaaacaaaatgaaatcaataccttgggctgggcacagtggctcatgcctgtaatcccagcactttgggagactgaggtgggcgaatcacctgaggtcaggagttcgagaccagcctggccaacatggtgaaaccccatctctactaaaaatacaaaaattagctgggtatggtggcgggtgcctctagtcccagctactggggaggttgaggcaggagaatcattggaacccgggaggcagaggttgcagtgagctgagaccgcgccattgcactctagcctgggcaacaagagtgagactctgtctcaaaaaaaaaaaaaaaaaagaaaagaaaaagaagaaaagaaagaagtcaataccctgaagagatatctgcatccacacgttcattgcagcattactcacgatagccaagacgtgggaatgacctaagtgtctattgatggaagaacgggtaaagaaaaatgtgatctatacatgcggtggagtattattcagcctttaaaaagatgaaaatgctgccatttgcaagaacacgaatgaacctggaggacattacactaagtagtataagccagacacataaagaagcatattgcataatctcacttatatgtgaaatccaaaacagtcaaacatatagaagcagagtagtggttatcaagggtgaggaggtgggggaaatagagaaacatttaaaaaatgatagattacttaaaaacatttttaattgattcagagggaatattttactgattattagattgaagctctgtagacttcccagctaattgtgtaaatcatattttttttaatgtattgatacttaggttttcccctgggggcaaaaggaatgcattcattttgaatagtatattttttaatctttttgcataaactaaagcaatatgtcattttaaaaaagatttccattcttttggcaaggagcttctccatgtgttggttttgttgaacctggatgtaacatctggaattgatgcagccactttgtgccatgagtgaatctagcctgaggacaatttcctaaggcaggaaggggccgccttttacattatccctgttttaagagctaaagtaaaaaagttctttcccagaccccaattccttagaaaagtgaaattctcatggttggcttaagaaaataaagatttccccaccaagagtcttggaatatggaagaagttgaatattcaaatgaatagggtctattagaatggtggaagtgcacaaatggctcttgggtgggcaacaggatctgctctgtggccacattctatgtccaaagcaccagcagcaccaaggctgaccacccacagggactaccaagaggcacctgcccaccaccagcacctaagtcaatgaaatgaaaagactaggagaggtgagagagctttgggagactgccaggtgtataagagaatccctgccctctcatttctcttcggaactttggcaagccactaaagcagcagagtgcttgatgtcattggagcttggagaaggggagacaggaagacaagaagctgagaaaagggaaccattgagtcagcctgtttttctactgtctggcaaagcaagtcttctgtgggtcatgtggacactgcgggagatgaccaggcttgcctgtcttgacagtatactgcctccaaaggactggcatggagcaaggggatcccagcaacaaggggctgtggaatatgctcctgtggtagcagctgaagatttgcggaagccgttggttcagaatcgagtctgccatattagtttgcactgtattagggagactctgcagagagattcagccacatccatagagttaacagagagcagtggggagtaacagggctggatagtgcctgtcgtcttgccatgaaagataaccattccatccccaatcccttcgtccctttcagagcctggaagagggaaggggaagtatagaacaaccagactatgcttttctcacccactccaagcctctatagtcaaagttttcatctatgttagctggaagagagaagagctttgaatcaaacattgaaatttattcaacaaagaaataagactatttgaataacaaaaagtgacaaaaagatgttatggaatctggaagatgcctcatgagagatgctacaccaccagaaagggagaggcaatatagtagagtggcaggttattgcggaaaacttttcttcgttatacactaacacattgagactccatagtgaacacattctacagaaggaaggtgaggtgtcgcccaactctaagctttgaaaatattcatgtcccatttttggcctagccccaacacaatgatttttttttttctttgagatggagtctcacccaggctggagtacaatggcatgatctcggctccctgcaacctctgcctcccgagttcaagtgatttttcctgccttagcctccatagtaactgggattacaggcacctgccactatgcccgactaatttttgtatttttagtagagccagggtttcaccatattggccaggctggtcttgaactcctgacctcaggtgatccacctgcctcagcctcccaaaatgcagagattacaggcatgagccaccgcacccggccagccccaacactattactgaaggtaaataaaaatggagtcttaggagtagagctagaggaaaaaaaacattaacaatatctaggtactgccaatgaaccttccttggtatccgtgaggattggttgcaagactcccgtgtataccagaatctatagatgctcaagtctctgatataaaatggggtagtatttgcatataacctgtgcacatcctcctgtatactttaaatcatctctagattacttataatacctaatacaatgtaaacactatgtaaatagttatattgtttagggaataatgacaagaaaaaaatctgtacatgttcagaacagacatggtcctttttaaaatatttttgattcacagttggttggatccacagatgtgaaaccctatggataaggaaggccgactgtattcatttggaacgtaaattggagtacttggagaagatattcaacctgtgaacttcaggcccctagtggtggtcaaagtgattgcaaagagtcctcaaccccatctgtgagaactggggtggacagcaaagggatgaggcagcagaggaagttggagagagcaccaggatccactaaggacttctccacacaggggatagtgggaagcctttgcagcacagcaaagacacaaacagctttgtgttttgagaagatggttctggctgcagtgtggaaagtggattgggattggggatgggaaaagagcagttagcaagctattgaagtagttggacaatggtggctgggaatagtttctagcagtgaaacgggaggaaagtggagaaagtcaggctattttaagatatacaagtgccagctcttagagaccaaatagatatggggattaaaggcgatgaaggagttcaagataacttccctggtttttaagcaaatttttgagcaactgggtgaatgatgataccatttactaagacttggaatattggagatagagcaggttttgaggacactaagttcagtttggggataatatgattagtgagaagtatctaggaggcctctatgaagaaatgaccagtaattaggctattgaatagataccaatgtgagaggacttacatgtaaacttgaaggactgggaagagacacacacccctagggagagagtacacagtgagaggagcggaatagctagttagatgaagaagagaaaagagcaaagcaatatgacactgagaagattacttgggggcacctgaggtttgcagattagctgatatcaagggaacaaagtgatatgccaaaaactttcaaaattgcataagggttctcttgctggaaaatgaaactattgacttttatttataatgtccaggtcttcattgatggttataacataaatatatgccgaatgagaaaagtagatgatgacttattatctacatgacatatgattatatatgatgacatatgattacattatagcgtcagtagaggagaaacaagatgagtattttgctaatgctcactgcatgcactatgctttaaaagcaaaagcacaattgcttgatcactttgacattggtatgtggtggcctcactgttctcagaaatctttctaatcacagaaggtacaagcccagccactgctgaggccgaatgtgatctcatgccagaggaccaatatgcaatctgattttgcaacctcaggaataaggagttggatttgggcaagaatttgttggactatttcagatttttaggggtttttctcccctccttcatgaatatttcagcctaatcaaaaaaatctcaaacctcacaatatttttaaagcaataagtcaaatcaaataaatgatttgaatgttgaaataatgcaacacaccccttctggtcagcacacaggcagggtcttctttacctgaggacagaccttttccttcccgcaaactgtttctgtaagtaatgctgccacctagcagtctcttggggaatcaccaccctacaaggtaatagctttcggtacacacgttttaggtttgtggtggcttccctgcatttaagttgggtttaaacaacacttgaaatatgaatttaattacctttgaaaaatgtcttttctgcaggtataggtcttgaaatcatggtgtggcaaaaaataggctgttgaaagcagctcgctcaagatgaaaatgatggcaaaatgcacaggatttgcactgtccaaactcatccaattgcagacactgaatatgtgcagttctttttatataaattattcctcaataaagctgtttaaaaaatggtaaaataaaaagaaaatgatgaaaaaaaataaaacaccccctgtgtaaaacttcagtacatttgtatgaaataacaaacctctacaagtaacttgtgaggagagtaggtaaaaacaaagtgtggatgatcagcgtcaaagaagaacagctctttaaccagagaactctggagtcataatctcaaagtatcacctatgtgcctactggaaacctaaatgctgtgacattttaattcacagcaggagcttcacttgcaaactaagcaaagttactttttcatgtacttcacgtttttgtgttttcacaaaggttaaaaagaaacagctaacagttattgaagtgtttgctatttgcccaacactgagtaaaacactttccaagcactgttatgtaacctacacaatcccctgagatgatgttactgatactggtggcctggggaagttaacaaggcaaataagtgttggagtcgggatacaaaccgagccagtctgatttcagagcctgagctctcacctccaaggttataatacttttctattgtgctgaaagttatgtgggagcaaacagatgtcagatgttcagcaggttaaaacatgtgttaacaggatacagtaagtttctgttttctagttgagtggcatgaaagaaaatgttctcaattgtatcacagtgacatttgtcctatctcttactacaaactactttatttaatcactgtgaaactctaccgttaactctctgtttaatacctgttgactacctagattgtcagatactttgtccaattatgccatctcactgttttagtgacatttcactttttgatatcttgagagagagtttccttcttgtcactgctctgcatttagatgtcagtgagtactgacatctacagtggatgtgtcctgtccacttttactaaaataaggtatctatgcatcattttctgaggaaatgtcttgtccaaacatatctctgaagataatttgaatgtgcataatatctttatccagaaatagcatgccacagcaaactatgcagcttatgttagaccaggcccatgcattcaaaccacctgagaatctcgttgaatgcaggacctgagattctacattttaaactagctctcgggtgaagttaatgatgccagtccttggatcacaatttaagtaccaaggttctaaattacccagttatgcttgggtctggaaagaaaatctgattcgattccaaagtgaagcaaaaaaaaaacttccctataattttctcattttatgtatctgatgataaaaatcaggtttgatataaaccaagttatgtatttttatgtttctaaacaagggtatctataaaatctattttaaaaataaattgtttccatttgagttttaaatctatttgtttaaatattttttcttcttgtcatcagagtttttgaaatttatacctctaccataagatatcatgtagtgttggacttgaaacttctagaatcatctggctatcagagagctgcccaacctccagccccatcttagggcagacatgaataaggcttctttggtctaaataagctaaatccagagctctgggcattaaagaaactgaagtcagattttagaattgttctgcaattagttccttgacctggtggtcctatttttaatagcagccaatttaggagtttcctaggtttattcagagctctctttcaggtaactttgtccctatactcttcccgttcttgtcagtatcactcatttttttgctctcacaagaaaatatatagtacttagaggtaaatgtaaaacttctatacttgggtctcaagatcatatcacaaaagagtgaaatgaattagacactgtaagaaattgaccattcaaaaacaggaatgttattgcctaccaactcaatataagtgactagaataatgttattcagtctaggaatctattaatagaagaatagtgctaggacaaaggaggtaatgggcttcctctagcttgtactggcaaagccataattgaggtaatacaatgttcagatgtatgcatttaagtgtatgcgtgtctgtggctgtgagtcagagagtgtgatggagaggcaaaagggaaggtagttataatttatgaggaacaatggaaaagatcaacaggtttcaaaaaggtaaaccaagatggtgagagagtttcaaactgttatcaattcaaagaaataggagtatttacttttgaagtgggttttggagtggaagttagtaagatcttttatggatggatggacagatggatggatgggggtggtggatggattgaagagttaaatccctaaacacctcactttgagaaatgtagaagcaatggagcagttttttcccaaacagattagatagtcagacagacaggcaggctatttattgaatacattctacatgccagtatttggccgaaccctctacatataccaggtgctttcttctccaaacaaccctttggaattcctattatcctcatgtggaaagtggtaaatatgaggcatagagaaattaagtgacctgtccaaagtcattgccaggctgagctcagactttgtgctgttaacctctagtttataaccctgagtgacactcaaaggtggcctactcaactctctcttaaagaaataacttgctggccagcggcaaggagtgcagttagctgacagcctctactgataacctcctcgggctctgcttcagctttcaaccagagaccatgttgtttctgaggaggcccagctaaggaccgagcacggttggggtagaagagtctgaacatttctgcccaccatgggcccctctaataaacagtctttcctctggagctccccactgagctgttgtagacttcaccagatcagcattgcaatctgaggctccccctgcccaattcagcctccttcctccttctgtctatcgcaggagttgttctgaataaccttcttttactccaatgtccatctcagcatctgctttgcagaggacacaactggcacaccctgccttcatatatttggattgccatcatatagaagactgtttagaattgttttgtgtatgtgannnnnnnnnnnnnnnnnnnnnnnnnnnnnnnnnnnatcacaacacaagcataaacaaactgctagggaagcagctttcacatatacataaggaagaacatcgtaacaactagaagtgccaaacaatagaataacctgcctcaagatcaatgagtgccctgtcactgcgttcaggctgactggagaactgcttttgtgtgaaggttgtgtggcattaccactcctccacttctacccccatgaatactgaggcacctgggatgctaaacatccacaatgctaattgattagcaaaaaccaaattgtttaggaaatcgcgccaggaagcccaaacctctgatttcttagcagatcagtgggtctggtttgatacatcatccttgtccacttccagggcagtttagtggtactctaggccagactagccagtctacatactttttttttaatcaaagagcttctagaaaatgggataagctgtgggctgattgtccccatggactagttggtgggatcaaaacctaacttcacatatgtttatgtcagactgtaatatggggttcaccctctaatgcagttctaatgactccctcccctgccacatggttctcaagctcatggacttgcacacgacagccagagagattctcttcctcaaggctgttgtctccctcccttcatgcagacacaggcacacaaagcaggggactcctactgcccccttctaagaattccatgatggtcagattatataagtaatcatatatttcagatagcaaaataagagatggaaaagactggtaggaaaatcaatagcataatcagcgttaggatctgtatataaagagacattcatttgctgtgcaaatatttactgagcacctaccaaaggccggaatcccttccacatgctagggacgtgatgcgctcgacggagtccccaatgtcatggagtatatatctaatgccactgagaaacctggctcaccctgcactgagagaagcactcaaaaccaccatcaccaatagcgctactaaagacagtgctttggagcttccaagctgatagattatcctttctccccaccctcagatttctccagtgtctctggcacttatagtccatgtttgcaagaaatattttattatagtgctctgaaacaaatttataaagtttgcaagagaagttttaaaaaagcaagctcagcaatatttgggggcttttaaagctgatgatgcagctgacctactggagacaaaggcagtgggagggcccttactggtataaataaataggagtctctggtactgcaaacccacagcctggactcagagctcaagtctgaactctacctccagacagaatgaagttcatctcgacatctctgcttctcatgctgctggtcagcagcctctctccagtccaaggtgagaaatttcatttacatttcactgtttgttgaacagaaatagtctttaaccacttcaattttctttcgattaaaaaccgcagggaagtctgactaaagggggaaaaaactgctctgttccttctagatttctcaaagtaaggtgtttaggaatttaactcttcaaaactggaagtatttatattgttaagatttttatttatagcaaaaagagataccacaagtccaatattcatgtgaattatatattcccagcctttttctgattcagctcctgctatatataattctttacatgtagctcttctttgttctgcctctcaatgttacccactctgaccaaaccctatacagggtttaaagattattgaactctactggtctcttgcagtgaacatgcttcatgtaactccaaatggttagatctgacatcaagtacaccactgtcagtacaccaggggtatttacacacattctgcaaagaagcagacttccatgtctaagtggggcagctatctttgtgtcaatagataaatatccagttgaagtagtaagtttttatgtggccgaagaaatggatatgtgcagaaagaagccttctgctcagatttagaaggccaaatttttgttcttaaaacacagaggagctttgtcccccagttttaattttgcttcacatgttattttcactcttcaaaaccctaatttcttgcattctccacggggctttcccatggctcccggcagaggtagctcttagtacatcttctgttctcagcatgcatgttagattttgagcgtaatacaaccttctgtggtattttagtttttgtttgcttgtttcccctactaacttgtacacaccttgagaggtgagcctttttatttataaatgtatgtcaagcacagtagtaggctggatagaaaagatctgataaatgtctttggcttagatttcattagatcccattaaaattcatgagatggatactaatggtacccatccagtattaattgcttttgttaaataaaaagacttttgaatttttatgattgccttttgttctgtaatgatttgcaacccagacagaggaccaacatatcaaacaaaaacgtctgtgacattttctgagaggaaaggggaggatggcagagagtctgatagagaaaactctgttccagcatgttattgctcccaggactcttgagccaggtcatgtcctcggtttttatgtgttgggagtgaagataatccactggttttatattgcattaattataactgagttgtaagtccctacagaggctgttctcaaattttattatgtggactatcacctgagtacaaatataacactatcacaaatttcaaaattgctgtgtttttttgaaagctaatttttgttttgttttctttttgctttgtttgtttgctttctgagatggggtctccgtttgttgcccaggctggtctcaaactcctgggttcaaccaatcctcccaccttggccttccaaagtgctgggattacaggtgtaagccactgtgcctggcctaaaagctaactttatttttaaagttttggtagaaaacatttgaaaatactcaagccaagacaagcagaaatatacaaactaaagacatatgggtggaagcactgacttgaaacttttaagtcttcaaatgcacgttatgaaagattagtaattaaattctagttatgaattacatgccaatggattaaaataactgattctgtgtttacttacaggtgttctggaggtctattacacaagcttgaggtgtagatgtgtccaagagagctcagtctttatccctagacgcttcattgatcgaattcaaatcttgccccgtgggaatggttgtccaagaaaagaaatcatgtaagtttcaagagaaaaataaataagatttccttctcccaatgaaatcagatcaaatgttaccatacagtagtcttactcaagaatgtcgaagagatttacttgagtgttgctaaaaattctcaaactaataatgaaaattgttaataattaagagcttagtttgcagcagccctgagctaagtgctttacatgcacatactcattttctttattcaaccactttattaaggtaagtctattgttccttacagtctgaggcttaggaaggttaactaactgcctgagacacaccatcagaaaggattagaaagtgcattagtggccaggcgtggtggctcacgcctgtaatcccagcactttaggaggccgaggagggcggatcacctgaggtcaggagttcgagaccagcctgaccaacatggagaaaccccgtctctactaaaaatacaaaattagccgggtgtggtggttcatgcctataatcctagctacttgggaggctgaggcaggagaaccgcttgaacctgggaggcggaggttgcggtgagccgagatcacgccattgcactccagcctgggcaacaagagcgaaactccatctcaaaaaaaaaaaaaagaaagaaagaaagtgcattagccaggactccattcacattttccccgttgcaaagcctcttctttgcgacaccttgaagtattaggcacagcatctttctcagggcatccctgacttggcattcatgagtggcttttcccatggacttctttagatttttgcaatgtttgtaagcagctacttcctctttgtcacattttgttaccagtgcttggggccttggaccagttgaaatatgggatatcaaaagtgcatatggtagtttttcactagaaaggcatttcactaacgtctttaacaataatgtctaactaaactacaattattggcatcaaactcagagatgtgaagtctagccatgacctacttgggagtagttcccctggctgtttagaaaactgggacccccttcttttgattccatttcctctgtcatgactggtctcttgcctgtcaaccaaggaaggtaatgcaccttaattttctctgctttaactttgattgttttgaaatgacaaaaatctgattttatatcttttcatcaagttctgcatttgtgaattttaaccagatacagaaatgaaagtttcaaattattgtgagaaattcatgccagtcacaggtgaaaataccgtgagtccagatgatcagaaatctgtctttccatcatgaactcagaaacccaattggaagtgtctatctgaaaacccaactgctccatgtcctgtgacctctctaagatttacgtgcaaaagtgcagtttcagagttagatggatggatccttgctgtttgtctttattgttttggggtttttgtggtttgtttctgttttttgtgttttgggttttttttttgttttgttttgttttgttttgagacaggatctcactctgctgcccaggctggagtgcagtggcacagtcatggctcactgcagcctcaacctcctgggttcaagcaagcctccctcctcagcctcccgagtagctgggacaacaggtgcacaccaccatgcccagctagttttttttattattatttctgtagagatggggtctcattaagttgcccaggctcctggcctcaagcaatccgcccacctcagcctcccaaagtgctgggattacaggcatgagctaccatgctgctggctgtttgtcattttataactaagataaatgacatataaggaaattgtgttttgtttgagttcacaccaatagagggtagagtctcccagttttctgctgtctggcagacctcacttttccacttcagataaagcatttaacactatatctggcacttggtaatcactcaggtcatgctcatgaaaaacagtgaagaaaagtgtgggctctggagtcagataatcttcatttgaatccttctgtatcatgtatttgttgtgcaatcttgaacaagttatttaaattcactgagcctaagttatcatcagaaggtaaggaagtaataatttctccagcaaaggatttttgtgagatgaattgaaataatccatgttacctgctaagcatagtgcctggtgtgttataagtacctgataaatattagctattaattattgctgccacttttgctattgcttaatatcttagagcaggaaaaatcttgctaagtggtaattcgacaaaatgcagatgtcactccaagcaatctgctctgcagcatgcgtctcatgtgaaattgcactgaatttttttttttcagtgaaattcaggttctcaagagagtgttttctacagcttattttgttctcccaaatgcagtgcaacagataagcacattttaaagatattgtgatataactttagaagtgagccaatcttggagtaagttatttggttgttctccaatgcacgtaaatgttatcaacaaaacactaacctctgacatgtgaggccctcgcagctttggattcaaccccaccagctcacacatactgttccacaaatggttgttctcttattcctctgaccccatactacaaatcacctattccagatcccaaactgcccagctccaatttcacttcatctaggaataattattttcataccaaactcttttctttattaaaagtataggattgactaaaatgtaagactgaattatttaatttttattttcccccagagtctggaagaagaacaagtcaattgtgtgtgtggaccctcaagctgaatggatacaaagaatgatggaagtattgagaaagtaagttaggcataacaaggggtttcagattccaacttgtactgaagagtttccctttcctgggcagtcaaaatagggactagcttgaatttatgagaagttcctaagacaaatgtgtgtttttcactgttattgcttatcagatggagtaggggtagctcattccagcagctcagtaaaccaaactagatgccagtatacataagagtccttgcccggtatctccagaggaaagccacagtttcttgtgtttctctaaacatgacaattttgtttttgtttctgcttcacagaagaagttcttcaactctaccagttccagtgtttaagagaaagattccctgatgctgatatttccactaagaacacctgcattcttcccttatccctgctctggattttagttttgtgcttagttaaatcttttccaggaaaaagaacttccccatacaaataagcatgagactatgtaaaaataaccttgcagaagctgatggggcaaactcaagcttcttcactcacagcaccctatatacacttggagtttgcattcttattcatcagggaggaaagtttctttgaaaatagttattcagttataagtaatacaggattattttgattatatacttgttgtttaatgtttaaaatttcttagaaaacaatggaatgagaatttaagcctcaaatttgaacatgtggcttgaattaagaagaaaattatggcatatattaaaagcaggcttctatgaaagactcaaaaagctgcctgggaggcagatggaacttgagcctgtcaagaggcaaaggaatccatgtagtagatatcctctgcttaaaaactcactacggaggagaattaagtcctacttttaaagaatttctttataaaatttactgtctaagattaatagcattcgaagatccccagacttcatagaatactcagggaaagcatttaaagggtgatgtacacatgtatcctttcacacatttgccttgacaaacttctttcactcacatctttttcactgactttttttgtggggggcggggccggggggactctggtatctaattctttaatgattcctataaatctaatgacattcaataaagttgagcaaacattttacttaattatgagcaatttcttcttcttcttctttttttttttttttttttttgagacagagtctcactatgtcgctcaggctagagtgcactggcacaatcacagctcactgcagcctcaacctcctgggctcaagcaattctcccacttcaggctccccagtagttgggactataggcacacaccaccacacccagctaattgttgtattcttttgtagagacggagtttcaccatgttgtccaggctgtgagcaattcattcttaatatagcatctactcaaatgtagacattctctgattcttaaaataggattttatgaggttaatttttctttgtatctcatttgccttttacagatgatctaaaatcatttggcaaaggatgagtgaagttattcctgatattaacacagtgggaaatatttggctatgagggcctcttccccctagtgttacctaccgcatactaaccgtgatttcctccagacttcaaacacttatcaaacccattttcactgtgtcatattgactcttaaagtcactaatgtttcatctgacagttttgcattgagtttgaccaacagacaaagaagacacttgaactctggtccctatctgcccctggcatcagcctggatatcctacccaccacaccactaagctccactgtgtgttcctctccccaccccaccccgctactgcttaacaactgctttggggggtctgctcccagttcacccaggttttaagctatctctgactccctctttcacttttctttttatttttaaatttatttttatgttattaaattctttcttgggagaaaattaaaagcacccgtaattactatattttctcttgtctacaattcaatgtcttttaaattacaaatacacacacgcacacatagagggctgataaaatgtcatcaagatcctgccttgtagcgtttttcagattccagtgtttagagatcaggaatcacttcattctttaattcgattttggtctcctttggtagttagacaaatattcagaagtctcaaataagaaacaccactatttctcgtgaagtatctactattatcacccctgcttgggacacagtggttaagtcatttgctcatgagactccatctctacagaaataaaaactagctgggcatggaggtgtgcacctgtagtcccagctactcaggaggctgaggagggaggcttgcttgagcccaggaggtcaaggctgcagctactaaatgacaagccagcattcaaattcagccagtgcggaaccagaatccatgtgcctaactattgtactgtgctgactctatagaaggttggtatcatcagtagaaactgaggcatgtacttgccccaaatcgtataactagaaaagacaaatcagaactcaaacccagggccatctgactcctaagcaaatgctgttaatcacttcactagactgcctcaagttttcccttccctaaacatatttcttacttcaacttctttggccactatccttttcagggccaatcaaagccaggggaagggtgggagctccaggacgttcaggcttccgctggattgagacgttcatcctgtgttgtccaatcccagggggatctgggcagctggtgggtggcgtgaaggcagtgggccaatgtggaaagcgaaacaaaagcagggccagtgagggtttctaaactcgcttttcttaccacacaggcatgcattcctcaaaagtcggagtggatttggggatgttcagcctggtctgagacagagagctgaactcatagatgcaggaaacttgtgaaccagttcctggagtgtctgaggaaaggcgggctattgcagatctgagtgggtttgggtctggaaagaaagacttgtggaagagtagggcagtgcagtattcatgcgataaatgactctacacacacacacacacacacacacacacacacacacacacaagttaatcaaaaatcaaag

SEQ ID NO: 13594 - DNA, 13424 bp, Human
tctgtgggccctgtccactcagcctattgatgctctgtacaatgagctgtcatctctgtaattttaatcttagctctagtctctaagttagtttcatgctcctattatgtttatcagcatagatttccagcaagatgattatgtcaaataaaagttatcacttaatgtttaaaagataaaacaagcattggataaaattatgtagcctgtaaatcatttaaaactggtgtgctaattttatcttattttccaaaaccctcaccaagctcacacctctctgaaataagtgttagctttttgggctgccttcccccagttgctctgtgctccaaacagatgcctgtgtttagtccgagctaatatgcaaagggacctagttttaaaattccttagctgctccgcaaagaagagcgctgccaaagctatgttgtgtgccttcccatatttcacaagtaacaaaataattcacagaaaacacatagaagaacagaaaggagaaatctcttcccagggactatctgattatgtagattagaactcacgaatatggtattttctaatttaggagggagagagtaaacaaataaatgttccagggcagtcaaccacatgccccattgatattccgtgtgaaagtgtctctggcctaaggcacctggtttgtttgctttttgtcccgtcctgggagacgtgtcgcctataataacaacgctaattataatgaacaataaatgataatttatgggttaccaaggaccaagaagctctgggagtcttcattaaaacaacagcactacaacctctggaggtacgccgtaattattagatgtttacgtaccctcatcagcgtgctaagtttttattgaaaagcccctccttcagtccctcctgaatttttttaaattatggaaaaattccaagacacagaactagaaagaatactgtaatgcagcctcgagtacccatcacccagcttcgaccctcaactttttgcctatcttatttcacctctcttctccatttttttttctcttggactgtaaaattttaaagcaaatacccaaacttgtagcatttattgaatattttagtaaacgccccgacaatgttataataatttggtgggttattgcaaaatggaacgccaagacaaaataaagaaggaatgtagaaaactctcccgtggctgaaaaggctgtcacaaaggttagctgttaggagaagcgccgcgagcgtgacattcccccaagaaaggcggaggcagccaggcgagaaggcacagccccgcagggcaggtaactgaataccttctccgctgcacacccaggcatgcgcaatccagaccctggagttgctaaggccccaaggcagagagaggctcaggctacggagaaagccaatcagagggctccaagactgataagttagccaatccagattcgagggtgaatcaggtcctcagcatgcccatcgccccacccgcatccaatcagagagccggctactttgggcggacttttcaaaacagcgaaaacaaaacaaatcggggacctttaaaaggcgtaatgagaccagaaacgatctccttccgcccctctgtcttcccccgttccccaacgcagatcaatcgcggaataagcccgacgcccagattccgctctccgccctagcgccaggcgggaggactggctcggcaaagccaaggagagctagggaggccgcgagagaggctcgagacggcagcttaggggcgggactcttttttaaagtccgtggaggaagtgcaggatccctccgcggggagtcacgtgccccgcccccttgggggcgtcgaaactcttaacaaaaacaaggggctcggggaggtttccgctgaggcggcgggggtgcggcggtgggctggtcttccgcggccggcgttgcgccgcggcggagggtgggcgcgcggggagcgggatggagccggggctgtgaggccgaggcggcggtgcctgggaggaagggtcggatgccggaccgggggcaccgctgaggcggtgggtccccgacctgcgagacaggtttggaagcccccgctgcgcccagtccgtgcggaccgcgaggccgcgggcgggtggaggcgcgtctccggcacggtgagtggacccgcccagggccgccgtgggtttctttgttcgtggtggggactgtgggctttgaggaggttggtaccatgcgagtgcctcggtgctgcctgctcctcatccgctggagcgaccagggtgctgccctcagccccagccccggggggagctggcgcccgcgatggacagatagatgctcgtggggtggaaggaggttgcgactaggttaagggcagtctccgcctcggtgccccccgcccccgctcgtgttgtcacggggacttgctggcgtggtgcttctcgaattgacagccccggggctctgcagagttgtggggccccggcatcagtgggtggacgggtgttgtccctacgggcgcggggcgggcgggctggactggacttctctccccggaccgtagccgggtgtgccgcgccaccccagggctcctgggacgggggtatccgcctctcgggtaagtccggaatcggcgctgcagcagcggacgggaaaagctgggggcgggactctccgagaggggcttctgcagctgggcgccccgggcgggcggggctcgggagtctcctccctccgcttctttgttcagtcgcgagactctccctcccctcccccctattgtgcaacaccccatccccgggacccgctgcagtcgctcgccacactgcagtcccctgggcagaaggccctccctggcgcgacttcaggtggggcagaccgaggggacgccggcgcccgcggacagtttcctgtttgtgaaacgccaagaggccagggctggccggtcttacccagcgctggccggcggacctgaccacggctcctccccctgccacacctccctggccgtggtggggattgccctggggctctggcggacgtgactggtcccttcacccgctccttgtcggggtgtgctggggcgacccttgctggaggtactggcctcagccctttctcccgcttccccacccctcttacccccagattacattctctgtgtggtgtctttactgcagatgaaggatttgggggcagagcacttggcaggtcatgaaggggtccaacttctcgggttgttgaacgtctacctggaacaagaagaaagattccaacctcgagaaaaagggctgagtttgattgaggctaccccggaggtaagttggcagaaaagataacttgctcaagcagctgatggggcttggaggaggtaacccccccgcccccgttgaatcatgactaaagcctgcaaaatttcttaaaagttgttctttctggagtaccaagataaaccttattacaggttaatgcttttgtttcttagcaagaatgagagtgatactttagagaagtggggttttttgttgttgtttttaatgtggcaccctcctcgctgccccccatactccagcctgcagcttcaggatgggagaccccgggtgaattgagtagttcatttgtgcaaacaccctctgcctgtgaaatacatatttatagtagaatcttaaatgactttagaaaagcaaacaaaagaaccctttctctccattccaagggaattgaattatatttgctataactctctgaaatcttgcaacagttcaccttatattgaattgctgaagctcttttatgatgcgtatttttaagaagcagtgatttacgtcttacagatgataaagtgtatagctttagttaagcgataccactctttccacctatattcttgaagattgagggaaaaaaattaaccttattcttgggaaaaaattaaccttattctttggacctgtatgtgtttttcatctggttctaagaaaattgtaaaccttggttcttggtttttattgcagaatgataacactttgtgtccaggattgagaaatgccaaagttgaagatttaaggagtttagccaacttttttggatcttgcactgaaacttttgtcctggctgtcaatattttggacaggttcttggctcttatgaaggtatttcatcatttttataaatatgtcttcctttttctatgcccagtgcctagcacacagggttcaagaaatatttatcgaatgggtataataacgtccactgtacataaaaatttataatcagaattgtgatcgttagtgccagaataagactacaagattaattgtattgttgtatcttaggtttttctgttgtgtcttaggttttacctcttaagtactttctcttgaatatgtgacaaaagagagactactattttttaggtatttgccatatatttatagtcctcaatataagatttcatctgccatcatgcttctcttgaagccagatttttaaaatactgaagcatgacaaatgaagtataacagtttattaaatatgaccggctgccttccctagaagtctcttcaaagcagggagccatggttttattaacagtcaccagcaatggctagaaaaatgtggggaatcttctgccagtaggattgctgtcagctgctgggtcagttctcagggcactgaaaagaaaagggccgccatctgtccatggcagcttttacatatgtcccactctgcacaactcgtgatatttctcttgggcaaaattacattgaaatatggaatgactcttaaagatttttatgtaaaaagataagtataaaatattttaatatcccagtacatttttttttggtgttaaaaagcttaatttattttgggagagattatattatgaatttcataagtctgaaatacaaattatactttagtgctaggaatctagcttttgaacctgcatggaaatttttgtacctgcatttgaatttacataatttaaaggttcaaaaaacttttttttttttttttaaatagagatggaggcttgctgtgttggccagaatagtcttgctatgttggccagagtgttctcaaactcctggcctcaagcagtcctcccacctcagcctcccaaagtcctgggattacaggcatgagccactgttccctgctgcctttttttttggggggggggggaggtcgagaacgtctaaaatgtgaaaatgtgtataattgtgggtaaagagccagtacatataagagaaacaacttgattgtgttctgtcttaagaataggagcatcattacaatattctaagtatctgctaagtcaaagtgacagttgttaaaagaagcctcttgtttttttctcaggtgaaacctaaacatttgtcttgcattggagtctgttcttttttgctggctgctagaatagttgaagaagactgcaatattccatccactcatgatgtgatccggattagtcagtgtaaatgtactgcttctgacataaaacggatggaaaaaataatttcagaaaaattgcactatgaattggaagctactactgccttaaactttttgcacttataccatactattatactttgtcatacttcagaaaggtcagtgggattaaagatacattttgtactttgaacattgctatagctaacagtaaataattggaatggcaatgaaatttatatttttaccttcttcaaactttcaactttgactttattggtaaatctttttttttttttttttttggagaaggaatttcgctcttgttgcccaggctggagtgcaatggcgtgatctcggctcactgcaacctccacttcccgggttcaagcgattctcctgcgtcagcctcccaagtagctgggattacaggcgtgcgccaccacacctggctaattttatatttttagtagagacagggtttttccatgttggtcaggctggtctcgaactcctgaccttaggtgatccacctgcttctgccttccaaagtggtgggattacaggcgtgagacaccgcgtctggccctggcaaatatttaaaatcatttaaaatcatttaaatctttggaagtttaataaatctttgttctttgcattgtataggaaagaaatactgagccttgataaactagaagctcagctgaaagcttgcaactgccgactcatcttttcaaaagcaaaagtaagtcgattccttgcttatgtatatatctcacagtttgtattttgaatttttaaaaaatatttttcttttttttcttttttcttacagccatctgtattagccttgtgccttctcaatttggaagtggaaactttgaaatctgttgaattactggaaattctcttgctagttaaaaaacattccaaggtaattacagtcattattctttaaggcaaatttttttcctgatgtttatttttttctgtggtgacttaaacattaagtaatactttatgggactcttaacttttacacttgttttttttcttatatctctagtgttaaagttctcaaaatgcagctttgacccagacagtattaatccggaagggaacctggtcacttagctcagcttctttctgcatataggtgccccttctgtagtaatcatgccatatgatagtacagctgttacattgccacatatgcattgttctgaaatgcatactaggtagtagactcagaacaaacactaatgggataggatgggatcccatcacacctgtaggactgaactgtcatcccattagcagcagcatcaattaacaccagcaatgttgatgttttaaacccgaatgtcttttcaaatcctttaggccagctaagtaaaagtaagtcttaccatcacaaagagatataaaacaaaagcacaatactttttcttaaactctcagtctagttggggaaatgaggaacttaacatgaagtggtgtgttctgtcatttgttattgtgtcttggtgccaggtaatagtgaatatagagagtactttgggattttttttttttttttttttttttttgagacagtcttgctctgttgcccaagctagagtgcagtggcatgatcttggctcaccgcaacctcagcctctcgggttcaagtgattctcctgcgtcaacctcccgagtagctggggctacaggtgctcaccaccatgccaggctaatttttatatttttggtagagatggggtttcgccatgttggccaggccggtcttgaactcctgacttcaagtgatcccacctgccttggcctcccaaagtgctgggattacaggcgtgagccactgtgcccggcttactttgggttttttttaagcaaagaaatagggcagactaggagaaacactatgactgggagcctgtttggagcaaaagaatctttgacagtgaaagtttcagcgaaggcttaacggccaagaaattggtggactagacagatataaaagtcattttagggtagacttacaggtacaatgtctaggtggtagtcacaagcaggagtaaggctgtccaactcaaacagtggttttggaagccaagcatggaaatgaggcaaggagtcttgaatgaccaagatttgtacctaatggtggatataatattagcataattggcaggaaatttgggagaagttaatttgtgatgagagcaatatgattttagatgcttgtgtacacaggtgggtgtctagtaggtgtttggcgttttggaataagaagataaactatagttagagattgaggtttggaatttctcatgaagaagcagtagttgaaacggtaagaagctgtggaatcctttttgtaggggtcagttgaagctctggggttttcagcgttggcctttccccccaacattaggagccaagtgaagaaaggtacatccccacaagtagaagcactgtcagactggaaggaggtttttaaggaggtggtcaggagtattgaatttttataagagatccaatataatgaaaattgaaggtcattgggtgtgtcagaggtaatgtcagtagagcagtgagaaggaagtggtagaaaccagattacaagtgggttaggatgtagctacattaggtgaaaatgggaagccaagaaaatagatcttctgttttctggtgaaaatatgtgcatgtgaagcattttgtttgtaacagataactttttgctttagttatgattttattagtttttatctgaactttttattgatagtgatagctggaaccatcttcagtgaaaattgattcgttgaaataaactgaaggcattccgaaggaggagggaaaaaaatacgtaaaaagaaaaacaaaaaagaaataaactggagcactgcccagtggtggcggaactatgtcctttttgggaaattcctgttctctcatatcactaacttctttagttttgtatctggtgttataagtgtgtattaccagcaatccaaacaatgccttgttgcaggaacccaaattggtttctgtaacaaaaggaatgttaaattcctttgcattgagactaaggactatacttgatagctgatttattaacagacccagagtgtttttaggtcagtgttttcttagaataggcaaagctttctgtgtattgaatcctatgtagttttatacttacggtgctcttctcctaaaccagtggttcccaaattttgaaagtttggctgcacattacaatcacctagggaacttagaaaactcttgatgcccatgttgcactcattgtcaattaaatcagaataccaggggtggaagcgggtagtgggagccaggcatctatatatatatatttttcatagctcacctagtgattccaaggtgcagcaagatttgggagacattgccgtaacctcttaaaatatttttttttcagattaatgacactgagttcttctactggagagagttggtttctaaatgcctagccgagtattcttctcctgaatgttgcaaaccagatcttaagaagttggtttggatcgtttcaaggcgcacagcccagaacctccacaacagctactatagtgttcctgagctgccaacgatacctgaggggggttgttttgatgaaagtgaaaggtaggcaggttccttgactaattaaacttccctagactaaatattactgagtttattatactcagaactggaatagtgtaagacatcagagaaagcaagcacctacactaagagctaagaattaaagcccccactcttcaggtaagcaaattaaccagaagtagtattttaatatgtaatgatttataaggtcctctccaatttttttagtttttttcttttttatatttttttgagtagagatagggtctcgcgatgttgcccagggctggtcttacatactcccaggctcaagtgatcctcctgcctcagcctccgaagtgctgagattacaggtgtgagccactgcactcggcctcttttccctttttaaagtggttgttttccatctttctcctatttcccttgctcttgaaatacagctaaaaaaccccaaaaaaacaaaactgaaaaagaattctgggctttgtaatgttagtatgaattcctaatattgtgctgtggtgaagagattgaggggtaggtgcctggaaaataaagggaatcaccaccactgatggggaagacttctatatatgttctcagaggtttgtcaattggtgttgtcttattcagaatttgattactttgtttgtaaagtgaataactttgctaaatttgtttgttttatgccgtagagataaagggccagaagtttcattttcatagcttgttagtttactttgatatttgacagtgtaagtggtataataaatcactgatgcaagaaatacatctaaatagaccatatgctaggaggtatgttgtttttagtcttcattactggatttaaaatacttagaattctacaattctaatacttgctgatagttattaattggtacaagaataatagtttggcaaatagtaacttgtttaaacttaagaaaacctatattttctttctttctttcttttttttttttgcatgtgccaccatgcccagctaatttttgtattaatattttttgtagagatgggattttgccatgttgcccaggctagtcttgaactcctgggattaagcgatctgcacacttcggcctcccaaagtgctaggatgacagggatgagccactgcacccagtccaaaaaatctatattttccaatgagattactatagacttcatttaggaagtccttataaattttgtctctgtaaagcataaattttgaatataaaaatcctcactagagatatagcagctttattttggctataaaacatttaagtgtgttttaagtaatggtatcctctttttttgtctctttttctctttagtgaggactcttgtgaagatatgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgtctttaagcagattggaagtatgcaagtgcttccttagcagggacagtggataatccttaatggtttatcatagatttcaccctccccccttctcagaagagtgagtatgctcttaaatgtcaaacacatttttgttgttttgttttttaaatgatcagtgtctatttgatgtgatgcagatcttataaatttgggaattataatattgacatttctgtgatttttatatatgtaatgtcttaattgagatttctgttaaggcagaaataattaggctagggctcttagttttcattcctattgcccaagtattgtcaaactatggtattattttaatgttactttaaaaatccataatctgctagttttgcatgtacttatatgaaaacagtgcagtaagttgaaaactcagtatctatggaattgataaatgttgatctggtgtagtatattttatcgcattttcttatattaaaaaatgtctgcatgattacattttatttcctttgtaatttacatttcagaatagtgtattgctatatgggtgccaagattgaatatgaagaacccgagtgtttgtagtattatagttttaagcaaatctgtgtggtgatacagccataagaatggggcttatataaactctgtacatgtaagattttgtacagagaatttttaactttataaattgtatatgaacatgtaaatcttttaaaatgtacataaaatactgtatttttttaccttgtgtgtgatagtctagtcattgcatgtaaatataatttattatgtattctgtagtataaatcatacattgatgacttacatttttactggtaagtcaacatccgttggatgttttctgaagtggctctttttgaagtgataatagattgtaattcaaaataaaattattaatgaattctccttgtttgggatcacatcttaatttttaatctgttaaaagttcttgatgtattttaatgagaagactttaggtgaggctacagtgattccagagtgagccttctaactggctagcagaagttctctaggtttggcatctgtgccttggagatactgaaagagaatctgtcatttgacaattgacctctttgtgggatggactcattaagtatgctctcagagactggtatattaccagaatgcctattaattttcagtgagaggcaacaggtattaagtagaacagaatgctcaggttggcagattagaacgatctttcaggagacaaagcaagttttaatcagttgtttggttaataagtatggggtgttcgctgtgatagggccccgccagcttctggctcttgtggacctcaaaagtatcaggtggttttgcaagtggtggtcctttcccctgccccaccccaataggttccccatctgtctagtttgatttttgtagacctttgttttctctagttagaaaatcaggtacactgaatatggttttcatgtaacacctcttctctggagataggggtatgttttcctacccttctagtggagaatcctacttgaggatgacctttcctctcttactaaataatattagtaaatagtgggcaatatattctgctttcagattttgatttgttgagatgtaaaagttgtttggggcttaccaaatctcaagactctctttagctcctgcaggattgtattgcttttcttactggatatttttcctgggtaagcatctttgtggcttcatctcttccccctgtggttttcagtgtatttagtcgagacctctctgctgagcttgcaacctgtttattcacatggcctgccatgccacttggaggtttctgattactcccaaacctgctggttctttatgtctttctcagcgaataattccatctattcatgttggaaacttaggtgatatgctcatctccttttgcctgtttatggaggtcaccagcctctatcatttgtatgatttcgtttacactgtttatatctctctgtcccccctttttctgccattggcatggtttagacctgtactctttatcagcagaggtactgtaatatatttgtgatccctcagcttccaggcttactcctggtctctgccttcctatctacatatccttttaaaataaaattttaactatctcctgaaaaattgttgagtaggtcacgcacaatcaggagaaaaatctattcatgacatacaagtctctgtctaatctgaacactgcacctgtctctggcctttttttcttgtcatttcctagaccttaaaaaatgtgtattgagaaagaactctgttagctatacagaagatgaactgggcaatatagagtagcagcatggagaccagtctgactgaactaaggcagtggaagtgtggatgaggaagagaggtgaaaattgagaagcgctatcctttctctttgggcattattaggaggctcacagacaagtccaggagcctggttataccctcctgtgccattcaaccaggtggctttcc

SEQ ID NO: 13595 - DNA, 24710 bp, Human
agacagacagacagatagataaacaaacaataaaagtcttaactttctcctttgtggaagaaattctaaggggataggacagtgcctcaatgaactcattttaaattagctctccctttttacacaaaaactgcccaaatctgctctacctcccaatgaatttttgcatcccttaggagttctctagtcaagtaaatggcaaaaactgtggtcagggaagaagtcaaggctgaaatccaggagtcattgctccttatcttcctagaacctgactcttggcctgaaatagactctactgctccctttctgaatgaagagagaggaggacctaaagttgtttgtgtaggagccacaactgaccaagctcatctcacaataaggtttggagccccaaataaagacttggtctagaagattccatgtggacaacaaaattacacagttaagatactgaggtgaagaccccctaaatcgtctggcctaggtaatggagaaagtgaatttgtgtattaattctttattttctggttcagtctagccagagagggttttggagcaagaggaacaaggttaaaagaaaagaacaaagaccattgtctcagggagaccttaagaaaggtgatgcagatgctaaagtagaaggtgtgaaaatagttagaaagaatgaagaagacctagtattcaacagcacaacagggtgactatcgtcaataataatttcattgtacatggtaactaagagtataattagactgtttgtaacacaaaggattaatgcttgaggtgatggatactcatttaccctgatgtgattatcatgcattcattgtatgcctgtatcaaaatatctcatgtacatgtactccataaatatatatacctactatgtatccacaaaagttaactgaaattttttttaaaagatggggctatatggccacatagacatcagtctggagccctttgaggatccccagtgctgtggctgaggccaccctcctccctagggaacagaaggagcagagtcccagagaagtgtgagcgagggcctgggtgccctcctggctccgccacctgagtttaagaaagtagggattttgagatcacctttgtgtgcctattgaaatctctttccttcttcgaaactcaaattctaccttcttcagaaaacctcccctaaataagcctacactattataggcagtttgtagctttctaatactttattaaactgcgttattttattgtcaccttactaggctgtaaatgttgttagggcagaaatcatgttttggtttttaaaaatttccacaatgcctagggtggtgttgagaataaaataggcatttggtaagtaattgtgtgatgaaaaagttgaaaggaagaaaaaaccatcgggcttcctgaagtttctagcctttctaacttagacagagaatacactagatggtaggactgcatccccacattctcaaatcagagggtggaggttcacctgcacctggtgtatttttttctgaaaaaacaaaacaaacaaaaaaatgctatcctgaatgcaaattcagtctcaaagtgctacagaggacaaccaggaaagcacagtcctttctggatcccttttggggaccaggctgtgtgtgtgtgtgtgttgtgtgtgtgtgtgtgtgtgtgtaagtgtgcataggtgggaaaaggttgtggtgtgatgggaggggataggcaagagggaggaaagagactccatgcagtgattatgtggaggggatttgctatgtctcttccccccgcttctttctttgtcctctttctcctggtccccttcttctgcatttgtctgggaggatcctggagtgttcttttgatcgactcaatctttctctggcacttgagttctgattggctgaaggacttagaggggaaaaaaaactttaattaagtagataatctcttctttggacgtttggcagctccatttcacctccccttaactctgtttgggatcgcttacacaccaaggaagttgggctttgagaattccatcccactggcactgaggagaatatttctccgtcttgcttacccatctcccagttttttggaattttctctagctgttactccagaggattatgtttctttcaaagccttctgtgtacatctgtcttttcacctgtgtcctccaactcagccacagctggtaagtaacctggactcttacctggagctgggaataggtaagtgtatgtaatgtgttgggtaaagctcatttcatttccagaaatgtaggaagccttgatagctctcctaggaaaaactgttctatggggtagggctcttcctaaatttatggctgattttagtgaatctttaggacccctaccaataaaggactaaatgatgggagcgggggttcctatttttataaattgctattccacaaatattcccccaaagtgatttgggggtaaatggacagcagcccttttcacgaaatcctgatgtcagcattgtagagaggaggaaggtagttcaaagcaagttctaccgtgtgttgaatctgatcttgaggtaaagtctggagacaaaattcaatgggatcttactttgtactttctgactttattttttttttcaggatattctaagtaattgctcaaattatcatttcctagacataaaaaattttatttgaaccactaagcaggcattgggttaacaaacatgtttgaaaccagatattttagaaatctaaacgtctcgagaaatttatttaatttgttcaatttacaaatatttctaaattgttcagaaaatcagataacgtatatgaaagtgctttgtaaattataaacacaaatgctaaagaatatcatcaccattctcatttagctcttggaaaccacataaactatctatacatgcaactgttcattagcaaatacaccagtacacaataacatacagaatgcaggttgctagggtgttcggagtttctctccagttcagatatgagctcagtctctctcttcatcagctctcattttgaccatctatttaacaaagatataaatccaattgctacataaactgttgaggaagcaggaaaagaaatttctttgctgagataagcttcctttgagaattgaaaatacatttttatcataaatgagtgtagccgtctttataggagtgttgataggaagtatgccaacttcataaaactatttgcaagttaatacaataatttgcaacatttctgattataagcagaaccaccaattagtccatttttaattggcattttaattaaatatttcaatgttaaaaaaaaggtctctcttctctccccctcatgagaacaaaaagacaaaagggagaggagactatttcagagcatttctactgatgttcatggtattcttcagctgattcagtatcagcaaaagagaaacacgagattcccttccctagtcaccagggcggtgtgaagaattgttctataaaaaatacctttactgtgtgttcccttccctgctggagggggtcatgttcatttcattccgatactgacacagccacactgaaaggtggctgggttgcttgtctgtccaaattcaagtgtctggattcaaaaagaaaaaaggaaaaagagatgtgaaagaaagttctaatttaagaaaacagggtttaagagcccttctcgccttgcctgactttgaggagaaaatgtacaaatctcctttataatacaattagattttaattgctttttcctataagccccaatttaaattaaacatttgtacttcaccaagaatctgtttgtggtggcatttgaaaagtgatttttaaatttaacattaaacgttgattatgcttctaatgaaactatcagggttttgcataaggtcatcttcccctttatgccatgcagagaaatttgaccaaccacagcctttgaaatgtttctcttaatacttcattatcaaccttttatgtaaggacctcaaaagcatttaacaaatagagaaccacaatttctgcttggctgttcaattgtaggcctgcctgaaattactatctaaaagagtccatcagcagaaattcctgggcttgaaaaggagagaataatgatgacattcacctataatatgcagttttactaggtaaatcagtacaagatgatttctttgaaaagtatttgccacagttttttatagttgggacacttccaaggagaactgtcttttagtaacttgagaaaattattttctttgaatttgtttgtcttaatccttatggctccaaagatagagaatgagaatgcatgataagccaagcagatgatgatgattataatggtggccagagatgaaccaatttgattttccttccaatgcacttactcatctggaatgagcaggcctagaaagtgttttaccttaactggttggccccattttactccaaatgatatgtcataatgacagtgggtcttacccagttctgttcatttctcactctctccccacctaactcagtcaccaaatcagaaggatgccctgggatacagaagtaaactatagctctgctctcattcttcaacagaagtcaccgcctctacttctttccaaaggtctgcagcaggaatttaaacagggtccatttctcttctgcagtagggcaagaatttacctaaaatcattggattttatggcagcttttgaaaaacatcatcttttggtcctctacatgcatctcatagagtaacctttctatggctcttgaaatctcatctgatgatgacatgtgggactcctgattggcaaaggaatcagttattggaggaaggtctttgaatccatattctcaccaagcattgcataaagctgaaattattgatctccacactatgttctactacttttaggtgtattttatgaacaataaaatacaaactcacttaaaaattactgaattcatactggggttctgtcataagtttttgccatgttgaatttttcccactaacagattaaaaaaaaccatatatgatcaagtgaagatccactaaaactgtcacgataggggaggattcttatcctcaaagacgctgggaatccctgaagttaaagaaataaaaagtaaggtgtgaggaactgctttggaatctggaaaaaaaaataccagtataaaagagtgacttaatagcatccttggttcataaaaaaaagtgcctgatccattaaaaaaaaagctgggatttgtggagtagctctgaggtgggctagatcagcagctgcactgtaggaaggcctgagggctctgagacataaccagagaagtttaattcccaggtttatcaatgaaggcctccacaacttgagccccatgtgtttctttccagaatctctatttctcttgtcatgaaagacaataactattattattataattattaataacaacaaaggctgtgagtatcctgggaaaagacacttcattacagctcttgttatgaaaccagtttgtgtgagtgacaagaaggatgctctaagatgcatctttgttttagttttagtttttggtggatgacaacatgacacaaagaaggatctcctttgtgtgctattacatagtgacaaatgaggcattaaaaaaggaccagaagaaaaggagttttaatctaaaccctctccttccatggaaagatattccttttttttttctttttcccagctgggaaaattggtttaatgctgctctatattgggtgatactattatctcttgggactattaataaaattcctttttttctgggctccaacgatgcttgtctatttccatcagaaaagtgggggagaattcatatggcttagagaatgaggtcaatataatttttcttaggataaatctttatttttcagaaagtggattttttttttcttactcagtaaaagatcaggctaggttaacagctgagggaaacactgagcttgggtcacataaataacattccccattgcctcccacttgaaatacacctgcactcccaggacctctcaacggaaactaccatccactttggacagatgcttcagtctcattatgagccaaacttttatggtttgtttttctcaatctttattgtaagcccctgttattgatcatttcatttctctgtatgcttcttaggttagagttttctccaagccaagagaaaatcagatcataaggggatcatttaaattcaccatcatctgaccagtccaaactcgctttttaaaaataggttgttttcgcaacttcagcatcctatggtaccagcacattatggggctatattccagtagtcccaataagaccctataagagggctaataggtcagtctttctatgcagctccatagatgaaattcttatactctccaggccaaatttacaccaccctacattaggaggaatttccccttcattcaaaactgcaattaccatttgctgctctaaatctcagtcctttttctgtagtcaggttctttaggtttatcgtatcacactttgaaggttccattatccaggacgctaagtagtgaatcaatagattgtccacgttatcctgtctggtatttcctcaccttaatccaaggcatctggtggagcccagattccatagattattgcttttcagaataattggttttgttttaaaattttcatactatgggaaaaacatgtttttacaaatgttgagaacagcatatataacaaaccccaataactcagcttcaaccgttatcaatctctgaccaatcatgtttcacctatactttctgtagcatttttaactgcatattctcttagtctgaatcttccaagtactaccatggttcaaaacaggaagaagagggatagcaaaaggattatctgtcctgtgtctgagagattcaggccagtaattagaatgaagtttggggaacattgtacatttctcccattgcccttaggagaagatcaagaatacagattagcaaaagggaataagtcattcaaatacatgtttgtgtttatttctattggagctgtggttaattagcaaaggcagtagaaattgatggttggatcagattgaggagagaacattttaccatctatttggattaattccattaagcagtaaaaatggcactaaagtgccaaagcctgtcaattttccaaccttaagctgttcacctagttattttacaggataattcttggagttaccatgtacacccaccttcttgatactgatataaactggtattgtttccatcgatgcaactgagaacataaatgttttctaaagtctatactgcagggaccaaggcaacaagatcagaaaacaaaatggaattatctgcctccataacgactgtggaaaaagttcccgtgatcccaggctttctgggaatggtggcttgagctgttccttagcagctctcacttagagaccaaggaaaggagcatgagtatagcttatccctgccacagtcctcatttagatgctaagtgctgaagtgcttttctgtagcttagcgtttctcagcagcacttgctacaatacataaagaaggaaagaaatgaggacagggaagatagcctatcactctataaaatatcctggaatacaaatgacgtatcagttgcagggaaaaagatgatcccccgaacatttgtgctttgcttgtgaaggaatctgcctgagcttctttagcaaagatccatggtacagagttgtcctgtgggctattacatggcctttgctaacaattgtttggcaagggccggatttgcgataatgtgggattttaatatacattttaatataaggactactgctaagattgtcacatctgtttaactttaaaaaattttttttgtcaattggcttacaagacttgttttctcttttcatattttagggcactgcatcattatataaaaaattcacatttataaaaaacatttttagaatgatttacagggctgaactccctttgaagaaagaaatggactttaatttggtgaaatagttatgggaatatgaccaaaagctacacattcctgaatttttctttctatactcatcttgaaaaataccttcctctggccccaatctctactgcaatcatttctcctttctcttttttctttcaatgccatcctcccccaaccagttagcactagctactttcatgtcataactcctcactctctgcaatctggcttgtgttctattgccatacttaaatagatccctccactgataccagctttgttccctcttgacatatttttaagtaggaggaaatctgattttgaaagtctgaatacttctcttccctttaagacttcagataccttgtaacttctacctcctaatcccttcccctagttaaataggaaagcctgatttcaatactttggaataggtaagaattagtcatgcttttcacccttgaaaaatatttgcattttaaacttaactctctcaaattgtacagtgaatagttccaagttcaatcccctcaggtattatcagataaggtagtgaagaaaatttggggaccaacgggatattatttcacagttattagtaagacctactttctgtgtaactgtgtgtgtgggcacacgtgtgaacatacctttgtgtctgctcgtgcacatgtgttctacaggtcagatgtgtggatgctgtggaacagagacagtcacaaggaaactcactcagaagagctatctttgggctctccccagcccaaggcatcttgggagttctatggactgaaaagctgctgtcagaactcattctatgagaaagctgcatcactggagaaccttccagctatagcccctggcagtttccctactccataccctccccttagcctttagccctttgtcctatatgccttctgtgctaaatcttcagatggagatctatagttcacattcattcactaccacttctcctttcccctgggccagcactccaatttcggtaatcagatgtctctctcctaaagtagaccaaactgagcctcatgactcagagacaatttttttaaggcaggatctcactctgtcagccaggctggagtgtacaatcttggctcactgcagcctcgacctccctagctcaaatgatcttcccacttcagcctcctgagtagctgggactatagtgtatgccaccatacctggctaagttttgtattttttgtagagacagggtctcattgcctttttaaaatatcatcattatatcctcttttctgagctccatcccatttatccatctttattatgatttttatttttatttttcgtagagacagagtctcactctgttgcccaggctggtttcaaactcctgggctcaagcaatcggcccactttggcctcctaaaatgctgagataacaggcatgagccaccatgcccagctgatgactcagagacattttatggacattaagagatgggattaaaggttggggagaagccagaaatactacgtaaagatttgtggggaaagtgatgagaggcagaacaaaacaaaatcacagggcactaagatgaaagtcctgggtggtaagaggaaaatatcaaattctgcagattcatattcagaatgtttcttattttctattttattttgttttattttattttttgagacagagtctcactctgtcgcctaggctggagcgcagtggcgcaatctcggctgactgcaacctccgcctcccaggttcaagcggattctcctgcctcagcctcccaagtagctgggactacaagtccacaccaccacgcccagctaatttttgtatttttagtagagatggggtttcaccgtgttagccaggatggtctcaaactcccaacctcaggtgatctgcctgcctcagcctcccaaagtgctgggattacaggcgtgagccaccatgccaggcctatgttttgtttagatacacaaatgcttaccatcatgttataattgcccacagtagtcagtacaataacatgctgtataggctggtagcctaggagcaataggctctaccatatagcatgggtgtataggaggctatccatctaggtttgtataagtacattctatgatgtttgcacagtgacaaaatcacctaacgacacatttctcaaaacatatccctgtcatgaagccacacactgtatcccctccccacctctgcctacagtgtcctttagcatttgtttctccctactcttttatacatagaacccagtgtgagcagcaacagtgcctagaaaatgtgcccaggggatgtcgtgctacccagataaagcagggcctgtgccctggcagatgtggttgttttgtggacatagaagcagtaggctggtgtaatgaaaggataaaaaagtagcagagacaatgtgataattaactgagtgtattcatgagtgtgtgcaaaacatggcttaggccgctcagaaatatttaccaagaatttttcaggaattaggagtcctggattagccagtgggaataagagcaagggaaaaacgggctgcagaaaagcacagcaggtagagtgcatgctctagagtaggactgcctaggctccagccctggcttcaccacttacctagctgtgtgaggctgggtggccactctatgtttcagtctctgtttctgtaaaatgaaagatataatagtttctacctcatataattgtgatcattatatgaacttaaaatatgtaaaacacttcaaagtacatggtcagtcctggcaacacaacgagaccctgtctctacaaaaaatacaaaataaaaatatgccgggcgcggtggctcatccctgtcgtcccagcactttgggaggctgacatgggcagatcacttgaggtcaggagttcaagaccagcctggccaacattatgaaaccccatctctactaaaaatacaaaaattagccagcatggtggcatgtgcctgtagtcccagctactcgggaggctgaggtgggaagatttctttttcttttttttttttgagatggagtcttgctctgtcgcccaggctggagggcagtggcgcgatcttggctcactgcaagctccgcctcctgggttcacgccattctcctgcctcagcctcccaagtagctgggactacaggcacccgccaccacacccagctaattttttgtatttttagtagcgacggggtttcaccgtggtctcgatctcctgacctcatgatccgcccgcctcagcctcccaaagtgctgggattacaggcatgagccaccacacctggccggaagatttcttgagtctggacaacagagcaagtccctctctctaaataaataaataaaagtacttcgtgtgcacagaataaacactcagtgaaaagtatagtacccaccccatggagttgctacggaaatttaaaaagatgatacaggtaaagcacttagaagagttcctcacatacttgaataaatgctagttattattacatgatatgattaaactttatatcagtgtatacacacacacacgtatactggacagctaacacaagaagaagaaacaattgtaaaattttgacttggcagtgtaaaagcacaactaaccacagttatttatgtaaatcgcttaccacttatgcctaattactatgaagcacaataacaattatgcacagcactaagtgtgtcagattaactttgctaaaggtttgattatagcactaacctctgtgtacatatgctcagtgttcactctgttactcttgtagttgatcatctcctaatgtggcacagtcatctgctcactacactaaaaaattagtgggagcactggcttgccacaggcttcctatatttctcaaaatctttttgcagttctttttctccttacattttctgctgcatctgatggtctatcttttttatttcaaaatccttgtattcaattcacttttataggcacttactatgttcaaagtactagattaggaactggagggtatacagagataattaaggcagcccatacttaagtataaaagaggaaagggaaaccttcatatgaaacagagaaaagttgctgtgaggcttcaaggtgtgctggttgtggcttctgcactggtacttattcaagaataagtgagatttttaaataatagctttattgaaatataatctacatactataaaaggcaccctttaacaaatcaatgattttttttagccaattcatggatttgtgcaaccttcaccacaatccattttagaacattttaatcacttcaaaaagaaaccctttatttattagcattcactccccgttcctcctcccctcagtccctggaaactgtgaatctagtcagtttccatgagattgcctatgctggacatttgatatagatagaatcatatcatttatggccttttgtgtctggcttctttcactcaggatgatattttcaagggtcatccatgttgtagcttgtatccagtacttcattcctttatatggtcaaaaaatattctattatgggttggacatggtggctcatgcctgtaatcttgcactttgggaggctgaggcaggcggattgcttgaggtcaggagtttgagaccagcctggccaacgtggccaaaccccatctctactaaaaatacaaacattagctggacatggtagtgcatgcctgtaatcgcagcttcttgggaggctgaggcacaagaattgcttgaacccaggaggtggaggttgtaatgagccaagatggcgccactgcactctagcctgtgcaacagagcaagattctgtcttaaaaaacaaaaaaaaaggtgactcttcatgatttttgtctgagcaactaggaggaacagtcctttacttagatggagaagactacagaaggggtaggcttgggtgatggcagcgaggatcaggagttcagttttggacacgttaagtttgagatgcgtattaaacactgaaggagagatgccaagaatacagttggatatgcaagtctagagttcaagcaaatgtctgagaagagctgggagggttcaggaagtcatgaaccctttgaatggtcctgaatctgggtaatattgtcagcaactgtacaacctcatgggaaatgggaagcttgtacctccatctgggagtatactgttttaccatgttctgtctatatagcagcctccatttgttaaacaaaatttatatcttaaatttacatcttcagtgtttgttagcatctttccttcaatcacataactgccacatagaggtggcacccatacaaacacttaaattccttcctttttggttctctttgcatcttctcacaatactcactatgttttctgcaatctatattttacccccaaaaggaaatcatgtcattgtttcattgaccaagaacaagatcctcctcctttggtactcactacaggacagtcttcttttttttttgagacagagtctcgctctgtcgcccaggctggagtgcagtggcacgatcttggctcactgtaaactccacctccagggttcaagtgattctcctgcctcagcctcctgagtagctgggattacaggggtgcatcaccacgcccagctaatttttgtatttttagtagagacggggtttcaccattttggtcaggctggtctcaaactcctgacctcaagatctgcctgccttggcctcccaaagtgctgggattacaggcgtgagccactgcacccagctgagtcttttcttaatataggatattttggatatgaacaagctagccataaggttcaaatatgtctgcaaataactcggaggttaacaacacaagttggctgggcgtggtggctcacgcctgtaatcccagcactttgggatgtcaaggtgggcggatcacctgagattgggagttcgagaccagcctggccaacatggtgaaaccccatctctacaaaaattacaaaattagctgggtgtggtggcacacgcctgtaatcccagctactcaggaggctgagacaggagaattgcttgaactcgggaggcggaggctgcagtgagccgagatcatgccactgcactccaatctgggcaagacagagcaagactccgtctcaaaaaacaaacaaacagaaaaacacaagtcccgggaggtggagtctgcagtgagccgacatcacaccactgtactcaagcctgagcaagatacagtgagactctgtctccaaaaacaaaacaaaacaaacaacaaaaaaaacaaaaacacaagtcactttataggaatgttgtccaaataaggcctatagtgttgttccatgacaggtgctcaattaagtctcattcattgatcagttgggcttgacctggatatcatacaaatctttgcatattgtaggatcttccaggaaagaattctctagaatctctgtctattactccctgtagttccggcttagactcctttcacaggaagactcttcaccccagctatggcaaagcattttctttgtcactcaatttgctttgttgttttgttttctttcctgataatttctgtcttatggaaaatgggaactagctctgtcaggcttggtaatgtccaaaatctttgaatgttattcctaacataaaaagtgcctttctgagtgggaacaagctcaggcccctttccccaaagcaaaggggcctggctgactcctctgacatgtctttaaggatcagaaattcatgtccaaacctataatggctttggaaattgtgaattcatttaagtcattctgaattgtatttttgtgttttgctggtgctactacacctgatcaagcagtgcttcttttcagttgaattaaggttgcctaccaagctttaaaaagtaggccttggtggctgggcgcggtggctcacgcctgtaatcccagcactttgggaggccgaggagggcagatcacgaggtcaggagatcgagaccatcctggcaaacacagtgaaaccccatctctactaaaaatacaaaaaaaaaaaaatcaaaaaaaaattagctgggcatggtggcaggtgcctgtagtcccagctactcgggaggctgaggcaggagaatggtgtgaacctgggaggcagaggttgcagtaagccgagatggcaccactctagcttgggtgacagagtgagactccgtctaaaaaaaaaaataggccttagttttgatagacttcatagtatttttgattttctaaaattctattacaactcgtttagaatctttttcatctcatatggcagcctcttagtttgttaatactggttttcaaaaactactcacatttttggtgttgtatgtgttttttatgaagaaagtcagccaagctcttttggcctgacaagaaactttcttggtctatttcatttccaatcccctttctggtgatgttcagcatcttattggccttcagaattgcaggggtacaccagatttcatggaacaatacataatgattcccgtattactttctcacattataatggaaaaacaaagataatagataatagattctgattttcaaatgcctatactgaagtcattctccaagtctttagccctgcagatcatgtgtatatgtacatatatatttaactttttatttttagataattatggagttgcaagacatgtacagggaagaaacgtacagggaagtcccatgtacacttgccccaacctcccccagtgtgaacatcttacaacgttagtacgatatccatgaagcttattcagacttcaccatttttacatgcacttgtgtgtacatgtactcatgtatgtggctttatgcaattttgtcatgtgtagccttgtataaccacagtaaagacatttggccattcccccaagactttctcatgttactctttacagccacatccatcccccatcccaaatccttggcaaccactgatctgtcctccagctctataattatataatttttattatttcactattgttatgtaaatagaatcatgcagtatgtatccttctgagactgactttaatcactccgtaacttccttgaggttcatccaagttgttgcatgtatcaacgtatcattcctttttattgctgagtaatattccatggtatgaatgtaccacagttttttattttttattcatttatttatttattttattttatttttgagttggagtctcggtctgttacccaggctggagtgcagtggcgcgatcttggctcactgcaagctccattcccaggttcacgccattctcctgccttagcctcctgagtagctggaactacaagtgcccaccaccacgcctggctaattttttgtatttttagtagagacagggtttcaccatgttagccaggatggtctcgatctcctgacctcatgatctgcctgccttggcctcccaaagtgctaggattacaggcgtgagccaccgcacccggccacagttttttaaactaccctttgaaggacattgggtagtttccaatttttgactattattaataaagtggctatgagcatccaggtacaaatttctgagtgaaagtaagtctttatttctctgggataaatgcccaagagtgcaattgctaagtcatatgacaagttcatttttagtttttttttgttttttttttgggacagaatatcactctgttgctcaggctggagtgcagtggtgcaatctcagctcattgcagcctctgcctcccaggttcaagcgattcttgtgcctcagccacctgagtagctggcattacaggcgcataccaccatgcctagctattttttttttttttttttagtagagacggggttttgccatgatgatgcctaggctggtcttgaactcctggattcaggtgatccacctgcctcagcctcccaaagtgctgggattatgggcgtgagccactgtgcccagcccatttttagttttaaaaggggcagccaaaccatttttccaaatcgcattacttatttttagagttttattatgactcaatccctagagagatattccactgtttgtttacctcttcctaattagagaagtatccttctaacgtcccacggagtcagatgaatgtggattcaaatcctgcttcactcacttattagctgggtgagcctgaacacacgtttaacttttctggagtctcagatttcctgtctgcaaaatagagataataatgcctgagacagtaaggatttaacaagatcaacatgtaaaataccgagagtagagcataaggaacatagtcaggagttaatgctagttctctcccccacttcatggcagaataatcagcaaccatcactatcaggtatatggtactggaaattttacctggctttaacaatgcaaggaaatgatactacttttattcatgttttttctactaagttttatgtgtgtgtgtgtttttttttttttgttttgaaacagaattttgctctgccgcccaggctggagtgcagtggcgcaatctcggctcactgcaacctccacctcccaggttcaagtgattctcatgcctcagcctcctgagtagctgggactacaggcgcctgccaccatgccccgctaatttttgtatttttagcagagacggggtttcactatgtttggccatgctggtctcaaactcccgacctcaagtgatccacctgcttcagcctcccaaagtgctgggaatacaggcatgagccaccccacctggctgtaaatcatctttagtaggtttgttatgcacagtgtttcctgggtaaaactagtttccctttcttcctattaatgacatgtgctgaagtaattcttaccactcttggaagcagaaacaagttggtgtctctgcattatattctgtttttgttttttttttcccttataggtcggtgaacaatttcctgatgactggtccaaaggtaagaacaaattccattaattgatatggatttcactaatcttagcctgttgactaaagatgataaatgcagatttttcattatatccacatattttattatgctgtatacattacagatagaaagattgagacccagagggtgttagggacacatctaaaaccacatagcaaaccactgtcagcgccaagataagaacgcaggagcactgaatttatggctagaatttccagagccataaaagtcaacagccttttataggtgtcaggctgcaaagtcacacatccttctcagtgccccgtggtgggatgcagtttcccatgtttaaaatgctggaattgtactacatgatctttacattcatgggcattttcagttccaaaatgttgttttctaagatggtcatgtgatgagaactccttaaatttcatgaattaggtgatttgggctcattttggagagacaggatagtatagtgaagaaaggtgaataaaggataatagggactagagtctgataaaactgagtttcatttctagttctgccatttgctagctctgggactttggggaaattactttagctcactccctgggcctcagtttcctaatctataatatagtgcctatttcacaagttatttgtgatgtcaaatgagacagcatatttaaaggcttactccattattttggagggatgggagagtgagcaggaagagggctgtttggtcagtttagggtaaatgcctcctaagttcagtctgaatttttacccctatgtccctacaggcttacctgatttactccagcagtgtggcagctggtgcccagagtggtattgaagaatgcaagtatcagtttgcctgggaccgctggaactgccctgagagagccctgcagctgtccagccatggtgggcttcgcagtggtaagaaaaacctcagccacagctccctggaccctctggtcacaggttagagccccagggatagccccttgcctcctcgacacccttattcctcacctgctctcttctcttaggtcatctccctctccaggatcttctcttttccttttctacttcctttttcccacctgtagagttttttctttctttctcaacactctcattgctcaacaaatggatcttgccttactcccaatcccataccatccttggcctcccagctggctaaaggtctcctcacaatgtaagtaatatcaggaggtaggcaggggtcataattcctcagacctcttagccccttcctcagcagagagatactgggcaagtggagagtgacttggagaccagattcccatggagaagataaagagtggccatgccagtaaatgaaagagctaccaatcagaggttcttttcaagactaactgcacatgactcttagaccctaagtgttccaggaggaagtggggatgggttctttacaacctagccttcagattcatctccctccccatttcttcctcaggctctttccagtcatgtgtgtcaacagtaccctagccacttggtcataaaatgtgtgacctgaaaagacaggaggtgagaagagcagggctaaggccagggatggggcagaccatgcaagagggtaagatacactataaagatgggaaggccaggcacagtggctcaagcctgtaatcccaagctctttgggaggacgaggtaggaagactgagcccagagtttgagacaagcctaggcaacatagtgagaccgactctctgcaaaaaaataaaagttaaaaaataataataaagatggggaaataggatggagctagggaaagaggatataatgatggttattaaagaaaggtagcatgtctggtatttctttaagctgaaacccctccctctaactctggatttttggttcctgctagccaatcgggagacagcatttgtgcatgccatcagttctgctggagtcatgtacaccctgactagaaactgcagccttggagattttgataactgtggctgtgatgactcccgcaacgggcaactgggtgagtagtaatgtagggatgggtaccataggccagccaacgcacataaagaatgaaaagcctggtgggggtgaagaagagctgtattcttctaaatatgaagaaaatcatgcggaagatgggtgaacgagtttgatcccaagccctacaatgacaagccaggctaaatgtagcttagaaccttcttttcccattgagtagtttccttaatttaaatataaaaataaagaaacaacactctggggattcctctgttgcttctctcaaacacaaggggaacttccttccgtgttgcctatccccgtctactttccactctttacctccagtgctgtctccaatctcctgagccctcctgaccaatttccaacatcgttgttccatatttcaattgtacccctctttccccctcaatgctcgagctttcctcatctttttggcaccattttgtcccttctggacctcaatcaccagcagggcacgtgcaccctctgcccatgcgaagaggcactgttggcagaggagtgtactggcaccttgcaaagaatccactcggcaactacttacgtcgttgagccctgagcaggggattggctgaacctggaagtgggcgtgtaaaagtggcaaaaacaaatctagacggcaactgatctggatacagggcactcgcccaaccttaatcctctcctatcctggacccccccacccccaacccaattagaaacagcagcccaggaggctctgcgcccgcttgctcaatgacctgtcctccctctgcacttttccagggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggtgagtcccgcagcccttggaaataggcagctgctggctatatccactaccagctccaggtgcggacaactcttcagttcatttaaaagattggcaaaatgaggtaccaagtgggctggcccagtagactaactagacttctcgcaactcccacaggggcagttaaactcgccacgcgcttaatccggggcctctcactcctagctctctccccaggcggtgaagggcaccatgaaacgcacgtgcaagtgccacggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccggccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaacgccgcagctgccgccggctctgcggggactgcgggctggcggtggaggagcgccgggccgagaccgtgtccagctgcaactgcaagttccactggtgctgcgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgagagggagagactgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactgctgcacctctcttctgcacagctcctcccctgctacctgctgagccagattccccaggaatcttgaatgctttctctcctcttctccctttcctttcccagaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctagaggcaggtcctaagaaggagaaactgagacccttccttctcactaacctggttctcaaacaggcaggattcagagcactggatatcttccttcaatgagtaaacttcctgcaatgaaactgttgcttagtaggaagttcagcaccttgaaccttaatttattgcagtcattgtgatatgtgctctttttctaggtactgcacttattcttgaggatattcgggtgggctgtggtaacagatacaacctgtaggctctctcctccctcccatcttggcaggataccatcctccctaaagcctcacttccctggtggcccaagcagttatctggattgaggctaagctgccaaggattagtaaatcatctatttaaatcttctaatacattcactcaagagccatgagcttgctgcttgtggtacttgagtcttctggttttattctcagagagtacagcagggacttgtttatgaaacagagcaagaccttggggagggaagaaccaatccctgacagaccctctgtagcccaaggggcttcccagccagcttccttgccctaggacagtcccaggtctggggctgggcagctcttctagagcagaactggtcagatgctagacgacctcaaccttcctctcccagagtaggaaaagcagtgtggctggctccaggcaacaaaagccaagactctaggggttcacctgtaagagtcaagggttcccgtattccaaactaaggcaatggccaggtcagatcccaaacccttggcctcacccacacaccttctggtcttaccaacacttactgaggagagagtttccccttcctgaccggggatacacttcctttcaggtgttcttagtgcttcatttccagctttctcagcaaaaggcccttcacgccttccctctgcttttatctgaacctcctgaatctcccaactcaccttttctccttaatcaagaagcagcatatactaacctacctgtcccactttgcagaattactttataatgtacacgaagaaagtttggcaaggcagctagaaaatttaaaagcacaatgttgtaaagtaaagctacattctccaggtctcttagcataaaagcagaactattgtgcttcatatttggtaactccaggtcagcactctaaatacgtcatgccgccagaacattatttcataggttattgttttatacccccaaatggataccagattcattccagttctaccaagaaaacatgactgagatgccttggatctgtattgcttttcccttccttttgcaatatccacttgttcatttgttcattcaacaaacaccagagtagagatagtggtgaacaaccaccattgctgcatcacggagtttaagttctcatcttacactcaattgccagggccgtggtccctttacaaagtagacaactccagaactggtgcttgggaagacatctttgaggtcagccagtcaaaccttttgtgttacagatttaaactgatgctgagaaagatgactggcttcttcccccaactagtaagttactgtggggagagtgcagagcacaggccccttccacctcttgtgtgctcttcaggagcccatctgtctcagccagaagacagaaacagagggaggccctgagaagtgacaaggacattggttggggtgggcaaaacactgtctccttcctgtccctggcctgtgagcctaaacacaggcagagctttttctttttgaaaagaatcgcagcctcaactggccttagcagcaggttagggcaaagacagagacggggtcgtcttcggcgctggtggtgctggcggtggtgggaggggagggcaggccagggcactcgcctattgtaggtctggattggatgcttccactcattcatttccttttaattaacccgcattcctggaggagaaatatttatgttggctcccatagaggcaatcctcagactggaaagaagggggaagaaagcctgt

SEQ ID NO: 13596 - DNA, 15392 bp, Human
aagagagtcaaggagggaagcaggcatgttgctgggaagcctttggtgcagataaccttggctacttagagtctccaggtgtgttcagtgcttgtagaatgaggtcagtaaataccacactccaccccaggagagtggtcaacaggcagcaggaaaaggcttgccccagctacgggtgcagctgcaaaccatgttgggttagaaaggtgagggtatcaggtgtggtggtagaagagttaagaaggaagaagaggccaggcgcggtggttcatgcctgtaatcccagcactttgggaggccgaggcaggtggatcacaaggtcaggagttcgagaccagcctgaccaacacggtgaaccctcatctccactaaaaatacaaaaattagccaggcatggtggtgcgcgcctgtaatcccagctattcaggaggctgaggcaggagaatcgcttgaacccaggaggtggaggttgcagtgagctgagattgtgccaccacactccagcctgggtgacagaccgagattctgtctcaaaaaaaaaaaaaaaaaaaggccgggcacggtgggctcacgcctataatcccagcactttgggaggccaaggcgggcggatcacgaggtcaggagatcgagatcatcctggctaacacggtgaaaccctgtctctactaaaaaaaaaaaaaaaaaattagccaggcatgctggtgggcacctgtagtcccagctactcaggaggctgaggcaggagaatggcatgaacctgggaggcagagcttgcagtgagcccagattgcaccactgcactccagcctgggcgacagagcgagactccatctcaaaaaaaaggaagaggacagggtgtatctacaagcaatactaagccttgacatctgtcctgcacagggttggtctctgtgtccagagtcactgtttacattgattgggccctgggtggtacctgagatgctgggagaactcagattcttttctggacacctcactcgacataccaagtgttggagcagcaggactgtggttctcttctattctcagagtaggctttagtctttgcttctctttaccatcaggagaccaaggagtaaaaggaaagcatagttaaaaagaaaacaacaacaaaaatctcccaaagcatcgtgctctgcccttgcaataagaaccagacagcacgtgttccatgggagtccatttcaagcatgacagtgctcatggcggtgtctgtcacagaggccctggaagctgggagagttcaggcctgagctgggaaagtaggttaaaagcaccccagggtggcgtaacaaggagtcatgtgcttttcctaccttatgttcctgaacttggctgctttgatgcttctaggtactttcttctttccccaggttttctgtctttttcttccctttattactagtatttttaattcccaaagcaaaacatgttcaatgtagaaaagtcagagactacagaaaaatcacacatacggttgtgtatacagtgagaatcctcctcaccatcctatttccacttcccttcttttggtgtgcatttacctttttctaggttcaaataaatgtatatattatatacaaatattagttttgttttttttttcctgtgagacagagtctgtcacccaggctggagtgcagtggcacaatcttggctcactgcaacctctgcctcccagattcaagtgattctcccacctcagcctcccaagtagctggaactacaggtgcctgccaacatgcccagctaattgttgcatttttactagagacaggctttcaccatggtggctaggctggtctcaaactcctgacctcaagtgatccgcctgcctctgcctcccaaagtgttgggattacaagtgtgagccactgcgcccggccgctttcttttcttaaataaaaatggtaccatataatgtatttttccttttgtatttgtgatagttctgactcctcattctctctcctctttcctcagggatccggtgtgattaaagctggttttgctggtgatcagatccccaaatactgctttccaaactagtaagtcattctgtagcttagacgttttggaggctcatcagctttgttacaggcccagccctataagggacaggagccgagtttggagtcaacaaaggaaaacagttgtctacatggtacaatttgagaggcacagataagaggcctctttttaaaaatccaattttatctgatgctaaaaaattttatcattggtaacttattgctttggaggattgcctcttggtggagccctccttttaaaattctcctatcacccaggctggggattaacatttaacccatctaccatctttttttttttttttttttttttgagacggagtctcgctgtgttgcccaggctggagtgcagtggtgtgatcttggcttactgcaagctctgcatcccgggttcacaccattctgcctcagcctcccgagtagctgggactacaggcgcctgccaccgtgcctggctaatttttttgtatttttagtagagatgggatttcaccgtattagccaggatggtcttgatctcctgacctcatggtctgcctgcctcggcctcccaaagtgctgggattacagcccttctaccatcttaatgaggagtttctcagaactttcctcctaagacagagagactgcaggcaggagaagagcacagaggcttacaggaagggcttaaagggggaggaaaggaagaggctatctgtccgatctatagcatcacagttttttttgttttctgagatggagtctcattctgtagcccaggctggagtgcagtggcgcaatctcggctcactgcaactcctgccttgcaggttcaagcgattctcgtgcctcagcctcccaagtagctgggattataggcatgtgccatcacgcccagctaatgtttgtatttttagtagagatggggtttcaccatgttggccaggctggtctcaaactcttgacctcaaatgatccacctgcctcagcctcccaaagtgctgggattataggtgtgagccatcgagcccagcccagcatcagttttacttagaggtcctgggaaggggactaaggacactaaaatgttttgagttaatcactcctttagaaattctcatttcctcatctttcttggtctgttcatacactgcagaaagagaagaactagaggtattaaatactctaaaaatttgttttcataatttataataaatataaaatatgaaataatatataaataatacatgttcattttagaaattgtggaaaatacagaaaagtataaagaagaaaatcaaaatcaactgtgacttcactccttgaagataatctcagtagaatttgagtgtgtatgtacatctatacatccttcctgtgttctgtcatgaaatgaaaaatgatggtcctcctcactgtcttttctagtgtgggccgacccaagcacgttcgtgtcatggcaggagcccttgaaggcgacatcttcattggccccaaagctgaggtaattcccaggcctacagaacaagccttaagccagcagaggaccttcattattcaccacatggaacatgtcccaacatttggacatacccataagtaaaaggggcaactttctctgaaaatctcctttttgattctctcatcctaggcttaggtggtttatttttcccaggaacagcctgtggtcttggagaagaaaatacctgggacctcactttgggacacactgagaccagtctaggaaacagggctgttgtcttctgcatcctgtcactgccttgtcagtgatcaaatttactgtgtttattatttttttcacaaaaaatattcagtggggagatcctggctggggtaccctagggatgagttaattcacacagctttgtcagagccctcatgcagcctcttgtaagcagatagcagaatcgctgttgccatccttggcttcaagtgctgaggcccagaggtgggagccaggagattgtgtcctggaaccaggcaatgaggaagatgcctcctgccacttgccctagaggcacctgaggggccatggaaatgcagaagcccctgctttgccggctcctcgggaatgagggcagtttgcagcaaacagtatttagccttggagaatgagtgcccacccttagccctgggcaaggacagcagggtggaagctcaggaagctgaggcttctttgcaagggattcagcttgcactgcttagtcttgggagaacagggtcctgggtggagcctgactgcagtcgtaagtcctgttctcttttcccaggagcaccgagggctgctttcaatccgctatcccatggagcatggcatcgtcaaggattggaacgacatggaacgcatttggcaatatgtctattctaaggaccagctgcagactttctcagaggaggtgaggatcctgtgtgtagggcactcctgtagggtatgcaaagctgtgtcaaactcctaccctagagatgatgaggaggacgatgatcactgccaagagtgctggagccatttgattttcaggcatattcagatttaatcttaacaccattcctatgagatataggtagtattatctcattttacaaacaagggaacaagttcagaaaagccaagtcgtggccgggcgcggtggctcacacctgtaatcccagcactttgggaggccgaggcgggtggatcacgaggtcaggagatcgagaccatcctggctaacacggtgaaaccctgtctccactaaaaatacaaaaaattctccgggcgtggtggcgggcgcctgtagtcccagctactccggaggctgaggcaggagaatggcgtgaacccgggaggcggagcttgcagtgagccgagattgcgccactgtgctccagcctgggtgacagagtgagactccgtcccaaaaaaaaaaaaaaaaaagaaaagccaagtggtatttccaaggtcaccaagtgaacaaagggtagagatggaattcaaacctatgtcttttagaattcaaagcctgtgctcattaacttctttcacccagactggagtgcaatagctcactgcagcctcgacctcctgggctcaagtaatcctcccatctcagccccaccccccaccatgcccggctaattttgtgtgtgtgtgtgtggtggggttttgctcttgttggccaggctggagtgcaatggcgtgatctaggctcactgcaacctctgcctcccggattcaaatgattctcctgcctcagcttcccaagtagctgggattacagcatgagccatggcacctggcaaattttgtattttttgtagagacaaggttttgccatgttgcccaggctggtctcgaactcctgggttcaggcaatctatccgcctccacctctcaaagtgctgggattacaggcgtgagccaccttgtgcagcctgtgcttattaacttgtaaggaagtaactctccattcaaaaatgtaaagggaggctggtcactgtgggtcatgcctgtaatcccagcactttgggtggatctcttgagctcaggagtttgagaccaagttgggcagcatggcgaaacaccacctctactaaaaatatgaaaaaaaaaaaatagccgggtacagtggtgcgtgcctgtagtcccagctacttgaaatgatgaggtgggaggactgcttgagcctgggggcatcgaggttgcagtaagccaagatcgcaccactgaactcgcagcctggtgacagagtgagaccttgtctcaaaaaaaaaaaaagaaagaaagaaaatgcagagaggtgcagactaggtgtatcaatttccaggtgcaggtgggatgttttcagttttgggttttttttgtttgcttttttgagatggagtttcgctcttgtggcctaggctagagtgcaatggcgcaatctcggctcaccgcaacctctgcctcccaggttcaagcgattctcctgcctgagccttcctgagtagctgggattacaggcatgcaccaccaccaagcccggctaattttgtatttttagtagagacggggtttctccatgttggtcaggctggtctcgaactcccgacctcagatgatccgcacgcctcagcctcccaaggtgctgggattacaggtgtgagccaccacgcccggctgttttcagacagtttttttaaagcagtggtccccaacctttctggcaccagggactagtttcttggaagacagtttttccatgggggtgggggtttggggtggccagatagtttcaggatgaagctgttccacctctgatcatcaggcattcaattctcataaggagtgcccaacctagatccctcacatgcgcagttcacagtagggttcacactcctatgagaatctagtgccttggatgatctgatgggaggtggagctcagacaataatgctcgcttacctgccattcacctcctgctgtgcagcctggttcctaacaggtcacagactagaactggtctgcggcaggaatttagagtttcacaaaatcttcttgacagttggagatacacagtagacacaggggcctgtataacaatcttggaggacaaggaggggagttggggggcacagctgaggacagaatgaaattttaaagtgggcattaacttgaaaagttgagaaaactacttgggcagggatagttgacaggcacagcttgcctttttttggagtgaggctgactgaagtccccgggctctcaaaccagcaaggcagggtcttctcccctaagactaatgaagatggaaatctggccttggcctcattgtctcccgggctcctttcaccagcatcctgtgctcctgactgaggcgcctttaaacccacgaaaaaaccgggaacgagctgccgaagttttcttcgagaccttcaatgtgcccgctcttttcatctccatgcaagctgtactcagcctgtgagtagcagctggctagcccggcccctgcggggaaagcagtcctttggcacagctgaggctggctctcctctggaatggttcagagtaacttgagccccctctgctagggaaaggttaaagatggtgggaaagagagagaggcttttgctgaaactgagcactgaggcttcgtagttgaaagcaaagaaggacatgtggctgctattgaccatatcccagtgtcaggactcctagtgggtttggtccccaaggccttggctgggcctgccgaggcagccacatgctgcagcagctcttcccggaggcccccgtaatgtgtccacttattattcagcacttactgtggccagctgctctgccaggctgtgagacaaccatgatccgaatgccaccacagtccttgttcccatcccccgtggctcctgtcacactcctaccccacctcacaccagagtgaggtctacggcagagattatccacaagtgacctacacgtgggatttatttgaccccattaacaaactgtgagccagcatttaaaaatcaagaggtgtcccatcaaaacccaaatttttggcttctctgaaaaaatgggaagatctgggaaggtcgggcacacattcccacagggcaaaaatcagctggagctgaagagcggctgccacttgagatggggctggcaagcccaccctccccacagcctgtccatgctctgttggcctctccgcactgaagcagggggtcagttgcctcacttgcctttttttggagggaggctgacaaaggtccccgggctctcaaaccagtaaagcagggtcttctcctgcctttgttttttatggaagtgaaaaatattcttatttttctttactcttacttttcctgcctggcccctgttgacatttgagggtttttgccttttgtctagagagttaaaactggcccctaggctgggtctctgaagcagctgaaggccaggccatctcagacaggaaggcctgctcttctgggtacggggagggaacttggagaagatcagcaacttccgttcaggtatttcatggcttgctccaacacctgggcttccttagtacccagtccattctacagaccctggagagaggcaggcccaagctttagtttagctgacattgaaccctaaataaagaagtgtatttcttcccagcgtgaggaggcagtgctgagtgacggtttgcccctttgcttcagttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaagtaagtgctgccccctgggcctagggatggagtgggggttgggagcatagcacccaggaccttggtgacctgccagtgaagccaggcaaagcacctgcctgggggtccctggtgaggccttgttcttcccagccaggtctcccctacgtcacactgacagattcgccttcctgacgtgctgccatcttgttgggggaaagggagctgcttccatttcttcagttgggtgatggctacataggggctcagtatgttttttataccttatatgcaaattacatagggtttggttttgtttcattttgttttgtttctgagatggagtctcgctctgtcgcccaggctgcagtgcaatggtgtgatctcggctcactgtaacctctgcctcccgggttcaagcaatcgcttgaatcctgcctcagcctcccaagtagctgggattataggtgcctgccaccacaccccactaatttttgtatttttagcagagacatggtttcaccatgttgatcaggctggtctcaaactcctgaccacaagtgatctgcccgcctcagcctcccaaagtgctagaattgcagcatgagctaccgcgcccactcctggtttttttatttttatttttttaacatccttgaagaagtcataatacatttaaaacatttgtctttgtaagtaaactgaaacctcctgccacctgtggctatagggaaaactcgagctgggtaggaccagaaccatatgagtggtagaaggagaaagatgcctgggcctgggctgaacttaggttgtggtctcagacctaggatccaggggccaagtttccaagcttgcccatcaggaaggtggagcggttaagaactcatatgctaaatgccacccagtgaaggccaacagagacctcactgcccctgcttctgggcagcagctatagtgaccattggggccatcacaacgtttagacaggtttgtgcagcagcacattcctcccctgggcctttgactggatgtgcaccagatttcctgccagcctgactgtcttgcttggatctgcagagagcctgttacctatccataaacccccaaaaggatgagacgctagagacagagaaagctcagtactacctgcctgatggcagcaccattgaggtaggtggcctgccttctttcttcggtccccttaggtccacaaaagctctgggcccaaccagaattctccatcagggtctggagtctggcaggccagtccctttacaccaagcttgtccaacccctggcccatgggctgcacgtggcccaggatggctttcagtaaggcccaacacaaagtcgtaaactttcttaaaacattatgagattcttttgcaatttttttttttagctcagcagctgtcattagtgttagtgtatattatgtgtggcccaagacaattcttcttccaatgtggcccagggaagccaaaagactggacaccccagccttacaccctctctctggagcagcagagctcctgagcatgagtggccctgtctcctgcagaggaggcagccagaactttgctccctcccgctagaggggaggaagctcctaagggattgtcccacatcagtatgagattaggaagtgggatggttagtgccatccttcaccacacctgggtgcagtgtagggtgagttaccactcccttgaacccccattgctaggaagacgtttccatgagcaaataaatccatgtactgatgccaaagacctcttggctggaaaatgccagagcgagaaggaaatataggagcctcccctcactagtttccaggaggcctatctttgttcctttaagcccttgacatgtagagtctgtcttgagcctggccttcatagccacccagttactaagtgacgtgcagaggggcgtcttccattcccactcccaaggggaccttggtcccagctccgacctcttcagctggccctcctacctgcagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggtttgtctcttctcttggagcccttcccctggaagtgttcagctcctgctggctccaggcaccctgagaattgacttgaagttctcctctttgcccattcaggttttggtgacaggctcctgagtgaagtgaagaaactagctccaaaagatgtgaagatcagggtaggagcatggtggggcctggcctgggtggaactaggcttccatggacagagtgccacctggcgtagcttccctctagctttgcccaagctcttcaagcagccatggctctacaagcagcgccaggttcccagcctgtacactgaccctgaggtctaggtcagccacagggaggctgagttctcattctccctcttcacaccaaaggcaggcagttctaatacccagatgaggcagggtactaggtagagggccccctgcgtgatctttcagggaaactataatcttaagaggagactgacttactgttgctgtgccccctgcccaggtggctcccctgtcacacagtctgacaccttagtgataggtgaaggaggttggctgtctgaggagagcggggatcctaaaggaaggagtacagttcttgccatggagtctgcttctccctgccccccccaatagtcccagcttccctgggacctgtggggactggaaacctgcttccccagatgagtggcaggctggccacagtgccctccagagaggccagagcttcaggcttgtgtaaaatgtatcccctgccatgggcagaaagaggagcattgtagggaaagggagcgggagggctggaagtctcagattcctctttcccccacctttgcagatatctgcacctcaggagagactgtattccacgtggattgggtgagtagctcttccaggagtaagaacagaacaggaagtgatggcactgataacccctcagcaccctctaaagaaaagcctgatttggtttggccccaggggactggtaggctccacacacagccacttctctctcacacagttcctctgggtttcctccctccaggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttagccaactcacctcccttctcttagcccaagcctgtccctcgcacagcctcgcacaaaccacattgcctggtggggcccagtgtactgaaataaagtcgttccgatagacacgtcagctgggcctctatctgtctgtcaccagggccaagtggaaagaggaagagcagcaggcactgaatctgaggtggtgactgggcctgatccatcctctagagggcatcattgcaccagccagccttgtccagagcatagcccaagtcccagcctgtcaggtggatgcagagaaaagggtgatcacaccacagcctaagttcaagaacagaaggtcccactcctgtgtacactgtagcccatgggtgagactcaactccagatgacaggagcagctctcaacatccctgaaatcaaagattctcaaaactgtcaagtgaataagaaggccaggagcttggccgggcacggtggctcacgccacacctgtaatcccagcactttgggaggccaaggcaagtgcatcataaggtcaggagttcaagaccagcctggccaagatggtgagatcccgtctctactaaaaactacaaaaattagccgggcgtggtggcaggcgcctgtaatcccagctactcaggaggctgacgcaggagaatcgcttgaacccgggcagtagaggttgcagtgagctgagatcgcaccagcctgggcgacagagtaagactctgtctcaaaaaaaaaaaaaaaaaaaagaagaaggccaggagcttattacagtgcagtttccagggcccatactcagatatcctgattaatcacttctccgtttaaaacctgcacttgggaggaaaattgccaggtctttgccaaatggtaactatttaatcttcccaataaccttacaaaatatacgtgcttttgttgtccattttacagataaggatttggagccacagaaagattaagcaattttccaaagttctgcctttttttttttttttttttttttttgagatcatgtctcactttgtcaccaggctagagtacagaggcacaatctcaatctccgctcactgcaacctctgcctcctgggttcaagcaattctcctgcctcagcctcccaagtatctgggattacaggtgcctgccactgtgcccagctaattttcatatttttaataaagatggggtttgaccatgttggccaagctagtctcgaacttctgacctcaggtgatctgcctgcctcggcctcccaaagtgctgggattacaggtgtgagccaccgtgcccagcgctggcctttcttaatcccgaatgtaaacccaggccatagaacctacagcctacatttttaatcaccatgcagcctgtaaaaaaccattggcctagagcagtggttcccaattggaaccaattttgcctcccaggacacatctggcaatgcctggagatgtatttgtttgtcgcaactggtgtgtgtgtggggtggggtggggggtgctaaatgtctacaacagagaacaatctggccccaaatatctccagtgctagtgccaaggttgagaaatggtggctgagagtcatggttttcagtgccagctgcatgataaaatcacctacagagatgttcaaaatcctactgcccaggccataccccagacacattaagtcagaatcccaaggaatggaactgagatgtcagtattttttaagttccccaggggaccccaaggctgagaacctcgggcctaaaagaggctcctctctctttgactaccatgtccagcagtgatacatgggaaatgcactgaggcctaatggtcattttgggcccgagtgcctatgcagttaccaatctatgtttttctccctggcatcttggtaacccaccaaggtgggttttttttttctttgagatggagtctcattctgtcgcccaggttggagtgcatgcagtggcgcgatcaatgcaacctcctcctcctgggttcaagcgattctcctgccccagcctcccaagtagctgggattacaggcacacaccactacacctggctaatttttgtatttttagtagagatggggttttgccatgctggctcaggctggtctcaaact

SEQ ID NO: 13597 - DNA, 98439 bp, Human
  misc_feature (1)...(98439): n = A,T,C or G
gttgaaggtgtatttttttctccaggtgaagaacaactatccccacgccatctgagctgtgcagactggcgctgaccctgggggccagtgactgggtacctgttcattctctttccagagcaggggcctcgcttccgttggtttttctgcttgtctctcatttctcctctctccttttccccctctctcctgttatagctccttgtgtactgttgccttcttctccccacctttcctacctctacccatccccttttcttttttctcttttttccttcttcccttctcctatctcttcattaaaatgcatcagtgttgtagatgtttgttagatttctcttgattttggtgtgacctgaggcgatctggttgagtatgccgtttggggtctctagaatctcgagcattcatttttctttagtccagaactggtctattactgtggttcatgacggtggttagtactgtcggcagcattggaggacagatgataatctgtgcggagctgggcttggctgtcaagggacactagtatgtcctgttggtgacaggcccagacctgaaaagtcaagatactgagttcatcctttaggggaatgtctaggtaagcctcccacggaggggttgcagggaaaatgaatacaggcttttccctggctttttttctttggtttatcctcatatcttttgttccccaaaagtctgtctggtctcaggattacattcatataaaatatggggaaggagatgatttgtaacttgtatttcacttacagtcacagtactttctgtttgactgcttcccttagtttgaaggatcttagaaaacttccttacatctagccttagaaattttttctttcaacaacttatgagtgaactcagggcctgttgactttatctgtaacatgagaccatattattcctttgattttgatgaggcgaataatagcagtcatttaaaacagcccctttcctacctggggcaggtgggcgtttcccatccatagggctggtgtctggggtggaaagtagacaagccaggcgtaaacacacacttcgcgtgtgctgagtgatgtgaaggttaatacctgcagcggtgccccttccatcccctgcccggcttatgtggagataggaagatttcattaaataatattcattaccagaggcaggtagacaatctgtcaatctgtcagcttttagccatgaaactccaaactttgccctttgaagggtcttcagaactcagctccattgcagaaggggggccagagtgaatggcagtgggtgttgtctccgacataatcccttccagccgggacgccctcaacactttgccaggctctggagagagtgtggtctctgcccttcacttgcttgcagcgtagttggggaggcaggctgaacattagaagatggtgtaattatgtcttcaattatatggtacacagtacaggcactgaagaattgaagagaatagggagatcagagatggcttgcttatttaggcaaggcttcgaggaatcagaacagactataaaagggctgtgctgatagagaacgtgtgtgtgtgtgtgtgcgtgtgtacgtgcgcgtggggtaacgtttagacaggtggaggcaggaaagggaggccttccagaaagacagcatacagggcacaagggcggcgacatgggtgcgcatggccacacctgccggggagtatgaagaatcagctcgaatggagatcaggaggaacaggaaggattgtcgcaggcctgaagctcggcagagggattagatttgacagactcagatacaggaagccagtgaagacagggaaacaacatcgcctttcatttaggtagattttaagtttaagaaataactggttataaatttgaccacaatagtatgcttgtctctgtggagctgggaaaaactcctaggatttttaatcttgaaattcagactattgaagtgaagtttactcctctattttctctctctcaccagattgccacggcagtgaagtttctacagaattcccgggtccgccagagcccacttgcaaccaggagagcatttctaaagaagaaaggtacaggttccacagggctgtgcagcacggcctgcagggggactggggctggggcagatggaagccacggtgcaaggcaggtgctgagctgccaggacttcctagagctgcccactcatggggcagtggggctgaggcgaaccccccagtggggcatgcaggtttctttcctgacgatggagcggcaagatgacacgattcgggtaattaagcacggatgacttagtccagtccatcatggcaaaggcagcattcagtagcagagtcggcccattggatgagactgtggaggacttctggtttttggtctgctctgtgtcagtgaccctggctgcaggatgactagcttaggttaggagttcagctgcttcaatagagaatgagggagaaagaaatgaagggcgagggaaacgagatgactaacaaggtcaggttaaactcaagcttggggtcagtccgatttacagattgaagcggtaaattagtggttttatggtatttctgtaaacagggataaagtggaccctgacaaattcaatattgtctgaagagacaatctattctggttctgttggacttcagggtatttttctttttttgtaaaatgaaaactacaaagaaacctgacttttcaattttttatacatgtaattttctagaaatctaggaagtcatttacacatccttatataccatgaggggcaaaagtaagctttcttcctcccaaagcaaaactctttttccttaaggagctggaatgccagccttgaaattctgagttttgagctttcagtcatttttggctggaataggtgggtgatatttcctaggtctgctctgtgatgtcccgctgaagggatgcagcatgaaccattggtcccttcatgcgatcatgtcccggggctgcactaacagggtttgggcagaagaagcccaaacatttcaccacaggcagctgcttcgcggcagccccaaggctgggtccctgcgacagagttggtaaggagcactgcacggctgctcactggctgcattgtgccagcacccccccccccccccgccatcattaggagattattaaaatttggagtgtgttggctggcctcgccactccgcaagcatcatgccataaaagagtttttccttgaaatatgtgtacctatggggagtaattaatcataaaagcttagggatttcagctctctcatcaaagcattgaagctggggaaagctgagcctaaaagctgagctgattacccggggtaacctgagacaaaatctatggttgccgagagatccttagctccagtatattgtgcaatattataactgcctgatcttctcttccaccgacaatgaccagttagtcctcattttctctcaaacgcagctgggttagaatttcatttgcagaaggtatttagagcaatttagagacaaatgtctctggtgtttgctcggcacttccccaccgcaggctttgctgagcagttttagtatcaggagctccatctaatctgtttaattttaataaatccctgactgggagagggagtgaaaaaaaaaagagagagagaaactctggaccaaataatacttcttttgagttacttggctaataattactgtagagagaaaactgttttgtgcaattatgattcgttgctcctttagcaaaaaaaatccaactgatcaattcatccaagagtcattgtgcaccctatgccctgtccctggactcccatcaggaatttagcagagaaccgaacagacaaaatccctgccctcgcagagcttaaattctagtggagggaaggcagacgattaacaaatgggaaaatgaaataggtcggatgtcagatgccgagcgccatggatactgatgaatgaagcagggagccggggtgaggaatgccagagttggtgtgggctggactgtgatcttaaacaacatgaatgtcagagtgtctctaagagggtggcacatgagcaaagactggaaggtgactgtttattggtacagtggacataattccttcttgacccctaatttgggttagagtttttagaattttaggcatctggcaccttgagatgctatcctgcccttcgtcctctaaagagaaccatgtgagtttatcccgtacttaaacctggaatctctgaggttaatcacccatctccattatcctctaaaatgctgcttcagtcagtaattatccatttccgagttgaatcccaatggagtaggttctggcaggaccttttctgggcagagaattccaaggtttgatcggtgtctggggaagaaaagccccttcgcagatttaagcttcacttttcaaatttcgggctgttccagggtcaggtttccgtgctcagcacggcctggcaccgtctccgatggggatgagggtgaacatctactgggtccctaacagtagttgtggcaggaaagcaaattggctcgctggccgtctggaccaggaggggcctgggttctggcacccgtgctcttggactccctgcagaagccttgcagtgctgggcttggagcatgggctctgggagggctctcagctcctggagtcttggcttttcctagcaatgtcacttcagggaattgcagtggagcactgacttgaattataatcttgactttcttttttttaataaacatctctttcctgaaaaggcaaatccaattttgtttttcttttaatattatttaatatttaatatagaaattgaggtccctgtagtgcatgtcagttcagtggaaaatgaggcgcatcagctgagtttgtttcattgtgaaaccgcagctgggagcaggggctgcatcctgtccgtgttaccgacgggttaagtgttgtgctctgtgacttctggtgggggtgctgggtgagggtgagtagggaatgagtggtatagggatggaagagcattggtttgcaaaggtctttcctgttactttttttttgttttttgttttgagatctctttcggatgctttaaaatctgaacatggagccattaatgagaaacgtgaagttattagaatcatttatcattttctttgaagtttgtactgccattttgtgtaatttacaacatttcttccttttatcgggaatattttggatgaaagaaaaaagcagctgctcaccttcagagtattagaataaatgtttttgttttccttccaaccacttgattctgcagatgacacatcaactgcggagtcagccacacatcaagataattggactgtgtgtggggtttaagccctcagaaccagtctatatatagaagcagttcttgccaggcaggcatcatatctggggctttaagcaggctgcaatccaggaggttagagtaacgtaaaaacagcaatagaatcagtccagaaagttagaggcttggaaattgtcgtcaataggcttgtgttgatttgacaccctatccagccacaaaatgtaggaggcaatctgcttccaaagatgtttggcaggctgaggatgaggtgggtaatagtgatgcttgcttgtgaggggggtgaggtgggggagggggatagagttgtctgttaacttactctaacatatctgttgcaaagcaagcttctaggaaagacaaacatcatctatttttctgtataaccctgcatagtggggcctgggtgctgttggctcacacttactgtgtccttctcaagtgtctaagtaaagggctttttcctgcctcatccaagaaatggtcctggttggggtaggcaaatgaaacaaataaaacacaccaccatactttctcattccaaaaggtgaaactagatcttatccttctactgttcctggaagtagaaaccccggtagcaaaaccgcctccttgctggaaatgaacttgaagaaacctggcggtcccaaccttggtagtgggctagaggtaaagggcttctctgtagaatatttcaagggggagtaaattcttacacagatttcaatttaactctcttttattacttttcttttttttatcatttacgtctatttcatgaggtagtttgcatgtccttgaatggaatctcgttaccatgaaagcttttttagcattgatttcataacagtcttaatttaatagctccgtcattactgagaagctctgggagtggggccctggctttccaggtcactgaccttttaattacaaaccttgttctgatggccaggttatcgactggacagctcccagcttgtgcccccaggatgaaaacgaaaataactgtgtttcctcccccatctccaggaaaaaaaaaaattgtaacctcttgtgtttctaaaattaattttctccttcagctttactttataattaattctttaatgtgtcttagtgaagccagaagtcttttcacaaagcttttcttcctagagcttgggtccagcagatagcttggggggagggcacggaaatcttgccagctcccaccccttgcttgcgtgtggcccatttcctcatcctcagaaactcctgcggctgagctggaaggaatacaattggctctgtgaggggctgtctggcccttctgattttttgttaacgagacatggattgtggcatcaagatttagattcattcctctgtttgttggagtcattgaagccagtatatcctggacattttttaaagaggtccccattctgagaaaagacaggagttgaatgtcttattgattcttacctttctgttcgttatagacgaccagaggaaacaaatgcccgacacggattcgactcagtcataagtgtgaaccaaataggccgatctgggttctctcactgactgaagaggaagagaaataagagaggacagtgggcaaaatgtagggtgacaaccaagggttctggtttgcccagaattgccctgggttcaaccctgaagttcccatgttgtggacagccccgtggtcctagacaaacaggtcaccttagcggtaaaagcctttctcaggagtgagagctaccaggggagacaaaacgggtttggttttggaacctggaggaagaaggcaaaatgagaagagtccactggcagtgagtcccggagaggcccgcctgcagcagcgtggcatcttccgcacccacttcctgctctttctcccgtagccctgccctagtgtgggtccagtgcagagcctctgggggcggggccgtgccctgcaggtgagcgaggagctgctcgtgcggagcaggcagggctgtgtggcagccgcgcttgttcctgaggatgattgagcatctccatccatctgttgtgaacggaccgtcttccttccctgccagtcttgcacctgcatattcgtcacctgctgttctggcccagcctattcatcacaccgactggtcccccgcatcaattttcccgctccccctgttatccaaacttgccttgaactccacagatttttctcggcatccaggacgagacctacggcagctaggccagccgaatgttgtagaaacagagatgccctggcttccccattcagagcgggagctgatagcacttgctgccccaagaaggctgagctgaggggtttcctccacttcaccctgcgatggggaaatagtgcagaggagtttgcggggagggaacactttcagatttacccagttacttttatgttttccctgcaactgaagactgattcttttcttaaacttgcgtgcctgtaacaatactgcaatgaaaaggaaagtgacaaaatgacattggcatgtattagtaaaaaaaaaattttttttactttttgaaaaggtaaggcatatacatggtcttaaaaattcaaacagtagagaagggtatacagtaaaaaataagtcttctcttctcattctctcattcctgttccccacccgttctcttttgcagaggatgctacagtttcttatgtatcattccagagataatctatccacatgaaagcatgttaatatgtattactcccccacagaaacacgaatgctttctaaatacagtggtagcatattttacactttactcgtatacttggtgttatatctcggcagtcattccacatcgatacatactgacttgcttcattcttttcagtggctgcataatattccattatatgcatgtgttatccttttaaaaactagtcccggctgggcgcggtggctcacgcctataatcccagcactttgggaggcagaggcgggaggatcacgaggtcagaaaattgagaccatcctagctaacacggtgaaaccccgtctctactaaaaatacaaaaaattagctcggcgtggtggtatgcgcctgtagtcccagctactcgcgaggctgaggcaggagaatcgctttaacccgggagacaaaggttgtagtgagccgagatcgtgtcaccgcactccagcctgggtgacagagcaagactccatctcaaaaatagaaacaaaaacaaacaaaaaattagccccaaatttgtgagcatttaggttgattcctatcttctgctgtctcaagcaatggcccaatgaatattcttgtcgtatacattgttgaacgcgtgttggtttggcaccatgctgaagtcagagcatttttgcatatggtaagcaggataggggatatttttcttgcttaaatttcatgggattatgtttcatagtaaagaagataaaacttttttaaggtaaacatggactataggtagaaggaagttaataagaggaaaaagagtaacaaattgcggttaacacttagcacagatttggattttgaagggatggacattctggttatgtgaaaaattcttgctttctttttttgttttgagacggagtctcgctctgtcgcccagggtggagtgcaatggcacaatctcgactcactgcagcttctgcttcccaagttcaagcgattcatctgcctcagcctcccgagtaactgggattacaggggcctgccaccgcacccagctaatttttgtagtttttggtagagatggggttttaccatcttggccaggctggtcttgaactcctgatctcatgattcacctgtctcggcctctcaaagtgctggtattacaggcatgagccaccactcccggcctgctcagttttgacctagccattgagggaggcagtgggcacagagagaaaagagcaggaaggccttcgttagtgaggggaggctcaggcagagacgcatgtgccagtcgctggattggcgtgtgaggaaaaagaagggaagagaattgaggctggtgagataggaagtgagggaggagctggggttaggacccaatattatataacagtattgcctaggctggaacgtaatggcatgatcatagctcactgaagccttgaacttctgggctcaagcgatccttctgccttagcctcccgagtagctgggactacaggcacgtgccaccacacctggtgagtttttttgtagagacagggtctcactgtgtttcccaggctggtctcaaactctcggcctcaggtcatccttctgccttgccttcccaaagcattggaattacagacatgaaccacggcacctggcccatggagcacagagaaactctgtttgaggaagtttactctcggctctgtattgaaactgacttggcctggcaataataagaccagccacaaagatggtcctgctgagtccgtcttcaggtgtgggggatctgggccgggttggtagcagtagagatggaaatagaaatgacagcatatttatgtagacagttctacagtttacaaaacactatcacatagttgattttttcactatgaccctagtatgtagtgggcaggttaatgaatattagttgattttttcgctgtgaccctagtatgtagtgggcaggttaatgaatatttgttaaatgaatgaaaacattatttaatgaatctcagagtggctcttttctcccattttacatagatgaagaaattgaggtttagaaaggctaagttgagctaatacatggcagaagtagaactagaatctatgtcttctgaccaagattctttgaactataccacgtactttctggagaggaaggacagaaccacagacatggcagaagaaagagtaagccatgctcaggagggtgtgtgtggcaaagggatgggccaaagatgactctcagggttgctttttttgtgttaagcagctttattgaggtgtaattgacatacagtaaactacacatatttaatgtgtggttttaaaaagttatgacatatgtataattgggaaactatcatcacaattaagataatggacatgcccagcatccccaaaagtttcctcctaccccttggtaatcccttcctcctgtggtccccccaacccccatatcctggtttgcaagtatgcattgatctgctatcactatagattagccttttttttttctttttctttttctgagacaggatcttactctgtcacctaggctggagtgcagtggcgtgattacggttcactgcagccttgacctccccgggatcaagtgatcctcccatcgcagcctcccaggtagctgggccacaggcacacgccaccaaacccggctaattttttttgtattttggggagatagggtttcaccatgttgcccaggctggtctcgatctcctgggctcaagtgatctgcccaccttggcctcccaaagtgctgggattacaggtgcaaactactgtgcctggccctagtttgcattttgtagaaatttatataaatggaattatacagtgtgtaattttttttgttctggcttttccactcagcataattactttgaagtttggccatgttgttgtatatactagtggttcattcctttttattgctgaatactattccattatatggctatactacctgttgatggacatttgggttgttttcagattttggatattaaaaataaaggtgctgtcaatatttataagtttttgtagggacatataatttcttttgggtacatactttaggatggaatggctggatcatataataggtgtgtgtttaacattttaagaaacttctcaactgtttttgaaagttgttataccattttacattctcaccagtcatgtatgagtgtaccagcattttgagcctggagaataggaagatgaaggtgacaaattttctagtaatgaagccacttgactttggaaatattcttaagagtgactaaataataggtcatgtttggactacttcagctttagaggcaacagtgcataaactatctgggtttgaatcctagcttcaccactctttagctgtgtggtcctgcataaaatacttaacttcgtggtacattggtttctttatctgtaaaatgggattaatgataatatttactgcaaaaaattattgtaagaattaaatgaaaattggctgggtgcggtggctcaagcctgtaatcccaacactttgggagactgagacagaaggattgctttagatggaagggttgagaccagcctagacaacacagtgagatcctgtctctacaaaaaaaattaaaaattagctgggcgtggtggcgcatgcctgtggttccagctacttgagaggctaaggcaggaggattgcttgagccttggagtttgagcttacagggagctatgattgtgccactgcactgtagcctgggtgacagagcaagacactgtctcaaaaaaaaagattgaggagggggtagaattaaatgaaaatgatatggaaagtgcttagcagagtgtctggcaccaaaataagggcttaattgatgacaacaatcatcaatagtatatgttctcttagaagatatattcttaatgggctatagtcagtttgctgtaattgtatcataagaattcgtgcatcaggaacctctaggaattttgagcagagagggatttaatacaggcagttaggccgggtgcagtggctcaagcctgtaatcccagcactttgggaggcccaggcaggtggatgacttgaggtcaggagtttgagaccagcctgaccaacatggcgaaaccctgtctctactaaaaatacaaaattagccgggtgtggtgacgcttacctgtaaaccaagctactttggaggctgaggcaggagaattgcctgaacctggaggcagaggttgcagtgagctgagattgcgccattgcactccagcctgggtgacagagcgagactctgtttcaaaaaaaaaaaaaaaaaaaaaaggctaggtgcggtggctcacgcctataatcccagcactttgggaggccaaggtgggcagatcacaaggtcaggagattgagaccatcctggccaacaccgtgaaaacctgtctctactagaaaaaaaaaaaaaaatcagccgtgcgtggtggtgggcacctatagtccccgctgctcaggaggctgaggcaggagaatggcgtgaacccgggaggcggaggttgcagtgagccgagattgcgccactgcactccagcctgggtgacagagtgagactccatctcaaaaaaaaacaaaaaacgaacaactacaacaacagcaaaaaaaccagatggttaggcacttactcacttattgaaaaggctaggagggtagacccaaggttaggccttcaggaatgactgccagataatttgccagggtaggtgctacctctgtcctgatcaagcagtggggaatcaagaggctgtcactggagctgtggagctcaagtgcatgtccttgcagctgtgatccagggaccaagaagttgctgctgcccccactgcaagtgttgtgtgacacctggaaaagcaacgacaggacattggaatgtgggcttggcttctacttctgtgaagattggctcttgacccccatgaagctggagactggacattacaataggaaacctcagtgtttccaatatcctgcctgcccatctgctgatatttgcagcaatcaaaagcagcaagaacagcagtcctctgccttatttccactttccaaattgtccatgagtgcacctaattggtggtacctaattcccatccagaactctagctgccatggagggaagcattttgtgcaatatggcgcaaattatgggtgcgttagtccccgccttaaccacggaggagacgttccaagacctccagtggatgcctgaaacctcggctagtaccgaactctgtatgtactatgtttttcttatgcttgcatacctttggtaaagtttaatttataagttaggtacactaagagattaacagtgttaactaataataaaattgaacagttaaaacaatatactgtcataaaagtaatgtgaatggactcaccacctctcccaaattatcttattttcaggtaactgagactgcaaaaagcaaaaccacagataaagggagacttctgtgtatatgtgacagaaggatacttttatgcttttttagtctattattatttttttagaagacttgggcctttgttagtaactgtaatgatatacttccagtttgtccaagagataaatattgatgtattctgtatcatcactggctttcgagatgattttaagaaaacttgttggctgggtgcagtggctcacgtctgtaatcccagcactttgggaggctgaggcaggcagatcacctgaggtcaggagttcgtgaccggtctggtcaacatggtgaaaccctgtctctactaaaaataaaaaaaattagccaggcgtggtggcgcatgcctgtcatcccagctacttgggaggctgaggcaggagaatcgcttgaaccctggaggcggaggttgcagtgagctgagatcgcgccactgcactccagcctgggtgacagagtgagactctgtctcaaaacaaacaaacaaaacaaaacaaaaagaaaaatttctttcttatctggcctcacttagggatggaagttcttttaatgagatttatctgctaagggtagacaagagagtttccaccaaaggggctacatgatatgcgggcttattggaactgttggaaaatgttagaagcagggatttttgaaacttaacataaggtataacataaggcaatctctactgaaaaacattttatgttgattggactgtaattagaaagatttaaaaataactttggatagtattcattaatttaccaatccattgttatattcaacactttcgagctgatgtcttttaaaaatctaagtttatctgttggggggtggtgtatgaattagtgtatctgtaattgtatgaatacggagtattcttatctttgtatgtgatggtgtgcttctattttaaatttatttttaactatagataggcttgctaggttggtcattccacagcttggtcttctttccgtttttgaagtaaaggtaactcactaatggtcctcagtaaacagagtgatggggcaagctgacttatatttcaattgttctgagaattgaacaactctactaatgtttcctttccaacttcaaacatacctgttcagtttcttcaacatcctgataggagctgatctcctcagaactctcccctctcatcagacagaggacttgggcatgctctaatctcttactgttaattattctttttagttttaaagccctttaaagtaatctttctgtaattagattgttgagtagattgtctttagtaatatggtggtcttaaattttgtgtggattttcagattgttaaatggttgcagaggctttcattcatgaagttcaagtttactatatcatggtatgtcaggaaaaaaaaaatcatgaccctctgtgataaattaaatatcacaaccacgtaaatgtcatcttttcaatgaaactgaaagtgcataggaatgggactctttttcagtctgttttggctttaagctgtaagaaaaatattttaacactgacagtagtaaacctatgaagctaaagaacaaagccatactctccccagctttataagtcacacgcggaattgtgaattaaattattctaattgcaaaatttggggtcttggccgaaagaacacaggttgaatttgaagaagaggcagctagaaaaatcggtgtaacttttacgtgaagataatttgcacagaatgtaattgaaagagaataaatatggagctccatgatgtcctctttgagtctatttctcatatttacttacatttttttttcccaatcaaaggctctcctttaggcagtcctgaaaagaggagacacagtgctgaaatagaaataaaggttaagtatctccgatccaaaatgcttgggaccagaaatgtttcagtttggattttttcagattttggaatatttgcagaatattgtgttggttgaacatccctattccaaaatcctccaatgagcatttcctttgaatgtcatgttggcactcaaaacgtttcagattttggattattttggatttcagatttttggatcagggatgctcaacctgtaacaggcagaaataatagaaaataacagaaataacataaaatagcactgttctttggaagatcttagtaccttatttggaaatatttttactattcattcatccaccacccatccatccatccatccatctttccatccaacaagtatttattgagtgcatgtatcttacaaggcatggtgctggccctgggagtgaggatgtaatgttaccatttacataaaacaaacagaggcctggggtggaagcagactccacagaaatatgaacaaacaagcaaaatacagataagcaaggtgctgtgagagagaataatggagagggtggggtaggtttgcattgggaaggttgctgagaccagaagaatgataagtggttctgtgaagaatgagaatcccgggcagaaaggacagcaagctctcaaagactccaaggcaggaaaggagcttgatttgatctaggaactcctgcagcagtgagtgaaaatgagagtgacattttatagcttccatctggagacaccatggaaaataaaagttctattctcccagtctagaattgtccatgtcagctgtgaccaagttcagctctgttcaccaagcattcctcatctgctgtttgccaagtgctatgctaagtgcactggggacataaatggtccacacccttagagaacttggtgatgaggctgtagaagctactagtaatacagatgttttaatttacaggcaagcctgagatgatacggtacagactgtataatagccactggcatgtgtattttgctttacagcttaaaagcattcacacatacatttgcccatttaattttcatggtaacctaagtcatttcctcaaaaagtgtaaacatgggcttatgagacatatggaagcccacccaatttgaggagcagggtctctgtcatcactgagttgaatttcagggtgtagtctgcgcctgtgctctccccttgaagaatcacattatagaaaatgaaatctagaatgactacagaggttacttagttcgtctataccttttcatatacatttcagtaattattttgctacataggaagtgaatttaatttggagtttttcctgctgccttccatgagggctttcatcctaagccccattcttgtgtgtgagaagaggaagtcttgggcttgagtgtggctctaaagtaaatgccgttgactttgttgttctgtatggacgcttttatcaggacaataaagggtacatagggtgacctctgctcctgtggagaggtcgaatggttacattacacaatcttctagagcatcttgcagcaaatacatgggttatattaaaaattgcaatcatatcattttttatagtaaattgctgaccttctgcagcggaatcagctttattgaatttcgccaaaaatgtgtttataattctgccatacacacatgatattcatgtccttgctgtccatgtggaaatgtccctttttataatgttaaacaaattaaatcgactttctcctgagcttccgtgcctcacctttaagatccattctcaggagtcgaacctccatgaagccgagctcatctccattagcgtggatgtcattacacagcgcgctggaggctggtgcattaggcagctttatcccagcagcacggattcggcttggagattctttagaggtgactccagggcagtaaatgtttttcacgcatactgcctgaacactaacaaggccttaccataattactctgtttgttttggggaaatggtaggtatttgtttaaaaggattttgtggtgaaccaagaatatacatgtgtagttagttctcgctattcacttgtgaatgatgcattgtagaagttttatcttataccaatttttctttaattttctgcagctctacttcccttccaaccagtttggtatcagggatgcaaactaattttaatgttagcctaacaaaaatacaatcagaaagttatggccaggcacggtggctcatgcctgtttacagtcccagcacttagggaggctgaggcaggtgtggagttcgagaccagcttggccaacatggtgaaaccccgcctctactaaaaatacaaaaattagccgggtgtggtggcaggcacctgtagtcccagctactcaggaggctgaggcaggagaatctcttgaacccaggaggtggaggttgcagtgagctgagatcgtgctgctgcactccagcctgggcgacagaacaagactctgtctcaaaaaaaatataagttatactgcatactgcatacttagatgaaacataaacatttaaaaactatctccgggctgggtgtggtggctcatgccagtaataccagcactttgggaggccgagacgggcaaatcacgaggtcaggagttcaagaccagcctggccaatgtggtgaaactccatctctactaaaaatacaaaaattagctgggcgtggtggcggacgcctgtaatcccagttactcaggaggctgaggcaggagaatcgtttgaacctgggaggcggagtttacagtgatctgagatcacgccattgtactccagcctgggcaacagggcaagactccgtctcaaaaaaaaaatctgctttttagattcatttactctaagtttgttcatgcctgttatctatatatttatatctatgtttgtatcaattgttggttcccagtttagcacatagaggcagtatgattcactggaaaaatcctctatccatttactaattattaaatatccatttccttcatgtgccaacatttgtgctaaacataaaaatacaaaaataagatttaatatttgtagtttagtggggttccatgatatataaacagatgtggtgtgggtgataaaatattataggtgctataataggtatctgagcggaggcctggggggagagcgatcagttttgtggtaggggaggagaactagtggcgaagaggttaaaaaggtgcctccattcatggaggaggtcccctttatccgagccctgcaagaggattagttgtttttaaggtctgaagcggattggtgacttttgtccatgcagaggatgtgatggggcatagccactaaggcgagagatcgaggagacagcttggaaaggtgggcaaaggtgggatcagggaagacctggcatgtgttacctcaagagtgtggattttgttatgtggacagtggggaaaccacggaaaagttgtatgtggaataataagtttcatgctagcgttttagaaagctctctcaaaggtagggcgggcatttaggagaggggaatgatggatgaaccagggcagttattacggggatggagaggatggattagagagtgaggaagcagaatctcctgggaattggtggctgaatggatgcaagagtgaagaagagggaagagtctgggctcactgtccaaatttttggcctagggagctggtgtggaggatagcagatgaaagagtagaccaggagtgagagacgctgtgaagagagaaggcccagagggaggtgcgggggaccctgtcacgtggttagtggttggccagaggcggatgccccacagtcaggcagtggcgctggcttctgcctttcaaagtcgcttctacagggtgaccgttaagcttgttctttgacgccgacattgttaagtggtttcactgaaatttgagactctctgaagaaaggaaagatggcatttatgaagcaagtgttattttatctggaaatgatttctcaggggtaagcctgtcactctgcctctggtaaagtctgcttctccctccaagaagagaaggtcccactgatttgggtcatggtcagagtgggccgctactcccaccttccactgaaaactcagcttccagaaagctcctcttcactcctttgtcatctgtttcctcatctgctcttccctgagtttgtccttctctgttatatctgcatgtgtttccactgatctgcttgtgacagtcaacctgtttgctgatctggcctcggcaattttcagggcttccctgcacacctgtgacatgacggttagttccctgaccttgcatgcacctcggttttctggtagcagatggtctttgtggtacctttactcttacaaatcagtggagtcagaagtttacaaaatgtgggccgggcgcggtggctcacgcctgtaatcccagccctttgggaggccgaggtgggcggatcatgaggtcaggagatcgagaccatcctggctaacatggtgaaaccccgtctctactaaaaatacaaaaaaaaaaaaaaaaaaaattagccgggcatggtggtgggcacctgcagtcccagctacttgggaggctgaggcaggaggatggcgtgaacctgggaggcggagcttgtagtgagcccgagatcgcaccactgcactccagcctgggtgacagagcgagactccgtctcaaaaaaaannnnnnnnnnnnnnnnnnnnnnnnnnnnnnnnnnnnnnnnnnnnnnnnnnnnnnnnnnnnntgtgtggagctgaggcagaaagcctaaagggcagactccaaaagggcagactccaaaatgatcaggacattaactgacttcctgggagatcccagagcacacgcagagtcattgaactccatgatactcattccaggtcaccttgaagaggcagggagaagggcattttcgcttcttgaagcttctgctcctctgccggttcagcctgatcttagagctctcttggcattgcagctgcagtcaggttttccttttaaatgactgcagccttcagatgcccacacagtgcagtccagatctcatgcctggggctgaaggtggacctggtttggcggtaaattatgatccacagctttgaaagcatataggctgtatgcttttttttcttttttttttaaagacagagcctcacactgtcacccaggctggaatacagtggcgcgatcttggctcactgcaacctccatctcctggggctcaagtgatcttcccatctcagcctcctgagtagctgggattactgatgcgtaccaccatacacccagctaatttttgtagttttagtagagatggggttttgccatgtttcccaggctggctgtacaccttttaaaaataaagcctatctgaaagcaagttgcttctctagaggcatcttcctcagtctgcttttgtccagccttcccgtggaaagcagccttcttcttgatctggggctgcagtaaatcacatgctggccatcgcgggaacacatcccatcccttcccaaaaccacctgcaggactgaccctacccccaaataacacaccaacctgctgtgttttttactgaccattcctgtccgggatagtcactgtagcagtctactttggtgggcttttacctctcctatctgctttttttttaatttacaaattttaaattaaaaaaatttaaatgaaaggtttggacattgagtattgttacccactcacttctggtgactcttcagacactcactcgaagagccttccttcttccctacatacagagtcggggggagagatggggaaaatgacggaggaaaacatgctaaaaatgattttcaatgtaaaataagggagggaaaaacgaatgtttgaggaaacccaaaaaaagcacctctcattacagtaattaaaccgcagcgtttaacctatcagaatgtgctgcatatgtgagagacaagccagggagctctgtgtttgaaattagagctctaatcctcagggaagagaatagttaaataatttgtttttgaggtgtgagagcagagccggcaaggtgtgagtgtgtgtgtgtgtgtgtgtgtgtgtgtgtgtgcatgcacccgtgagggtgaggggccgcagtgcctgtgtttaccaagaataccctggaggtagatatttatcagcacctgtgtgctgtcaagaagcacacaagctgctgttgcccgttcattaggttttcagaagagtccgggcctcacctgtggccgggcgttgcatcataacagcagaacttgcttcattctggccctctgggacacacaggaatagatttgagagacaggatgagacatacagagaaagacacaagcattaggggaggaagaaagccgaatgatcctggagcatgtccttggcgcaggcactgctggacaaagcagtccatctcggtgggctggcactgcggagccagcgtggacattccaccgagcacgaggcgaaaggggcagcccagaggcctgccactgaaaccgccttctgcaggcaccgtctgccagtgctcagcgctgttagcagggctcctcctctgctgggatgaggggttgggatgacaggagttcacagtgtcctgcctgccccttcagcagcataacctttgtctttctggactcctggctggagctggtgatactgtgaacatgctgcctctctggaagctgctccatgtctccctatatccccagagcatggcagctgtgatcagaattccacagggtggggctgatgaggatccatgcacatccgtccctgtacccctcattagggacttgggttggggggtgcctatctgcacgtgttctttttcctctcatgcactttgtcggtctctgtgcagggtttctattatactaataaggagcactggggacgctggcgacagtgtgataatcgtccccttggagggccagaggcagtcggtgtgcgctgacctcatcctgggggagtgctgatgaaactctggcttggccttactgcctgagcactgcgcctgatgtggagggttagggggcagggttgccgggctgtttcttctacggcttcattgttaccagccatgcttgtctttggggcatttcatcaaaacttctttagttttgcttaaggaactttaaagagctgatgagcctaatggaaacttttcagtaataactcagtacaggaacacacttcacaaataccagctaattaatcctcagagcaccctggggacaggggagagtatggtaatggcactggtgatttttatccccattttatagactgagagactgaggcacctggaagaatctgtgacttgggccagagggagggcacaaatctggaagctgaggttagagtgctttgccttttggcctctcttgggactgttgagtcttaccttaaagtcatttgagtaagtcattaagtaaagccagtcaccttagattttgcctcttctctcatctttcttttttttttccctgcttgatactaggtcttggatgtaactggtatccatcaatacagatctctagcatcaattttagtaactgccttgtgttctgctgaaaatatatgccataatttattgtaacccagtccccttgattatcttcatttttcacaattatagcaactcttctttaagtatccttgggaaataggtattacttttgtgattacctttgtggggtaaaaacctcagagttaggctgggtgcaatggctcacgcctgtaatcccagcactttgggaggccgaggtgggcggatcacttgaggtcaggagtttgagaccagcctggccaacatggtgaaacctcgtctctactaaaaatacaaaaaatagccagctgtggtggcgggcgcctgtaatcccagctgctcgggaggctgaggcagaagaattgcttgaaccctggaggtggagtttgcagtgacccgagatcgtgccactgcacttcaggctgggcaacagagtgagactctgtctcaaaaacaaaaagcaaaaaacctcagagctgctaatcctaggttaaagaaaatggacttgttttcattttaatgtacattgctaacctgtgctttaaaaaggtgatttcagcttacagcctcaacaccagttggccagtgccccgagcacaagtctcaaacttccacattgtcaagttcacagtttcttcctttgtctaagcatggaaaacccttcccccactgcaagggcatagaactatttgcctacctttttttttttttaaatgattttagttttcttttatggaatttgtgttgttgctagttgcgtaacagggaatataactttattttttcctgttgaccaactggatagtctcagcaccatttatagaacgatttatttctttccccactgatttgacatgtcacctttttcatctgctaaattcttaaatatactgatgtgtgatcagggacattctattctcattcattgctgtacttgtctgttgttgtgctaatgctgcaatgtttttattattatagatttgttacacactgtatttgttagtattccgttgtactcttttacaaaaatataaaaattttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaaagtgctgcgattacacgtgtgagccaccgtgcccggccttcttgtatatttcttaagacattttagaatcacttttatcatcttcttcttgatcccaccccacccctacccactgcgaatcaagaaagaagatccctttgaaattttgatgataattacattcaacatagaaattactttggaagctggacgctgtggctcatgcctgtaatcccagcactttgggaggccgagacaggtagatcatttgaggttaggagttcaagaccagcctgactaacatagtgaaaccccatctctctactaaaaatacaaaaattagctgggcatggtggtacacacctgtaatcccagctactcaggagcctgaggcaggagaatcacttgagcctgggaggcagagattgtggtgagctgagattgcaccactgcactccagtctgggcgacagaatgagaccctgtctcaaaaaaaaaaaaaaaaaaaagaaagaaagaaattactttggaaagaattggtgtctttgcagtatgcactctttccatccacggatgtggggtatctttcaagtaaaatatgtaatgcccctcactgatggttttgtacagttcttgcatagttcctgcacatttcctttaattctgagtacctgtatttttaattttttattcttgctttaggatatttatttccattatattttctaattgatctttgccaatagttaggaaagctgttgatttctgtgtttttagaattattttattatttttaatagtcctaattgtttttgttggttctcttaggttttctcagtagcatatcacatgaaaataacattttccttttccaatgtcgtatgactttattattattattttgactggcccttctagaacagctttaattaaatatgagtgcacaaggaggtacattgggaggtacaatcacccccttttctttaaagcattaatttagagatgaagagcataggaatataagagacatagccatgatgattcctagacttttcaaagtccttgctttgcaggactttttcatctattttatttttagtttttcacctatttggtccagtatttattctttggccaaaaatggcttgacatgctgaaaaccaccttattttagagaagaaaatacacattatttctattttgtcaagcggaaaagctgaaaggcattggaaataactcccagtcccttggcaaacagatcagtgagtagacccctgtgtgagacaaagccactgcctggagaggatggtgcgggggctggcggtccattgccacggctgctgcagctctcaacaccacggcagcctccccccaccaccacccaacggtgtacagcctgagtggaaagggcaagtttttggccgaaagagtaaatgaaacatggacgctgtaggacatcatcagaagtgattatttattctacagaactagagacttctcttctctcagaggacaactgacagcagcttctgtgtcatcaggctgctgccctcaccctgagacagattgtggtaaaggatggaacagggggtcatttgatgatcttaggcctggggagctgcgaggctgagttcttgcgttttcagtctcgcctcccctgctccactctgcgttgctgccagatgataagattccagttctgctttcggcgtgtgtcttccctgcactcctttgggtagttcccattgctcctaggatcaagtcctgttgtctgcttgtattctttctaatctgatttttttcctccatctattttttcttttttttgagacggagtttcacttttgttgctcaggctggaatgcaatggcacgatcttggctcactgcaatctctgcctcccgggttcaagcaattctcctgcctcagcctcccgagtagctgggattacaggcgcccgccaccgtgcccagctaattttgtatttttagtagagacggtgtttctccatgttggtcagactggtcttgaactcccaacatcaggtgatctgccagcctgggcttcccaaagtgctgggattacaggtgtgagccaccatgcccggccttccatcttttatatttaacagcttcaaatttccagaaaagtggaatagcgtatgaacacccaattaccttttctttctttcttttttggagatggggtctcactctgtcacccaggctggagtgcagtggtgccatctgggaccacaggtgtgcaccaccagacccagctaattttttgtttctttgttttttggtagagatggggtttcgccatgttgcccaggctggtctcaaacttctgacctcaggtgatctgcctgcctcaacctcccaaagtgttgggattacagacatgagccaccacgcccagcctcccagataccttttattcagtttcttagttgttaacattttgcccccttttttttttttttttttgagacggagtcttgctctgtcgcccaggttggagtgcagtggtgcaatcttggctcactgcaacctctgcctcccaggttcaagcaattctcctgccttagcctcccaagtagctgggattataggcgcacaccaccacgcccagctaatttttgtatttttagtagaggcggggtttcaccatattggccaggctggtctcgaactcctgaccttgtgattcgcctgccctcggcctcccaaagtgccgagattacaggggtaagccactgtgcctggcccattttgccacttttactttgtctcactctctacacacacacatatacacacacacaaaccctaatctgaccatgtaaaaataaattgtagatatcatgacacttcacctgtaattacttcagcatatacctcctcagatacggccattcttccacacataaccacaccatgttaccacatagaagaaaattaacactaattccataagatcatctgctatatatcccatatttacattttcccagttgcccccacatttcttttgtatctcagattcaggggacagtcagggcttgtgctgtgcatttcactgccatgtctctttatctagaactgccctcttgtctcttctcattttacttgtcattaacattttttgaggagttccaatcaattgttttatataatatcacacattctgcatttgtctcattgtttcctcttgataagattaagattaaacatttttggcaagaacagttagtaagtaatgttgtgtgcttattattgcattacaataaaaggtgagaaagatcagattcttccagtattggtgatgctaatttgattggttaatgaggtgactaccagaactctccatattaaaggtacattttcccttttgtaattaacaagtaatctgagaagtgcttctttgagatcatgttatctggttactcaacagcctttcattcagtggttttagtatccattggagattcttgtttcaactgactgtttctctggaactttaacagttgtgattatgtaactgtattattactcatttattacctattatttttctgtaaagagctctctcctctttcctcttctgtttctttctcttctcactttcatttgagtgttattatgtactctttagttcagagtgctataatctattattgtcatttttcttcctttttacccgagacaaggtctcactctggctatcttcctgcctcagcctcccgaatagctaggattataggtgtatgccactgcgcctggctaatttaagaataattttttattttattttattttttagagacaaggtcttactgtgttgcccaggctggtcttgaactcctggtctttagcaatcccttcatctcccctgcgcactgccccctgctgccccagtagctgggattacaggcatgagtcatgaggcccagctctttttctttttctctcttttcttgtcttcttttctccacccacccccaacacatgtgtatgtatcaaaatcaagaagataactatacaattctatgatcagatgtacagaccatattcaaatttagtcagttgtcctaataatgccctttatagaaaaagaaaaagatttttttctagcccaccatctaatccatgatcgtgagttgcatgattgtcctatctctttaccccccttaatttggaacaatgtcctgcagtcttcctttgtcttttattaccttgacatttttgtaggatagaggccagttttgtacactgtacttaatttggatttatctgatgtttcctcatgactagatttcatttgtgcatttttggtaagaatacacaggagtggtattgtgtctttccagcatcataaaaggacattgattttgatttgttctgtgatttcactttgatctgttggttgaagtggtatctgccaagtttctccactgcagagttatattttttccctttataattaataagtaccttttgaggagatacttcgatccttcgacactatatgagtagcctgtttttatcagcttcatgaacattgctaatgattcctcactgaatcaattattatgaagattgctgaatcttcatatcagttattatgaggattgctgaatggtgattttctttttttctttctttcttttctttttttttagagacagagtctctctctgtcgcccagggtggagtgcaatggcatgatctcggctcactgcaacctccatctcccgggttcaagcaattctcctgcctcagcctcctgagtagctgggattacaggtgcacaccaccatgcctggctaattttttttttttttttggtagaggcggggtttcaccatgttggtcaggctggtctcgaactcctgaccttgcgatccactgaccttggcctccccaaagtgctgggattacaggcgtgagccacggcgcctggccgctgaatggtgattttctaatcctcttactattgaaatgtattcttgctgnnnnnnnnnnnnnnnnnnnnnnnnnnnnnnnnnnnnnnnnnnnnnnnnnnnnnnnnnnnnnnnnnnnnnnnnnnnnnatttttgcatttttgtatttgtatgccaggcatgtgctgggcatagtggcacatgcctgtcagctactccggagccggaggccggagaatcccttgaacccgggaggcggaggttgctgtgagccgagatcgtgccattgcactccagcctgggcaacaagagcgaaactccgtctcaaaaaataaaaaagttgggccgggcgcagtggctcacacctgtaatcccagcaccttgggaggccgaggcgggtgtatcacgaggtcaggagattgagaccacggtgaaaccccgtctctactaaaaatgcaaaaaattagccgggcatggtggcgggtgcctgtagttccagctactcgggaggctgaggcaggagaatggcgtgaacccaggaggcggggcttgcagtgagccgacatcacgccactgcactacagcctggcgacagagcaagactcggtctcaaaaaagaaaaaaaaaaaagttatttcattattttctggcttctattgtcatctttcagtcttgttattgctcctttgaagaaggtgaaacatgtttttatcttctggcagcttttagatttttttctcaatctttggtgtttttttcaaaagtagttttcctatgtgatgttcctgaggtggttttctttgtagttatcctatgtaacatagaatctttgaatattcggcctgattgccttgttagttttacaaaattattaattattctctcttttaatattgttctgtcttgttctcattctcttctttcctggactccagttgtaattgtgttagaccttctttccatgttctttatgtcttttgctctgttctacattgtccatccgcttttctttttctttactgatctttcagtttactaaccctttcttctgctatatccagtttgctgttaaacctgtctgttgagctcttaatttcaattattgcattttacagttaccttgtttgcatttgatttttttttttttttgagacaaagatttcactgtctcactctcttgcccagactggagtgtggtggcacaatcaaggctcaagccatcctcctaccttagtctcccaagtaactgggactacaggtgtgagcaaccacacctggcctgatttttctttttctttcttttttttttttttttgtagagacagggccttgccatgttgccaaggctggtctcaaattcctgagctcaagtgatgccacctgccttggcctctcaaagtcctgagattataggcatgggccactatgcctaacctgatgccttttaagtttagttttctagtaaacttctctgttttgtcacctgtttcattgaatatattaattagttcttttaaagtctttgataaattttaacactgggctatctatgagtttgggttttttaaattcattttcccccacttggtcctattttttgtatatcttttttttttttttttttgagacggagtcttactctgtcacccaggctggagtgcagtggcacgatctcagctcactgcaacctctgcctcccaggttcaagtgattcttctgcctcagcctcccaagtagttgggactacaggtgtgcaccaccacacccgactaatttttatatttttagtagagacgaggtttcaccacattggccaggctggtctcgaactcctgacctcgtgatctgcccgcctcggcctcccaaagtgctgggattacaggcatgagccactgcgcccagcctttttttgtatatcttaaaatattttattgcatgacagtgaataattgagaagctctgaaagatactattttcctctgaagtttactttatgcttgtgtaaagtgggacttatgaccttgatcaatcaggatttggcctgagtcaggttgcagggttttagaaaataagtctgtcttcccctggtcaatccatgttcctagggtatgggtcccaacaaagaacctaaagttcttcatggctccttttccttggtggggtgaaccctaatttttgtttactgctgttgaacttttacaagctatttcatctcagttagacgcagaaagcctctcaatgctgttttgatttgaatttctcttttgaacttaagagccatttttattttcatatctacaaattgactattcatgtattttaccctttcttaggattaggagattaatgttttaaaatggatttataattttatattctcaactttggatcttaagctctagccttactcaatttaaaaattgtaactgagtgcaatggcttgagcctgtaatcccagctacttgggaggctgaggcaggaggattgcttgaggctaggagtttgagaccagcctgggcgacctcattgctacaaaaaaacacaaaaattagatgggtgtggtagcacatgcctgtagtcccagctacttgggaggctgaggtgggaagatctcttaagcccaggagttctgctttgtgaactccatttgtttatttatttacatgtctgtctatttacttacatctctctagtccatctgaagatggacaaaagctctgcctcagcatcttatagggtatttgctcacctttctgcagttcccttctcactgagatcttggactctcaagtcttggttgccttggcagctccccagtactttcaatcagtttgtttttcagttgttctcagcagtattgttgaacttttacaagctatttcatcttggttagatgcagaaagcctctcagtgctgttttgatttgaatttctcttttgaacttaagagccatttttatttccgtatctacaaattgactattcaggtattttaccctttcttgggattaggagattaatgttttaaaattgatttataattttatatactaaggaaaatagccccatgtctgggatttgtgttacaaatatatgctattagtttgaaatttgtcttgactttgtttatgatgcttttgtccaggcagaatttttttatttatctatcatttcttttatgacttccttttttttttttgacgtggaatttcactcttgttgcccaggttggagtgcaatggcatgatcttgactctctgcaacctccgcctcctgagttcaagggattctcctacctcagcctcccgagtagctaggattacaggcatgtgccatcatgcctggctaatttttttgtttgtttgtttgttttgttttgttttgttttttagtagagacggggtttcttcatgttggtcaggctgatctcaaactcccgacctcaggtgatccgcccgcctcggcctcccaaagtgctgggattacagacgtgagccaccgctcctggccaccagtattattttttaaacctcaagttgtttttttttaagtaatcaggaatttatttcagtgtatagagtataaggattcaagttcagttttttccagctaataaaataatccagcatccattattgcaagggttgacacactttttctgtaaagagccagatagtaaatactttaaggttttgcaatttgtatggtctctgaacactactcatcgccactgtggtagcacaaaagcagccgttgacagtgtataaactaatgagaaataaaactttatttatggacactgaaatttgaatttcatctaattttcatgtatcattaaattctttttttgcctcctaactttaaaaaaatgtaaaaaccattcttagcttgcaggccatccaaaaatagacaatgggctaaatttgtctccctggctgtagtttcccatctctgcagtttttctccattgatttgcaatgaagctttatcctatgttaacttcctgtatatatctggacgtactctgttcacttgaaatgtttctttgtgtccaatgtcacactatcttacatgttttattatctgttaaaattaattttgcctcagcattttttcaattatttggaattttcttggctattcttatttctatataattttcaaaattagcttgcccagtaaaaaatgaaaaataaagatttttttttagacagtcttgctgtgtcacccagattggagggcagtggcatgatctcggctcactgcaccctccacctcaggagactgaagtggttctcctgcctctgcctcccaagtggctgggattacacgcatgcaccaccacgccgggctaatttttgtatttttagtagagacggggtttcgccatgttgaccaggctggtcttgaactcctgacctcaagtgatccgcctgcctcatcctctcaaagtgctgacattacaggtgtgagccactgtacctggcctaattttcttattttttgtagagacggggtctcactatgttgcccaggctggtcgcaaactcctgggctcaagtgatcctcctgcctcagcatcacgaagtatgggattacaggcatgagccactgcacccagccatgtatctttttcgttactactttgaatgggatgtattctttcattatgtctttcagccagttctttaatttgaaggcagtttttacatactgattttgaatgttgacacctagctagatacttatattgtttatggtacgttaattcatgtcagtttttccaggtgctatatgtaaataacactctcccctcttcttttccgttgcttatatctattactacttttcttgtccagttgcatcagcaaatacctccagaacagtgataaataaaactgatgattgtgaacgtatgatgtgtttctgattttaaataatatgcttttatatctttttaataaaagatgatgtcagctttggagaatgacacacatatacacaagtagatactctttccccccccccactcccactaacagataatcatattcaggaagtattcttgtattcttattgtattagagtttttactaagaatggatatcgaattatatctaatgtcctttatcacttacagaaataatcatataattattgtcttttgatctaatatgataaagtatattaatagataacagtgaatcattattatattattaatatgaattccagccagttgtagtgtagtattttttaaatgtgctagattctttgtgccattattttatccagcagttagcagaatagccgtaagtatgtgttcaagccctcagagatgatgaatttgttcatgcctttgtgttcatgccctcagacatcatgaatttgaggatatttggaaaaattaaggtagagtgttttttgttttgttttgttttgtttttgagacagagtctcactctgttgccctggctggagtgcagtggcgtgatctcggctcactgcaacctctgcctcctgggttcaagtgattctcatacctcagcctcccaagtagctgggattacagatgcacgtcaccacaccttgctaatttttgtattttttgtagagatggggtttcaccacattggccaggctggtctcgaactcctgacctcaagtgatctgcccaccttggcctcccaaagtgctgggatttacaggcatgagccactgtgcctggctttgaagtagagattgatggagatctagtttattttagtagtattggatgcattaaatataaacagtgctaatattataaatatcaaattctaagcattatagtactaaagcaatattcatgctttagtaaaatcatgaatactaattataataaatgtgaaaagtatgtaactattttttacaagtgagccatgaagtatgtgatagttgtgctttctcttttgtaaaatttttttttcatagagttaatggactctatttggggatggggcagattgcttagctgtgtacttatcactgattaatcctcactcagctcaagctgtaaaattcccctcggcaccatcaaagacatcaggcaacttactgttttcttggtgccatttctggagccctctgcccgccctcccactgcagtctggactgcgctctctagacctgttccccagttgtcagcctttcccaatgactctgggaagacccttttctctatcctgtggttgagttcctgtcttccaacttccatgtggtctttcttggattgcttctttgggttggtagaacagatcctccagtagcttcctgagaaggtgtgcatgggaggtaagcagcttttttagatccagtatctgaaaacatctttaatgtgccttcatgatttcatctttaggttggctgggtttagaattctaggttggaaatgattttttattagaatcttgaggacattttccattgttttctaccttcctgtgttgctgctgaaaagtctgaggtcattctgattcctgatcctttctatacaagctgtttatttccctctgaaagctttaccgcttgtctttattctacatattctgaaatttcacagtgatgtacatgagagggtcttttaatgtgaaatcttcttgtattatttctttaataatttcctctcctttgtgttgtatattgtttttttagaacctcgatagttggatggtagatgtcctggcttgaccctcaagtatttaagaaaatatattttctttcctatcttttatcttttttgccctactttatatgtaatttcttctaatagtttgtcttctaataatttttttttccaatgtttttcctgggtattgaatgattttctgctctcaggtgtttatgagagttctttcttttctgtgtgtgttcccttttttcccccacattccgttcttgtttcattgatgcaacattacttcttttcctctgataattaatttctgtttcttccaagcttttttgtttgtttttggatggctgtttttcattttcttttttgagacgtggtcttgctctgtcgccaggctggagtgcagtggtgcgatcttggctcactgcaatctccacctcccgtgttcaagcgattctcctgcctcagcctcctgagtagctgggactacaggtgcacgccaacacgcccagctaatttttgtatttttagtagagatggggtttcaccatgttggccaggatggtcttcgatctcttgaccttgtgatccgcccgcctcagcctctcaaagtgctgggattacaggcatgagccactgcacctggctctgttttttcattgttaagttttccattttccctcaaatgtctggtgatctttggctatccagtatttatgacagaggccataagtaaactgattggagcatctgtgggcatgagtccttcctaacatgtaagtgtaagatgacaaaaatcaaccagaagtatgtgttcaagctgctatgtctaactggaagtttctttagagaaaatgtcaacagggtttttttttttttttttgagatggtatcttactctgttgcccaggctggagtgcagtggcgtgatcacagctcactgcagtcttgacctccccaggctcaggtaatcctctcaccttagcctcccaaatagttggaagtacaggcacacgccaccacgcctggctagtttttttttttttttttttttgtagagacgggattttgccatgttgcccaggtgggtctcgaacatctgggctcaggcagtcctcccacctcggcctcccaaagtgttaggattacaggtgtgagccactgtgcccggccttcaacagttgttttgacatacacaattttcactttgtacacaactttagaatctaattttcagctaagatgtgattccattttatgttccagatattaacaccagttgcttctggatggtggaaatgtgtgttacttttcacttctggtgcctttaagcttttctgtattaaaaaaaaatgtgtttctaaagaatgtcatatggtatttaccagggggtgggggtgggatatagggttttgttgtttatgatgggtacagagtttcagttttgcaagatgaagagttctagagatggatggtggtgatggttggaacagtgtgaatgtacttaatattgctgaaccatacattaaaaatggctaagatgggccgggcacagtgcctcatgcctagaatcccagcactttgggaggccgaggcgggcggatcacttgagcttaggagttcgagaccagcctgggcaacaggatgaaaccccatctctactaaaaatacaaaaattagctgggtgtggtggtgggcgcctgtattcccagctactcgagaggctgaggcaggagaatcgctggaacctgggaggctgaggttgcagggagccgtgattgtgccactgcactccagcccgggcaacagagtgaggctctgtctcaaaaacaaaacaaaacaaaaaagcagtggctaagatgggacattttatgtgatgtttattttgccataatttaaaaattttcagtttttgaatgttcataatcagaaaaaataaagggagggagttttcataatcttcccttcaaccatcatcagtttgtaggatatctggaaaaatggaaacagaacacggagcttccagtttatgtagtacaatcagattgccagatactggacacaagttagagattttactcagctctttcctcagattgagaatttcctgaaattaaagggctgacagatctaacttgttaaactgcttactagattacatggcaaaagtggtatcttgtttactgacctatctccctgacgtctgacatagtaaggtctcaataattacatgttgatgaataaataaattaacaggatatgccagtactccaaaagattgtgctggagtaatcatacccttaccttaaacttatacaaataaggaggataaatctataaagcacaagaaaaatgcaggaggatgtctccatgagcttggattaggcaaagatttcttaattaggtcacaaagcctactaaccatagaacaaaaaggatgctacatcaaaatcaagcacttctattcatgaaaactgaaagaaggcaaagggacaagccatagagaagatattcataatacagtcatgtgtcactggatgacagagatacgttcttttttatttttattttgagacggagtcttgctgtcacccaggctggagtgcagtggcgcaatctcagctcactgcaagctctgcctcctgggttcacaccattctcctgtcttagcctcccgagtagctgggactataggcgcccccccaccacgcccagctaattttttgtatttttagtacagatggggtttcactgtgttagccaggatggtctcgatctcctgacctcgtgatccgctctcctcagcctcccagagtgctgggattacaggcgtgagctaccgcgcctggccagagatatgttctaagaaacgtgtcattagacaatttcattgtacaaatgttatagactgtacctacacagacctggagggtataacctactgcatacttaggctatcaggtatagcctattgctcccagactacaaagctatacagcatgttactgaaaaggatactgtaggcaattgtaacacaatggtacatatttgtgtttctgagcacagaaaaaaggtaatgaattgtgctacaacattatgatggctgtgacagcactaaacaatgggaatttttcagctttactataatcttatgggactaccatcgcatgtgcagtccatcgttaactgaaatatcatgtggcgcgtaactatatattttattcatctgacggaggtcttgtatctaatatatagagaactcctacaaatcagtaagaaaaagccacataacctaatttttaaagtgtacaggctttttgaaagtatacaggctgggcgcagtagctcacacctgtaatctcagcactttgggaggccaaagcggaggattgtttgagaccagactgggcagcatagtaagatcccgtctctcttaaaaaagggtgtacaaaagactcaaatatttactttattaaggagcatttccagagcgttaataatcatataaaaagatgcctaatatccttcctcatcagggtaatgtagcttaaaccacagcaagtcaccattatacacacccattagaatggcgaaaatttaaaaggctgagaatagcaaatgttgtcaagaatgtggagcagcagtaaccctcatgcattgatgatgagtgtagctgcctttaaaaagctggcactttctactcaagttaagtacatgcttgttttatgacctagcaattccattattagacataaacccaagagaaatgggtggatctatccataaaaagacatgtagaagaatgtatataacagctttatttaaaacagccaaggctgggtgcggtagctcacgcctgtaatcccagcactttgggaggctgaggtgggcagatcacttgagatcaggagttcaagaccagcctggttaacatggtgaaaccccatctctactaaaagtacaaaaattaactgggtgttgtggtgcatacctgtaattccctgctactccggaggctgaggcaggataatcgcttgaacctgggaggtggaggttgcagtgagctgacatcgtgccactgcactccagcctgggtgacagagtgagattccaactctaaataaataaataaatgagccaaaacctggggggaagtgtcccatcaacagaaaagtgggtggtttatgaaacacatacaaaaggaaatattacataagaagaaaaaagaatgaattactggtcaatgggtctgcatgaatgagtcttaaagaattctgtcaaagaagccagatataaaagaatacatatatttttatgaagttcaaggacaggcaaaacaaatgctgatgatcagagttgtagtggcccctctggaggagagtgaagatgccttatggagtactgggagatgttctggatctccgagtggttgttacacaagtatatgcatatgtacaaattcttcaagctttgtgcttaggattagtgtaattttgcatattaaaccatgtatatcatctcagcttttaaaaattagtgctactcattattagactagaggaaaataggacttagaacttgcaaatcacattctgggggaagaaaagatgatcagcaaaggctaggagagaaaaaaacaggagatgctacacacaatatataatcatgggatttaggaaatcccctattaaagaacagatcccaaactcagtgaaacctgaagaaaaaaaggccagttttatgcgtcaacaagagacataactaaaataaaacaacacaggaaagttgaaaataagggatgggctggatacagtgagcaaatgctaatcaaaagaaacagaattggccgggtgtggtggctcacactagtgatcccagagcttagggggctgaggcaggaggatggcttgaggccaggagttcgagaccagcctgggcaacatggtgagacccccatctgaaaaaaattcgtaaaagataaaccaggtatggtggtgtgcacttgtagtcccagctgttcaggaggctgatgcgggagggtagcttgagctgcactcctagacaacagagcaagaacccgtctcttaaataaaaaaaaaaaaggaagaaaagaaaaaaaggaaacagaattgacaatattaatattaggcagattagaaattcaagtttaaaatattaaaaagaatgcattgtcaatttataccattgcaaagttcaatgtacctagaagatgcaataatcatgcaactttatgcactgaaaaacgttctatcaaagtatataaagcgaaagctattagaaatatagaagaatttaaaaacgcatagttgaagatactaacacactttagaagttcataaatcacaggcaaaaagtaaatgagaatatgaaatagataacagtaaacttgttatatataaataaatggcattttgtacacataaaatggaatatttaatttttcaacacccatggtacatttataaaaagttgttaattggccacaaagaaaaattccgataaagcccaaaaggcagaaatcacatagcccctgcttctctgaccatatggcaataaagctaaaatttacaataagaagccctgaaaaaaaatttggccacttggaaaatttaaaacactcttctgcataattcctttcatctactttgtttggatttttctaacgttcttctagtttcttgagatgagcacttaatttattttctttctttcttgttttttgtataaaggaattagaaaaaaaatggtgactagcattgtctgatattttctcaaaatggattcctgaaatgtggaagtgttgactcataggatatgatggttttaagactctgggcacatagtgatagttttctgaatagggcatagtagatccttcaccaggggatgagagtacctgtctcaatatgctacttgagtgtggtcactaaaaaatgaccaagtagcaacaaaacagctttctcatattgttttcatttgcatctgtttgattagtaacagttgagcttttgaaatatgtttattctcagaaatgtttattcaatccttcttcccaccattttctattgggatattagtgctttacttattgatttttaaataccctttatatattaagaatattagttcttggccatgtttgcaaacattttccccaccgttccttgccttttatattttttaatatataaaagtgattattttcacataatcagatctaccaatcttctgatatttcctctattatttttatggtaagagattccatccccataattattaaatagtaataattacagtaacagctaacatgtattgagggctgattatgtgtcaggcaataagctaagtcccttatttaatcacaaaaaccctacgagatatgtattttttattatcttcttacaattgagaaagaaactaaggaaagagatgaaatagtttgtccataaacactgaaccagtgatttaaatattcatccacatttcgttttagtttttatggtttacgtttttatatttaactctttaatcctgaaatttgtgaaatggtgtgaagcgaagctcctttcaaacattagtttttccctgaccttcaaatgaataaatcatttttctccccagttgtttagtatgcttcctctattataaattaaattttaatacataacaaggtctctttcagggatatctattctgtttttattgacctatacattcttacacaagtgccacaatgttttaattgctgtacttttttttttttttttagatggaattttgctcgtatcgcccaagctggagtgcgtggtgcgatctcagcacactgcaacctctgcttcccaggttcaagtgattctcctgcctctgcctcccaagtagctgggattacagggtgccaccatgcccggctaatttttgtatttttagtagagggggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgcctcctgagttgggagggttcacgccattctcctgcctcagcctcctgagtagctgggactacaggtacctgccaccatgcccggctaattttttgtattttttttagtagagacggtttcaccgtgttagccaggatggtcttgatctcctgacctggtgatctgctatacccagcctggacacagtattttaaaaatatagtttgaaggtactggagagccaccaaaagcaagcagaaattggagtgaatttgattcttgaaagaaagaccccacccaggggagccacctttataaggctttttccttgaggtattccccaatccatcaggtgctagcaaatagaactcaagcagaaagctgtgtcatattggtttgaggaatcaggggatattttgagactgtgtgtcgggaaattgaagatggcaatcatagaaaggagagaaccatgctggggatcaccccgaagtacatataaacacccctcacatgctagactaactgctgaactgcccatgcacaggggaagtgccacagattccagcagagatttcagtagctgcctgctgtgggagagagagaatttggaggtggagtcttgtcaagttagaggcgattcgataaacaccttggactttgctttgaaatcccagaagggctaccccttaggggcaaatactactccccagggctatggcattttccctaggactaagggcaaaacaaaaataaagcataaaattgtgcctacaccagatctacaggtgatttaactgtctactagaaaaaactgaattctgcagaagaaaacagaatccagagcctctacaaactatcaccttcaacatccagtataaaattaaaaaattactagatgtgagaagaaacaggaccctgtgacccttactgaaatgaaaactcagttaatagaaacaaattcacaggtgaacagtaactttaactatgaacaaatatgttaaaagaatttacatgaaaaaaatgggtgaaagggtaaagaggtgaggagttgcagtggagataaggaagttgtgaaaaagaaccaaatgtaaatcttagaactgaaaaacacaaaacctgacactgaaatttccctgggtgagagacacagcagattgggcataacagaaggaagcatcagtgaacctgaagacaggtaaacagaaatcatccaaactgaagtatggagaggaaaaatagctggaataaaaataggaccagagccttaatgacctgcaggacaaaaatcaagctgtctaacatagggtgacagcagtactcccaaaaagcagagaaggatgaggcagaaaaagtatttgaagcaatattggctgagaaatttccaattttgattaaagtaaccccacacaaacagcagcccaggaagtgtggccaattacaagtaggataaataacaaagaaaattgcatcgaggtgtatcacagtgaaactgctaatattaaataaaaagggaacaatgatgagaattatggctgactcataatcagagacagtgtagcacacgggacaatggaatgatgttttcaaaatggcgaaagaaaaaagacactttatctagaattctctgtacagtgaaaataccactaaacatgaaggaaaaaaataaagacattataagataaaagctgagagaaattgtcaccagcagacatgcattgaataaatatctgtgtgagatcttcccattgaagaggagataatactgttacaagaaagagaaatctgttagggaagaggtcccaatccagaccctaagagagggttcttggatctcacacaagaaagaattctgggcgagtctgcggtgcaaagtgaaagcaaggttattaacaaagtaaaggaataaaagaatggctactccacagacagagcagccctgggagctgctggttgcccatttttatggttatttcttgatgagatgccagacggggtggattattcatgcttcccccttttagactatagaggttaacttcccgatgttgccatggcgtctgtaaactgccatggcactggtgggagtgtagcagtgaggacaaccagatgttactctcatggccattttggttttggtgggttttggccagctcctttactgcaacctgtcttatcagcaaggtctttatgacctgtattttgtgccgactttctgtctcaccctgtgacttagaatgcctcagctgtttggaaatgcatcccagtaggtttcagcctcattttacccagctcctactcaagatggagttgttctggttcacatgcctctgacaatactagatggaaatttgggtcttcaggaagggataaagagccgtgggaatgttaaatacataggaaaatatacaatactattttattttaattcttcagttctgtaaaagtcagttgactaaagcaataacaataatgtagtgttagatttatagtatactcatatatttatatgtaatgaacattttacaacaagagcacaaaggacagaaggggtgtaaatggaattaagactctttttcttttttttgagataggatctcactctgtcacccaggctggcgtgcagtggcaccatctcaactcactgcaacttctgcctcccaggttcaagcgattctcctgccttggcctcccgggtagctgggattacaggtgcatgctacctcgcctggttaatttttgtatttttagtagagacagagtttcaccatgttgcccaggctggtctcgaactcctgagctcaggtgatccacctgccttgacctttcaaagtgttggggttacaggcgtgagccactgcacccaaacaggcgtgagccactgcacccggccaagattcttaataaaatgtattatcaatataaacaataatacagtatagtacatacaattatatgtatcatattaaagttcttaatatgtaacatggtgtaatattaattcagagtagactgataagaatgtatattgtaatccctagagggaccacttaaaaaaaaatactaagaaatatttaaatatccagaagaggatactgaatggactaccgaacattcctagctgttcttttttttttcagtgcattatttttattatatttttattcatcaagttcatatgctgcttatatatgccaggcattgatctataaaagtagtaccttatttaatctttataacaactttattcccattttacagatgaaggacctgactcatagctattaagtgtcagagccaggattaaaacataagccacctttttttctaatttttgcttttaaccactatgttatgcttctagtggaggaagcagctgacacataaattaacaaataagtgtcctattgatatgagcgacaaaggaaaagaacagtcttctctgtctcaggaagggttcaaccagagaagcagaaccaatgggaaatagtatgctgttgccacgtctgaggctggagcttgaagtctacatggcaggtagtcagaaaaggaaaattaagagcagtctggaatcccatgagggcagaatgaaacctgtttccattcttgttgcctctgaccttggtgttaaacgaggatctttgttatcctttttttttttttttttttgagacagagtctggctctgtcgcccaggctggagtgcagtggtgcaatctcggctcactgcaacctgtgtctcctggtttcaagcaattctctgtctcagcctcccgagtagttgggattacaggcgcccgccaccataccctgctcatttttgtatttttagtagagacaggatttcaccatcttggccaggctgatcttgaactcctgaccttatgatccacccaccttggcctcccaaagtgctgggattacaggcgtgagccaccgtgcctggctaatccttgttattcttatttgtgcattctcccagataagcttgaggaacatctgagataatttaaaataattgggattttttaattgaaattgtgttaaacttataaaataatttataagtttataataatttatattttatttaatttataatttataaatttataataatttataaaataaaaataaaataatttgaaaggctttttcgtttgtctccctttatttctctttgcaacatttctttatactgatctaacattttgtaagactatagtaattttatatttctcatggctattatgaaaggaatttctcttcattttattttttaattattgctggtacataggagtgctactgatttttaattttatgtactatatcttgccatcccactttctcatgattaaattttataggtatatggtcaattgattattttgtaaacttgtctctagttcatagacattttaattttatttcctgctttattacataggatgaaactccaagaataatgttaaatgttaatgatgacagtgataatgagttttatgataaacagctttttttttttaagaggggaaaaaagggattatcatgaagtactacaaatatatcttacagctattgaaaatctgcaattcatgaagcaccagtgtgctttattcacatttattcacacattgaacaattatttggtgaatgaccactatgggttgatcagtattttaggttttggggatacagtaatgaataaggcagagaataaaagttcaacaccattaaaatcctcagaaaaccatataagataaaagaaaggttacaaagccatctatgtttgacaaccagaggagtattgtctagatagtaattgctgtagaaaagtacttctacctagggtgatcacagaggagctttggtgatggaagagataacccggaacaactgacaagctcagagtagggttgggaagaagctactctgatggctggaacatcaggggtggaagactgatgcctgactctctccagagtataaggcatatcaggggctgatgaataaactagtttgctttatttagtacagggtgaatatatggtaacaggcattttgttttgtttggtttggtttggttttgagatggagtctcactctgtagcccaggctggagtgcaatggcacgatctcagctcactgtgacctccgcctcccggattcaatcaattctgccaccccagcctcctgagtagctgggattacaggcgcctgccaccacacctggctaatttctatatttttattagggacgggggtttcaccatgttggccaggctggtcttgaactccttgacctcaagtgatctgtccctcctcggcctcccaaagtgctgggattacagccatgagccaccatacctggcctggtaacggtttttatacttacctctggggattcttggagattctgaggagatatttcaggggcaaagagggaatcaagaaggtgggactctgatttttctccgtacccctccggacctctcaaaacctgaacattacttttgtctgttttacatattggggtttccgtttatttattctttctacactttttttttttttgagatagagtcttgttttgtcacccaggctggagtgcagtggtgcagtcatggctcactgcagccttgacctcctgggctcaagcagtcctcctgcttcagcctccctagtagctgagactacaaatatacaccattgcacccagctttttttttttttttttttaaaaaggtgaggttgcactatgttgtccaggctggtcttgaactcctgtactcaagtgatcctcctgcctcagcctcccaaagtgctgagattacaggtattagctaccacgcctggctttttacacatttttattgaatacctactaggtgccagtagaacctaggtgttttaggtactaggaacatagcagtgaataaaataaccccaaatgtaatggtagagtgggagggagaagacagtaaatagaataaaatataaacataagtcgagtaagagcaatagaggattcttcttaggaatttgctattttaaatgggatggtttggaaaggcccctctaagataacattttgagcaaaaacttgaagaaaacgaggaagcaaaccatgcagatttctgggtagaaagagtttcaggaaaagggaatgaccgatgcagaagcttgaagaggaagttgtgtctggcaaattccaggaacaagaatggtaggccaggtggatagcagtgagacacgaggtcacagcattcacagggagtaaggttgtgtagggcaacagtatcttggtaaggactttggttttattttgagtaaaatggaaaatcatcagagtgttttaagcaaggagttataccatctgatgtaaggtttaataggatcaccagggtggaagctgggagactagtctagtgttgagatgtgatcagattccctggatatttttttggaagtaaatccaatagaatagcctgatttgtgggatctggatatgaaagagaagtagaaattaaggatgactccaaggtttttggccttgtgtgactacaagtttggagttgtcattaactaggaatggagcagtttggtggggcaagattaggagttcagtgttagacgtattaagtttgagatatcagacatccaagtggaggtatcaggtgggcagagggatattatgaatcaagttcagaggaaagatctgagctacagatataaatgtaacattgttaacttcttgattttgataattattctgtggttatatacaagcatgagcttccccgactcccaccccaaattaagacatgcttactgaaatatttaaggggtagggtgtgatgtctgtaacttagtctcaaacagttcagggaaagtaatcatatagacagatcaatagagaataataaagcgagtgtgatgaatttaacatttaaagaacctgggtgaaagatatatgagaattctttgtactatgctttcagcagcttttctgtaaatcagaaattatttcataacagaatgtcttttaaaagtgaaggaaaatacagacatttccaggcaaacaaaaagagaaaattcatcaccagcacactgtactgaaagaaacactaaaggagttttcaggcagagagaaaatgatcttacatggaaacatagaaatggcaggaaagaatgaaggacaaacaaaaggacacatatcaacgaatattgactgtgtaaaataagaatgtctttcttgtggattttaacatacattataattgaaatgcatgccagtacacaaaaggaggggtggagggaaagttatatgtgcgaggatctttgggggaacagtaaaatttctcatttatatcacactatagtaagtaaaggatatattgtgatgtctagggcgttggttcgcaagtgttttagtctcaggacccctttcacccttaattgaggatctcccattaggcaaacatccagtaattactgttgcagacaaattccattgacgggtgctaaaatgagatgaaggtttcaagagaaagagcaaagtgtcttttccgagctatttattaactctgaaagaaaagatagtaactttgcagtagagaaatccatcagaaaccaccttgactacaaggtaatagagagaaaaactgaattaaaaagaagacaggagagaaaagagagcactaaacaggtcaaaaggaaaacaaattgtaatatgaaagatataaacccccaaagttcagcatttacattaaatataaatggagtaaatactccattaaaagcagttggtcaagattagatttaaaagactcaatgctgcttgcatcagacacacctttagtataaagatatttaaggattaaatgtcaagtgatggaaaaagatataccatgcaaacactaaccacaagaaactcggtagtaataccagacaaggtggtcttaaaagtagaatcagaaggccaggcgtggtggctcacacctataatcccagcacttcgggaggccgaggtgagcagatcacctgaggtcaggagttcaagaccagcctggccaacatggcgaaaccctgtctctatgcagtggcgcatgcctgtaatcccagctactccggagtctgaggcaggagaattgcttgaatctgggagacaaagattgcggtgagtggagatcacgccactgcactctagcctgggcgacagagcgagactccgtctcaaaacaaataaaaaaaagtgagtcagagatagaaaaatttcagaataataaaatggtcaatcaccaacaagatgaacatttcaaaatagttacacacctaacaaacatagcttcaatatacgtaaagcaaaactggacagacctgaaaggaggactagacaaatctatcataatgggacgtttcaaaacttctttcaaaacttctttctccatgtttggtagtacaaacagacaaagcaatccagattctaacaacacaatgaacaaacttgccttattacgtagaacgctgtactcaatgaagatgataaacaaacaaaaagtattcagtctcggtcgttgtcagagaaatgcaaattgcaatcagaatgtgctatccttcacacccaccagaatgactaaaatggaaaagactgagaactttgctgctgggtgtgggacagctagagctcttctactctgctggtgggagtgtgaattgctgtgaccattttggacattgttggcagtatctgttaaagctgagaagatgtgcactctataatcgagcatttcccctaaaaaaatacatattaagaatgttgatagcagcattattcatagatggtccaaaactagaaatacattcttttactgtataagactacaatacaacaatttgaatgaactgtggctatgtgtaacaacaaggatgactcgcaagcataatgttgaacaaaaggagccgtttaccttttttttttttttttttttttttttttttgagacggagtctcgctctgttgcccaggctggagtgcagtggcgtgatctctgctcactgcaagctccacctcctgggttcacgccattctcctgcctcagcctcccgagtagctgggactacaggtgcccaccaccatgcccagctaattttttttgtatttttagtagagacggggtttcaccatgttagccaggatggtctcaatcttctgacctcatgatccaccgcctcggcctccccaaagtgctgggattacaggtgtgaatgctttaccgtattatcccacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggagtttgagaccagcctggccaacatagtgaaacccctgtatctacaaaaatacaaaaattagcagggctggtggcacactcctgtaatcccagcttctcggtaggctgaggcacgagaattgcttgaacctgggaggcggaggttacagtgagccgagatggcaccagcctgagtgacagagtgagattctgtctcaaataaataaataaataaaataacgagacaattttttaacctttcagaatggcaaagataaaaagcttaatagcatcatgtaggcaaggttgagggaatgtgagtggaaacaacctggaagaaggtttgacaggtcttattaaaattaaaactgcacacatctgagtctattcctagggatatagtttacacatgtacaagtggtatattcaaggtcctttattatggctttgtttgtagcagtaaaggttcagtaggggatgttaaataaattatagtacatccataccaaccatatagccattaaatagaatgagagagctctgtagatactaatatggagtatcctccaagataacctaattaaaaatagcaaggtatagaacagcatgtatagcgtgctatcattgtataaaaatatacggacacacatatgtatacacacatgtgctttttttttttttttttttttttaaaaaaaaaaagagatggagtcttggccaggcacagtggctcatgcctgcaatcctagcactttgggaggccgagcgagtagatcacgaggtcaggagttcaagaccagcctggccaagatagtgaaaccccatctctactaaaaatacgaaaaaattagctgggcgtggtggtgcctgtaatcccagctactcgggaggctgaggtagagaattgcttgaacccaggaggctaaggttgcagtgagccgagattgcaccacagcgctccagcctgggtgacagagcgagactccgtctcaaaaaaaaaaagacatggagtctcactatgttgcctagatttgaaatcctggactcaagcaatcctcttgcctcatcctcccaagcagctgggattataggtgtccaccactgtgcccagctacatgtatgctttttatataagaagctttagcaatagttgcccctggaggatgtaacagggtggcaggagtgggaaggagactgatttttcacgataaagtggaccccctttatccatagttctgcctcttatgctttcaggtacccgaggccaaccaaagtccaaaaatgtttaaatggaaaattccagaaataaatgattcataagttttaaattgtgtgccattctgagtagcttgatgaaacctcctgctgtcctacctgagatgtggatcatccctttgtccagcttatccatgctgtggacgcctccacctggcagtcacttagtagccctcatggtgatcagatcgatggtcatggtatccaagtgcttgtgttcaagtaagctctatgttacttaataatgaccccacgtgcaagagtagtgatgctggcaattcagatatgtcaaagagaagccgtaaagtgcttcctttaagtgaaacagagaatgctcttgacttaataaggaaagaaaaaaaatcatatgctgaggttgctaaaatctattgtaagaacaaatctatccatgaaattgtgaaagaggaaaaaaaatttgtgcatagaatgtacagaattttgtattatctgtggtttcaggcattcgctgagtgtcttggaatgaatccccccacagataagggtgggctactgtatacccttttatatctttagaattttatacagtgcaaatattttttaaacattaattttaaaaataattgttaaaagtcccttagaaagatgttctctcagtaagttcagtagagcccacattttccgtcacactgaaacagatctttggtttaataccagacgacatagtctgcattgcatgtgagtgccaagctgtgtgggggaaaatagcctgtgacatggtgctcagattgcaagggtatatgggaatgaggtgatgagggcacagcgggttcaaacatccggtcttgtgctcactggaagatgcaacacttgtggagtgaaatggtgagcccatccccaccccaaccgggtgtagtgtaatttccctctctctccccttctgagcaagtgtaagttgaattcagagtgtaagttgaattcaagtctcaaacctcctgggctcaagcaatccccacctcagcctcccaagtagctggcactacaggtgtgcaccaccatgcccagctaatttttgtagttttgtttgtttgtttgtttgtttgtttgtagagatgggggtctcactatgttgcccaggctggtctcaaactcctgggctcaagcagtctgcccgccttggcctcccaaagtgttggaattacaggcatgagccactgagcctggctttctacataagtcttttactacattattttattatttcttagaagcaaaatgattgagtcaaaggtatgaacatttttaaaactcttgcgatagagtgctgaagtgacttccaaagtttctcagtttgctcttccacagcaccctcactggcattgggcatcctcttgtttaaaagcagtttttaatttgaaaaactccagtcttaataactttgccaatacatctgaatgataggctggaagtcagagatgtcagtgttacctttcagcttgaatgggatttggaatattccacccccgccccatgctgtatagagagtagtgctgaggagcctgggcctggggtccgagcctggccctccaccctgcagcagtgagatctcagataggccggttcatgtctgtgagcctcaggctcttcccctgtaaatggggagaatcaagtgtctacttctggcactgctcggaggtgccacaaaaccgtgagcctgcaaacagaaccgtgagcctgcaaacaaaaccgtgagcctgcaaaccgtgagtcgtgcccctcggcaggcctgcacagggttagtgtggagctcaaagagttaaagatgtaaagaactaaaacgctctgctacacgtgggtttaatacacttggctgttattttgagtgaggggtggaaatatgaatgatttcttttttgttttttgtgtgcttttctttattttccatgttttctgcagttgacattttgttatcaatatataatctatattattctatatactatacctattatacattacagatagagaaacagacaaaactcattcaacgtaagaaactggggggtaggggtcctagggaggctcccatttaacaggtagggaaaatgagatcttgcactctcacattgcctagcagtaaataagcactcaaatatttatggatttggttgagtgctacatatttatctcaatactaataatgttgacagtagcaaccaataccagattcatttgagctacacagctaggtggtgacaaagtaatttatgtattgacctattaggacatagcatgttttcatgtgttaatatcagattaatgtgaggacttgcaagaacatctgatgcctgcatggcagcttaaatctttaggaagtaagctgaatgccaaataatagaccttctgatcacatatttaagattcaagatgcagaagaaaaccccaaaggaacatttatagcattcagctgggtgactaaagagtgtgccctagtgcaccaaactcttgtgacaagattttcttaaaggaacaaaaaatctccaccttgatttgtgtcttatagtggagttgtttcccaaatcaggctgtttcaaagaacatatgagacggcgtatggctagccctcccatcccaaagcaaatgtttgttttgttgcaatgatggaaacatttccattggtgaagcaaatatttagagctgaaagaaacatttgggcagccaggatgtgtcaaaacagaacagatgtctgccttttaaaaacacattaaaaaaaagccaccttgtacttggctgctgtggtcgcagccacagtgggttaagcaagaagttagaaattgtgggtgtctttctgttataatcctagctcctagacttggcttgtatcttcttctgtcttggtttttctcttccagaaaatggggtgaaccattgtgatcttgttaaggatcaagtctggttggtttgttttccccaaatattttctttgttcttaaatttatttatttgaatcagaaatctattcacagggaacaaaattcataaggctaggcagtgaaaagtgttcctcaatctctgttccccagcaactagtcctctctataaccagtgttaccagtttcctgtcctccttttctttcaggtatacacactgtgtgtgtgtgtgtgtgtgtgtgtgtgtgtgtgtgtgtgtgtgacttctctgtacccttcacctagttttcccccatgctcctgatgttctctttggctttcttctttcgggggtgttaattctgagagtttgcttatttaaaatatgcagactctgtcaagtggcagagggcagtaggtatgtcaggctgcccatgctccccgccccctgcccctgcccagcacagagagccccgtgtgggaatccaattctggggctcacatgggctgtgggcaagtccatgcccctctctctgtccctttttcttgatctataaaacagaaggaaaaaagaaaaagaacaggagagaggtcagataaactccaatttttcttgcagttctgaatttctttggttgtcaaaggcaagttgattcctttttttaaaccacccttcatgacctcttctgaaaacaggagcaagatttaagtatcactaaaagtgtttatcaatttgacttttccatgcatgcacaaacacacgtttggcttacttggcatttaagtagcagagattcctgattacccttcccttggtctttagggacacagtttcttccctaggacttactcagtatactgtgggaagggctgacttttctacctgttgccaaagacctgctgtctgtggcagccgcaacgatatttgtcctgctattaatcctctggaatcgatcaaatatcaaaaataacttctctttgtttttgtttctaatttagcagagagggattaaaagaaaaaaaaaacctttagattatatagatctaaaaatagacatcatggatgctgattggaaaccctcccagtcgttcatatgagagatctcaatttgtgttacatagaggggcagctcacttctgtcttgttcaccagttatactactccccagagaagctcaataaattttataggaaagtttcctccttatgtggaaggagctaagctcaatgactggtgtgtctgatataatttagggctccaagggagtacgtctgccttgtggaataacctatcaaaagtaaatgtacagaaactttcgatcttggttgatttggctatgtcattgaaactgctcagcactggaccccgtgaacccagcctgtctgctttggaattaaactgctcccccaaactcacattcgattcactgttaaagcggccttttgtgtgtctcactggtagtggcttctgggctcgcctgctgttgttccacggtttccaccgctggccctttgaaacccccaaacttggacgtggttgagtttttacatccctctttgcctcttctgttgacattaggaaagcagacctgccttctctttaggcttcgagtggaacaagcctgccagtttcctcagtctttcagctagcagtgaaatacattttgcactggcttttttactcagtgatttacactgggagacgtggctgggtgatgtccagtgtccttttgtctttgtgtttatttttcttccacatttaatgtatttaaaggatatattgtctttatggttcactgggataaggagggattggtgcaagttttaatgagaggtgccccagctctctgtgttgagctgagaattatcttcttggttagatatctttctttctttccttaggtggcaggaggcagtgttttgctgctttttgaaataatgtttctgcctaacgatttctagaaggataccgagaggacattcagcttcagggcatcatcagcaactttttctcctgttgtttgaacttccctcatttaaggagaggggaaagtctcaggtcttgttcttgaatttacatatcaatattaagatgatgggaaacagccccctgccactccccatcatctgatcaattcttataaaaactcttgcattcagggtagtgacatgtggaactagttttctcagaaactgttttcactgcttgggaatagttaatcagtggaggaaaaagtgtttgacttatctgcttaatattttaaccaagtgaattagacaggttggggggctgggggaggggataagaaagtgggtgggggaggccccataaacaaggtgatatataatattttttttgttctccttttaaataaataccgatcagctttatgttcagagacaatagaagccgttggcttaaatttgcagtttactgtatttatggctgtaatatcaaggtgctgccgtcgtaatttcatgccccaatgagaagagcaaggtcgaagcaaatgcttccatcggcatctgctaacacactaactcataaacaaggcccggctggatcaggtggcacggaataatacaggctaatgaaatacagcacagctttccattactgttagtttttacagtgtcgtcattacgtgtaatttatgtttaaaaaattcaattttatacaaggcactgggaaataggggtctccaggtcatcctacgacttttagaggctctgagagtccttattgtactctactgttccaacaaaatgttcataaaataaaataaaaatacttttccccttcccctccctgaaccttttctgagagagttgatttttttcttttaatttgggaagtatttttagccagctgtcttctctgcctcatctcctcccagagtgtgccggggcaggtaacttagttgttctgagagaggtgaccccctctcagtgtccatgagtcccagatgaattggccaagtcctagaaatagaggggctgcagagcggggaggaagaggtcccaatgaccagcccttgactgccaccgtttgtcactggccccctggccctgttcccgtgatcccagtcagatgccacatttttataataaaactagggctgagcaggaaggcgctggcaggagttcattaccttgcttattttcaaactcttcctaacccttctgtcctggttgttgtttgacctgaaagatgaagagaacactgctgtcttctgtcatctgtctttctgcttcacctgcacagggccaagccccgtggcagtgcccagcggtcactggggacagtgctgaggttacttatcctgagaaacccttgcacggcctgtcccgcagagaaaagacagcccttccgggtccctggtttggtctgagtcgtgggaaaggaccctagggcatcacaatcgcagccatgtaccctgcagctcacagagtcaatcagtttggttttatttgcatttgaacagaaaccttgagaaaaagaaagccaatttgtttatcttctaggggataaaaataggcaagtgtggcagccctgtggccacgcaggtcagacactgcagcagtgacactggggttttattaatcaataggatgtagctcacttgttctgtccttttaaaaaaaaaagcccaccctggagaagagatgcttggcccagctcctacacaagggcagcagtcatctccggtccagggagctcttctggaggtttttgcaagtagattctagagaactgagagaacaagaagtcttccccactctgggcacatggaatcttcattcaaagagtttggtttgaattgagagctctcagttttgcatatcaggtaactatgatgtgaaaagatgaagcggcctctttacctctcagagtcagcccagaccctcttcgcctcccctcctctcagagaagctccctcgtccctttctcctccttttgactagagctagtgggtggagagagtaactgaacgggaatttcttagtgttattctctatcaataatatattttaattgtcagtgctatagactgggtggctgggggttgggagctggtggctcttgaaaatcaccaagtggcagaaaggaagttataggaagaacataaaggcttagtgccagtggtgtcaggtaatgcatattgatacctcaactaaaagaacatttggggctttattaaaattgactaattcttccaaagatagcagctaaaggaggacttagatgaatagaggagggaggaggcttgcaggacggtgaagccctttgcttccagctctctgcctgctcagccattgctccgtccctctgcagttagattattccttgcagatagcaatcaactggaaggaagtgtctgtgtctaatttgcatgagattatttaaaacaacaacaaaaaaaaggtctgcattagtcagggtgatggtaaacaacgcaaagagagatgccttttataatatagcctgtgcctcagctttcagagccaaatataattcacttacaattggcagtttcctttattattccttttaaccttttggattctgcaaggtctcaatctaagatcagcagtttgtcttggcagtagtgggaaagatggggctagggcaccgggatgtcctatgttggctccatggcagcactttgaccctgaaggcagggtcatcacagcaccaagagccaatgactgggcagataactagttgtgatctggagacaggtgggtgttcccactcagtctccctaagttccaaatgaatcacctgagtcctgtaaatgcagtcttaaagctggccagttctgcctaaggtggggacattccagaggaagatgacactcaaggaagcctatgacaggcatttggacttgatttcgggttagaatattagaacgagaacaagatgaggacattctacctttttctctctagtattgttcaaaaagttgtccaggcgtcatttacagataggagccaggggttaagttcctgtattgtttcaatgtagccccaaaacaatattcactggctccttcctgtagatgagagtggcggggtagggagaagaaaatgtagtccttctcccaagctctttaacaagtctgaagacctaggacatagtttgagtctgccatttgatgttttgtaactctggtgtagtggagagtcactgggctgaagagggagagccttgagtgcccatcacatcaccactctctacaagtaggatgtggggcatcgtttctaccctccttgggcctcaggtttcttatctgttaaatgagggcagtgactgggataatggcccggctctgaatgtgattcagtgagattgttaaaacgcttacttttaaaaagaagagaaaggattcatttactgtaactaaatcaaaatcctgcctctcccagagaaccagggatatcagaatttcagccaatataaattttgagcctcaaatgataacgtctgtgaaaaacaagagcttggaaggaagtactgatgccctttcaactgtggcctcactagtgggctcggctgcgataatgcaaggaacatgttttattaggaaaataggcttcataaaagctcagggccagagggcagaactgcgggcagggcgtcctgtccctttaaccagctccggccctcagggccacagcacagtctgtaacttactgtatatttccccagtgttaaacattattgtacttgtttatatttgaaagagccaaaagggaaaatgagaatgcaactgaatgctccttttgggaaaattatcttcatttgcagccagcggctgacaaggcacacgaaccaccaggtttataaaattccgtagtgtaccagtgaccatcagcctgtgctgacatcgcagatgctgctttcttctctaatggctgattatgaactggttaaaacaatgtctttcccaccagggctccgaaaggggttccccttcctgtttagtcggagcgatcggcagtcactacacaggctggaacctgagaggcacaaactcagggcgggggtattctctgttgttgcctggcttgcctgttggtcctgtccctgttcttcttggaaggtgaaattatgggtaaagcagtccctttgcagcaagcaccccctctctagctccactctactgaccttcagcttttgtctttggaaggtggtacgtgatgcgctgtgaaccctggaagcattttcatccagcccaccaatctgttgagagcatggtgctatcagggcaacccggtggctcttcagacttcccagtggtgaggctgtgcctgcccttggccagctccactgtgtgaagagggtaaagaggggaacagctgcagttttaaatggggatagtcctcaactcctcagcacagagaagggaaaaaagagtccagggctgtttagaaaagttcgggcattttcctttgactagctgtggtagggcatgaaaagtttgaggggtggctgcagtcaactcatatgccagtatggtgcagggcggagctgtgctttaaagcattaatgtgcaccatctattagcccctaggcatggagtatgaggcaccatccttttgaagatgctgatcctcagaacctccttgtacttcatctacccccaggggcaaatataccatgctgtgggcctctaatggagagctgccgaccagatgtggaaaagctctcggctgtagtttaaaagctctgtgttgcggctcgcttggatgttgggattcccggaacagcaagggctggccgagtggtcttttgcagactaacagtgacctcccacctgcttttcccactctcagcagctggagtgcctttgtacacacagctacttcctgagctggccccgtgtgaccgctcctttcatacttgagcgccacatttcattctgttctttgggttggatggggctctcttcctcctcccaagagtcagtgtcccaaattggctcagacccggtggaaatatcccagctgtgtccccactggaaatgcggccttcatgggttttcatttgccttttattcttctgtgggcaaatcctctccacatggcatagccactgcagatggcgccctgccacttcctgatgtcccatgtatggtgtggtttagagtgtcgggaggatttcaagaagggaaaagaaaaactagccaaaggcgatacaggcagcgtgtgataggctagaataataatcatctgaaagtttgggcctggccttgttttgatctgttttcttgttttattttcttctttacattctatatcccattcatactaatcacagtcagtcctgatttttctttttatttctgcatttgtcataaaataaagcaaattattcccgtcttcagaaacgatctagactaattagtcgtctcacccaataattagttttttgtttccctgtctgttttcgtgcattattgttagttttttcccctcttttttttttaacaccattacagattaaaatgagccacatttgcagttgatggtatctgttttcgggggaagaatggagaattgcagtaccgagcgacttcaaaagcagcaataaactcaaggataaattaaggaaattgaatgagccacatttggaagcagtgttgaggctaatattctgtcgcttaaggttaaattgcaactgagagaggttccggagaatctgaaatcggggaggcaacttactaggatgcgaggcattctgtggctgtaaaggtctttgctcagtgaagattctgttgcagctatggacactgacaaaaggtactcacctgcaatgatgtcctcttctccccagggctgacagatgaagagattgatatggccttccagcagtcgggcactgctgccgatgagccttcgtccttgggcccagccacacaggtggttcctgtccagccccctcacctcatatctcagccatacagtaagtcacccgctcaaactcctgcttaaccttgattgggattcaggactctggccaaagggcagtgttctgtatctcccagacttagcaaaccaggagaaactgggagcagcagaaagctcttgggtttttcccaaggaatgtgacacaccccagtcttctagacaaactttttaaagtatgtgacaaaggtttaagaagagacaagggatcagaataaatgattttattgttgtttcaggtattttggttacatgcagaaaacctgtacaactatttattgattctgttcccatctcctcataccagtgcttttgaatgttactgtttcactaaaaacagcgtgaccatctgactcatgggtgcattcttgtttgctcactgcaataacctgtctcccacttctatttttttaagttaatatttgtaagtttaggtcagcctccatttccctccctcccttgtcctggctatactttgtacgtttatgtagtagcggtctgttagggaatttcaggttaaaacatgaagttcctttttgaatgtttcttttaattatacgagatcatgacccatgaggggtctttcgttgtcttaaatgaaagctactataggaataaagtttcttcaaacaagttataaatgcatacctccaaaatgcagccagaagccctccttgaaatcacttataaaaagtttaaaaaggctaaaattgactacaaagttatggaaaatagctccattttgtttctttaatgaaactcagcattgggccgggcacgttggctcacgcctctaatccctgcactttgggaggctgaggcgggtggatcacctgaggtcaggagttcgagaccagcccggccaacatgatgaaaccctgtctctactaaaaatacaaaaaattagccagatgtggtggcaggcgcctgtaatccctgctactcaggaggctgaggaaggagaattgcttgaacccgggaggtggaggttgcagtgagccgagatcgtgccactgcactccagactgggcaacaagagcgaaactctgcctcaaaaaaacaaacaggcagggtgcagtggctcacatctgtaatcccaacactttgagaggccaaggcaggcggatcacttgaggtcaggagttcgagaccagcctggccaacgtggtgaaaccgtgtctctactaaaaatacaaaaaattagccgggcgtggtggcacacgcctgtaatcccagctccttagggggctgaggcaggagaatcacttaaacccaggaggtggaagttgcagtgagccgagatcacgccgctgcactccagcctaggtgacagagtgagactctgtctcaaaaaaaataaaataaaataaagaaactcaatactggatctgtgatctctcaaaatgccttttctataattgttattctcagaagttttatttttgcaaaaaatgatttaaaactgttagatatcagattttaaggccgggcgcagtggctcccgcctgtaatcccagcactttgggaggccgaggcgggtggatcatgaggtcaggagttcgagaccaccctgggcaacaagagcaaaactccatctcaaaaaaacagacaggccgggcgcggtggctcacgcctgtaatcccagcactttgggaggccaaggcgggcggatcacttgaggtcaggagttggagaccagcctggccaatgtggcaaaaccctgtctctaataaaaatacaaaaattagctgggcatggtggcgggtgcttgtaatcccagctactcaggaggctgaggcaggagaatcgcttgaaccgaggaggtggaggttgcaatgagctgagatcatgccattgcactccagcttgggtgacaagagcaagactctgtctcaaaaaaaaaaaaaaaaaaaaaagtgttagatatcagattttaaaaggcatattttaaaatgacagattcgttttgatcccccagcacctggtctgaagctgccttctttccctcacctcagcactgttttcatccagctcagctgcagctaggcaggtgtgatcttggcagtagagccaaaaaggccttctcttctccggacttgctgaagggccagccagtgggttggaatctgctgtctgtgttacggatcttatttagagatctcctcctttggctgtccacagaaggctgaatgggggaggccagggagtgtgtgctcaagtgtgtcaatctgtcagtgccttgcatgggtgacccactgcaggttgcagagcttcagtggtgagccttgtcctgtatttgggctactgggttagcacctgtgacttgtcagcttggggctcctttctccttcctggccagcattttttccaatccattgtagttgctttgggtcctaagctgactttatgtgcttctttttaaccaaaggctgagtctccacactttttctttagttgtgtccctgggcccagccgtgtaatgggatttgttgaggataggcagcggcagctggggtgcagaattttctaagatgcacatctgttctgttccagctgtttcctccagtggcttaataccgaacaggtctctcggctacttggaaacttcttactcagaacaaattgttctggttgatcacagagttggcctaaaacatcatatgttcacctactttccatagacacaaagggttaaactgttagtctttctgaaagaggcaaaagaatggggtggggaggggcaattcagttatttaaatcatactcatgtccagatcgctctgagaaaaagcaatacacgttgaggtatttaggtaggaatatttttaagagccttccagcccctaaaaataaaatacacattcttagacacagacttcttcctgctttgacactagtgtaaaaacaatggtaatgataattttaaatacctgaagtttttagttgtcatcattgagcttcattcttctcataccgttacattgctcctctcactccgggggtgactctacctcttcacttctgtacttttgccaagaggtgtcaaaactgcttaaaaaaaaaaaaagcttgattttgattaatatagagaaacaagactttgcctgactgataataaaactgataaatgacatttgaattacttgtagcggtaatttattacataaaatatcttttatttgacatgcgattagttgctggaagcatcactcaatctgactagtttaaacatgctccaaaatgaaccccagtaaaaaccagggctgtctgctgctggcattatgaaatatactaatcctggagtgagggaaaaatctgactttaaatatttaaatgattaattgggtttatatatttttttacttttctaacccccttaattacaagcaaactcaggggagtttctgaactaggtgcacaatctgcatgcttatcactgaggcattgtctgcgtcgggagggatttatggcctctattcatgtgtgttcctgccgattttacatctagatccccggcagccttttccttcccatttcttggctttttacggacattccatctctgagcccaaggctagaaaatgggatcccctgggcctagccccaaacactcaggtctcagggtagggtagcttttccaagaccaccccagggagcccagtgctcttcacctttgaacctgctggcccacctgctcagtggcaggtgtgccactgagtgcctcttttggcatctctgttctttggtgaatgtggttgaccttgagatgttagcaaatgccagtgttggcagagagaacgtagagacctgcccaaatagtaacagttcaatttctcagtatttttattaaccatctactatacggtcagtactatatcatgcgagagatccaaaacctgatctttaagcatcttgctaagctctttgggaaagataagataaactcttaagaaaaggataataatataagatgttgtgatttaatgccaaaattaattatacagacaagaaattctgaaattctgaaatatagaaaagagaagaattaatgtgggctagagtcagggaaggcttttgtgaaagtgataggaggttggcaccaaggggaagcttggtgtcacctggtgtgagcataaaccagtgctctcgggggctagaagaaagttggtacagttcaggagaagtcaggctgtgattcgagagaagatttgaaattctccatttctcattttggtttcttgtctggctttacatcgggagtcagtgcatgtgtataggtgcaggcctagcccagtcctgagcagaggtctgataaatgctggttgattgattcacgccaagctgatttgtcttcgtcctcccagagagaccaagaagctttgagatataagcaggaccagtgtaaattttgtaggataataatttcttcttagatttgaacattttccctccactgtctttgataaacaatttaaaccccttcaaagactgacctagagcttcagttgcttcttctcaaaataggatgtcagcatctgaggccggtgaaaggttttgaaccatttgattagaaatcctgagagagagtgagttattcctctgtttatttcttttgtagccctgtgtagtaacacaaacttatctgtggttatcttaattcactgagcaagcattgttattgaatgcctactgtgtgccagacccctgggctaaagagactaacaagacctggtcgctctctctggttgctcccgtctggtaggaaagacggttaggccaacatagcagtgcctgtcaggtggtcccggtgaggacggtggcacagaagaggcgacgggaagcttcagagagcagatgtctaactggatgtggcgggctgcttggttcagtgatcagacaggatagacaagagcattccaggctaacacaaaagcatatagatgtgaaactgatgaatttaagaaactccaggttgttggacgtggcgcctgtaatcccaactctttgagaggctgagacaggaggagcactttgaagctaggagttcaagaccagcctgggcaacatagtgagatgccatctctgtaaaaaaatttaaaaaacaaaactagccaggcatggtggtgcgtgtacttgggaggctgaggtgggaggattgcttgagcccaggagatcgagtctgcagtgaaccatggttgtacccctgcactccagcctgggctccagagcaaggccctgcctctaaaaaaccaaaaagaaagaaactctgagttgttcagagtggctggagcatgggatgagagtcagaggaaatggctggagaaagggtggctctgtcagctccgacagaggacagccaaaagcacagtgatgttttactttgaaatgcatcatctaattatttttgtgccatacgacctatttggccattttattcttagattaatattaaaattatttgtatcatctcagcaggtgccatgaggttagttaggggagacatgggtgggggggcatcagccggaggccattgttcttgtgccgagcctgtagtgcctaccctgtgtgctcactgttgttctccatggttgggccagcactcgctcctccagggagtctttccagtgcctccattctgacttggagggaagctcccctcaggcccctagactccccaccccgccccactgcacttaaacatttattccagtgtctcccctattaaactgtgagttctgaggcttaaaaaaatctagtggcctgaggctctgactgagcaggtgttctagaaatgcttgtggaatggattaacaggggtggaaatgtgcttgagaatggaagggctatcatgtggacgagctgccctggtggtcggtcggtgatacggtctgtgagcccagctggtgcagactgctctgggcaagctatggaagaagtaggggatgggacccaccttcaggagctgctgttcatcgtagagggaagccctccattgcttggagaaagacagggaagaccatcccacgtcaccttgcatggtgagaatgttgagagctttcagaatttgagaacaaaggaaattcccagaacgctagtcttaggcaaggctttctagaaggggcaggacttgaactggctttgaagatcagtcagccataaggtagacccaaggtgtcaaggaagacatcactgtggagagggaacagcaaaggcccggggccagggtggcctgtgcgtaagtgatactgaggtgacagtaaacagaaagcatgcatgggtggcctcggggttcccgtcagaaagcaaaatagcaaatgtcgcctccacctctctctctgtctcttccatttctctctcatgcttccatttctttctctgctggtttagcagacaaatctctctttttgctacctgaaagttactggtttgtatatgaagaaagtatttctttaattttgaggaaattgtgttttcttttgtccgtggtgccggtttggattagcaagcaccctctccattttgttgctgtgtgttctgcctggtgtggtgccacatgggggctgaataaatgccattcgcggatgttgaagagggtaagtatcacgggaaggaaccgaaatgaagtgatcctttccttaggtttcttggaccattacaagtctttggtgttgatggcagttaggattctggctgtgctgacagtgtgttagttttagaaaattctgctacaggtgacagagaactccaaacaagagtggcttaaagagagaggaatttttctctattacataaatgtaggcagcccaggctgccaggaggctctgtggtctgcaggaaccctactctgcctcactgctctgcattcctgactggctctcatccgtctcgtggtgcagtgtgaatgcttcagctccaactatcccacctgctgtccagccagcgagagcggggagaaagcgggaaaagggcaggctgccttctaaggacacctcttggaaattgcccatgtcccttccactttctccccattggctggatcttgcatggctatccttgcctgcgagtgaggctgagatgtagtcctgatctcggcagcacatgtcctcagctttccatatcccataggaggtttgagttctgataaatactgggtttaggataatggttgcctctgggctggggaggaacacatggctagcttcagtggtatttggaaagttctagctagtaaattaggcaggtttagaattgctcattgtattcctgttcttataacttaaataaatgttatattcttttgtatgtgtcagatattacagggtatgttttttaaagttgcattagaattctcaggtctggcttcttctcttggtcccagctgcaagctgtgcagagagaaaacttagagcctacaccactgggtagtgttcccaagcactcctgacttcctgtagctcttttttaaaaaaaattctgaatggattttttattttttaaaagtcttattgagatgtaatttacgtaaaataaaatacacccattttaattgtacaatttgagttttgataagtgtacatttccatataaccatcactacatgacagaacatttccaataccctgaaaggttcccttgggtcccatttccagtcaatccaccctccttgatcctggcttgagggcaaccactgatctgctttctattactacctattagatttctttcctagagttttttttctttttttaatataaatagaatcatacagtattgtactctcttgtttctattttttttctttccgctcagcgtagtgttgccgagattcacccaaattgctgtgcgcatccgaagccttttcctttttaccattgggtgggtggtattccattgtagggatgcaccacagtttgtttatccattcaccagttgatggactttgggttgtttccagctttgagctattacgaataaaacttttgtgaacattcgtatacaagtctttgtatgtttttatttctcttgggtgagcgcctagaagtagaattgttggtttatatgttaagtgtatgtttaactttataagaagctgctaaactgttttctggagtggttgcatcattttaccttcccaccagcaatgtttgagagttctagttgctacatatccccaacagttggtcttctcagtctttttaattttagcagttttagtgtgtatatgctggtatctcatggtggtttgggtttatatttctttgatgactgattaggttgaacctctctttgtgtgtttattgtccacttgcatatctttcttgtgaagagtgtgtttcagtattttgcccattattaacagtcttcttactgagttgaatgaggtttttaatgtattctggattcaagttgttggtcagatacatgtattatgagtatttcctcccagttggtggcttgcctttttattttcctaacattaccttttgaagagcacacaattttaattttgatgacatatatttatctttttttccttttatgattcatggttttgcatcctaaagaagactttgtctattccaaggttgaagagactttctcctatattgtcttctaggagacactgtctcactctgtcacccaggctggaatgcaatggcctgatgttggctcactgcaacctctacctcacgggctcaagtgatcctcctgcttcagcctcccaagtagtggggactacaggtgtgtgccaccacacctggctaattattgtattttgtggagagatgggttttcaccatgttgcccaggcatgagccactgcacccagtttatagcgttagtttttatgtttaggtctgtgatctattcttagttaattttcgtgaatggtgtgaggtgaaggtcaaggttcgtttctccccataaggatatccagttgtgcctataccttatgttcaaaagattatcttatccgcattgagttacatgtctataaaaaatcaactcacagccaggcttggtggctcacatctgtaatcccagcactttgggaggccaaggtgggcggattgcctgagctcaggagttcgagaccagcctggccaacatggtgaaacccggtctctactaaaagtacaaaaattagctgggtgtggtggcaggtgcctgtaatcccagctactcaggaggctgaggcaggagaatggcttgaacctgggaggtggaggttgcagtgagctgagattgtgccactgcattccagcctgggtgacaacagcgagactccgtctcaaaaaaaaaaagaaaaaaaaaaatcaactgactatatatgaatgggtctgtttctagattcctcttttaaaaaaaaattaaaaaaaaaacaaagctatcgaagtatactttatatgtcatacaactcatccatttcaactatacaattcaatgatttttagtaactttaccgagtgatgcagctgtcaccataaatcagctttagagtacttcacctcccctgcaagatcctttgggcccatttactgttaatccctcttcccacctctagccccaggcaaccactaatctccttttcatcactataaatgtccccttttctggacatttcaggtaaatggaatcagaatatgtgatctcttgtacctggcctctttgacttaacctgatgtttttgaggttcatccatattgtagcatgtatcagtaattcattccattttatcatggaatagtattctgttgtctggttgtacctcattttgtccatcagttcagcagtcgatggacatttagattgtctccaattttggtgaagatgaataatgctgcaaagaacatttctgtgcaagttctgtgtggacatacgttttcattcctcttgggtagatatctaggagtggaattgctggatgtggtagttttatgtttctggatccttcttaattcttttctttctaattagctttttgtaagtataatttacatacaataagatacatcaattttaagtatacaattcaatgagttgtacaaacaagttgtaactcatttaactcctgtaaccaacactacaatcacaatatagaaaatttctatcaccccagaaagttgctttgtgccctttatgtcgtccttttcccctgcctctggtttctgttaaccaccaatctctgctctgtcactgtagttccttgtgccttttcaaacatttcttatagaacaggtgcagtggctcatgcctgtaattccagcactttgggaggctgaggagggcggatcacctgaggtcaggagttcgagaccagcctggccaacatggtgaaaccctgtctctactaaacgtacaaaaattagctggccgtggtggcgggcgcctgtaatcccagctactcgagaggatgaggcaggagaatcccatgaacccgggaggcggaggttgcagtgagttgagattgcaccattgtactccagcctgggtgaccgaacgaagctccatctcaaaaaataaataaataaataaaaataaaacattttgtataaatggaaccatatagtatgtagacttctgtgtctggtttctttaccgtaacataatggttttgagattgattcatgtttttatatacatatatatgtattgatatataaatacatatttatataaatacatataattttattcatatataatttatatatgcatttctatattatatgtaaatatatgtaatatatatttggaaaatacatataaaaggaatgaactgtttatgtctatatcatgattgtgattcatggtttttgcatcctaagaagcctttgtctaccccaaggttgaagagactttctcctatattgtcttctaggaagttttatagtgttagttttttggagacaccatctcactctgttgcccagagtatatttattatatatttatatatattatacacaaatatatataactttacatatatatatatatacacacacacacacacacacacacacatatatatatacacagagagagagagatatcattctttttcattactgagttgtattccagagatcagtgggctttctttttcgtttttcttttttttttgagatggagtttcactcttgttgcccaggctggagtgcaatggcgtgatcttggctcactgtaacctctgcctcccgggtgggttcaagtgattctcctgcctcagcctcccgagtagctgggattataggcatgcgctaccacgcctggataattttgtattttcagtagagacgaggtttctccatgttggtcaggctggtctcgaactcctgaactcctgacctcaggtgatccgtccgccttggcctcccaaagtgctgggattacaggcatgagccactgcctggactttttctttaaatgggtatattttagactttgtgagccacatatctctgtcacatgttttccttctcacctttttctcttctcccttcatcctctcttctttctcctccttcttcctcttcctgttcttcttctccctttcccatgaccacaattctttaaaaatttaataaccaggctgggtgcggttgctcacgcctgtaatcccagcactttgggatgtgagttgggtggatcacttgaggtcaggagtttgaggtcaggagtttgaggtcaccatgcctggccagcatggtgaaaccctgtctgtactaaaaatataaaaattagctgagcctggtggcatgcctgtagttccagctacttgggaggctgaggcaggagaatcacttgaacccaggaggtacaggttgcagtgagctgagattgcgccactgcactccagcctgggtgacagagcaagactctgtccccccgccgaaataaaaaaaaaattaatagccattcttagctcatggctacataaaaataggctaaagtaggattggccaactggctatagtgccaacttctgttgctccatgtaccgcaatttctttatctgttgaccagttggtagtcatctggcttgctcccagtttggggctattatgagtaaagctgctgtgaacattcatgtataaatctttatgtgcacttatactttcatttcctaggagtggaatggcttagtcacatgttaggtccatgtttaactttaaaagaaactgtcaaactatttcccaaaatggttgtagcgtttgtgttcccatcagcaatatgtaagagtttcagttgctccatatctttgtcaacacccgatagtctcatttttgagtttagccattctaatgtgtatgtaatggaaccttattgtatagtacttttaatttggatttccctaatggctaatgacatcaagcatattttcatgtacttattggccattcgtatatcttttgtacagagtctcttccaatcttatgcccattttaaaagccactttgtctttttattattattgaattgtcagagctctttatgtattctagttacaagtgctttgtcagatatatgcttggcagatattttctcccagcctatggcttgtctcttcattttcttgacagtgccttttgaaaagcaaaagctttaaattttgatggtgtccatttgatcagttttttcctttttggttcatgcttcttatatcttaagatgtttttgtttaccccaaggttgcaaagattttcttctatgttttctgatttcttatagaagttttatagtttttgctttcttgtttaggtgtgacccattttgagttaatttttgtgtatggtataaggtgagagtcaaggttcatttttttttcctatggatatccagttgttcagcatggctgttgcaaaaattatcctttccccatagagctaccttggcctctatcaaaaatcagttgaccatgtaagcatgggtctatttctggactcttctgaattcttaacagcttaattagagctcatattttttaatctatggacaggggatatagatatgcctctcggtgtccttcctgcctaaagatgacactgctaatggcattgtagcccatgaaaagtggaaaagattgtctttcatgggatgtacgtgtaaatacaggctttgcattttccaacaggactactgttgggctactgtggtgccttttgccatccaggctgccaagtccttctgttcagagcagagacgatctgtttctgttgctgctctctgggcctgtctttctgcccactgccagccatccacagccatgtgcttcagggcccaccccgcccccaagctatagccagcccttctcagcccagccaggtccccgtctctctgcacttgtgctctccacctctgtgctgtagcaagcactgatttggtgggctggctttattccaggaccttactgggagtgagcctgtcttgtcatttaattttcagggtggcttctgagcgaagctgatgggctgatgtgagaagctagagacactgctgtatagagacatggctccaaccctgatgagcctggaggcgacctcaatgggctggccccgtttctaccactgccttgcccatgcttgggctgccagcctccccaaggacgtgagagttctctccctcttgtcagccagcacatcactggagtgcctgttgtctcggcaggatggttccgtgacagctctcagctctgtgttgccgatgaacctttactggattgcaggatttccatggtgtggatcggtctgtgacttgctcaacaaggtttcaggctcaacattgccgtgttgtatgcacaagtcctagtcctgtgcatgtgttcttagttgatgatgtttgttctcacctgttaggtgagaatttggttggtggaggtataaagaaacagagtcatgttggttttgttggtgttcagtgaatagttaggagctgtggggatgcacctctcctgcccccgctctaccatggttttacccaaactggagcctttgcgcaggctgacctccatggagccgggcagagcttaagctagttcgtggagtccttggaaggttgggttttgaagagctccatgccctttgctctatagcagtttatcccctgacctcattgcagcccacagcgccacagcgtagaggcagtccaggaaggcccaggtgtgcaggatgaggattgccaccacagatgcccgtctcttcagccttcacagagatgccagggctttggtactggtgaggaacccctgccacgcagctagggcgccggtccttagacagctgggctctgagtgagagtgaagatatcgcctgttcttggattctttggggctcacaaagccctgccaccttcagtcagtgcttgataagaagagaaaaatgtccttggaacccccctggctggtggtggcatgagggtttctgaccccaggcttgttgcccacttgctaccttgtctgccttgtctgcatggcaggccagtccctgcttccagagtggagactcgaagcatttaaaaagcccactcattctcttccttttcttcccagctagagaagagtgactgccccatctcctgcccttgtctttatacctccggacattcagggagcctggtggcggggaggtgtgttcccaggcgccctgctctcagttcccttgcggggtctgcaccagacttggaaaaaataggccccagggtggggaggggcaggacttgaggtggtcgtggctgggagtttgagctagtgtggactgtgctaatgtttttgcagtagcctggtctgttaccctctgagagccacacagcgggtaggagtcatctctatccgagtttttctcttttttcattttgccacaagacagaattgtatcacacatctccaaaacgagtaaaatggcatttcagcttcttgtctttatagactctctgaactttaggaaagatcattctggtcccttttcattaataatgaaaaccagggggcaataaaatgttcttaacgtgagcatggcaggaatgaggagcggtgaggggtgaagggtgaggctgcagggaccacaggtgtttcttggggctggaatagctcagaactctggaaagtgaggcagctattgggagggtcctggtcctcaacccacacagccagcgtctgctcagccttgacagcccagagggccccagagaaggctgtccttctcatggcgggatgtttgcgggtgagcagaggaatccagcaaactccaggtgctggtcaagctttcagccaagtcacagctgctttcttgcaagaggcttcatggtgtctgagaaatcagtggtgaatatggtattcgggccgtgggccccgttctgcacttgttctgcctgaggattttggctgcagggagggatgttccgggtatggatgaaggccctcctgagcagggactctgagagagcggggtggccaggttgctctgtcttcactttttcctcctgaaaatggacttgcactagatgtcaggttttgtatctggagcgccaagcaaagctggctagaagaggggagacagaagagacacctgaccaggactccaagtgcccggctccttggggtcgaggtgaaagatccgtctgcctcagtgctcttagagctccctgtataacgagaggtgatttgtgtcgggtgggggtgtccaccatcagtgaagtagcactgtccccttcccatggcagtttcttagacaccgagtgtcactgcacagcctgggaagggagtgggggaagtccttgctaaccataacacaaaccccagaacccataaaagaatagattgataaatttgtataaaaacctctgcatgcgacaaaacaccattagcagagtcaaaagaaaaataaaccagagaagatgtttgcgatgcagatcacagacagcgggctaatatccctgctatataaaaagtctctctaaagtgacaagggaaaagaaatcaagtagaaaagtggagagcatacagtacaccgaaaaggaaatgctgatgaaaacatgctcaatcctcactcaaaatgagatcaatgcaaattagaactagagtgaacttctgttttcctgctgtggtattggcaggaatctctgcgtttgaatcgtgcattgtgtgggcgcagccgtggggaagcaggcattgcgcagcggctcagggtgaattatcggccccatggaggcagggtggcagtatttctcaaaactgcaaatgcacacgccctgggaccaccctctgggggttctgaggctcacagggtgcgtgtccccatgtgggagatggcacgtgtgcacgttgttgatggcagcgtggtgtgcagtagtagaaagttggaaatgagctgggtgcccatcggagggcaggtgaagtggaatatcctgcagctgtagaaaacaagattgagagatggggaaacgtgaaggaagagaagacatcctgtgccaccttaggtgtgcacacagactcactggaaggataaatgtaagactactaatggctgttggtggtggggaagccttttttcacagactgccctgtgctattcgatgagtaaactgtatgcgtgctacctgttcaaaaagtgtaaaacagaaatgggagttggggactgagggagaggccctatgttgattacagttttgggaccgagattccagggctaggacacaccggggagtctcgcatggaatccgcaggcagggagggagtttggtggccaaggagggactccaggcccctccagccctgtcgtctctgccccctgagagtgccattcagcagccctgggggagggggtgtctccttgcccactcggaggtctttgcgacttggatccgcctggtggggctgcgtgccagcagccccttccccctcatgccacatcctgccctgagctgaaggaaagaacgggccttctcctcccctgtggtcataaaacgccaggacatggaaggtacctctgaaaacttacaggcacaggtgagaactgagggcagaagtctctcaagcagcaagtccttcagcttcactcggccgtgttgtgacgttccttcccagagttcagaacgctgctgattttccctctccccctttctcccagatgagcagcacactgtgggggcgccttccggatagctctccactggtgctgtgatcgccttccccgctggtctgtgtcccacccacgcccctcctgatgacagatccttcggggggaggcagagcacccgccacgtggcctggagatggccgctccagaaaggtgttcgcagtggagacggggctctcccgcgtgccttggaggatcagatgaggttgtggacgtgggagcactttgtgaactgggcatgggaaagagtgaaggtggaaactctccccacgtcaagtagaattgcattcaggagggcactttgctatgtgccgttctaaagagaatcggccgggcgcggtgctgctcgcctgtagtccatctgcttgggaggctgaggtgagaggattccttgagtccaggagttccgggctacggggcactgtgctgatcggggttctgcactaagttctgcatcaatatggtgacctcctggagcaggggaccacgaggtcgcctaaggaggtcagaaatggagccggtcaaaactcccattctgatcagcagtgggacatgcctgtggatcgccactgcactccagcctgggcaacataacaagagcccatctctaaaaagattacttaatacaaataaagagaagagaacggggccaggtgatcttccatgaagactggctgcccttcacagcagcagcaatgtgttctcctgagacattgccccactcccttcttgccctctgtgctggtcccagtccctctccacctcgtgaacccttgcagcaggctcgccccagctcttctgcctctgcggcccccacttctgaccaccctcagagcctccccagtgctgctgtccagggtcatggcactccctgattcacatcccccagtaattcccattgcttaggaaagaatattcggcttccttgaccacacagtccacctggtgccacctgtctacctctttcctgccccgccccagcccccactgtacctgcggcttccttggctcctctccgttctccccagcaccctgctcttggggtcctctgggccagagcagctctcctctctagtcaggcccagggtgctcacctggtctacacccacctaccgtctctcttttgtgcttgctcccctccagcccccaagggcctcagggctcctccaaggccctgctgaccccagcccctctcccctgccacccccatcccttttgataggcgttctcattctctgaagccttgctcagtcatttggagacttgtgttttctctcctctggctccaagcgagagcagggctgggaggtctagtttaccacagcccacccccgtgcccccacccagcgtaccacggtccccctctccacttcgctgaggccccgcttggttctgctgtggcccccagcttatcgccagctatagtagggcatatatgggtatatttatgctcccctaaacatactcctgttatcctctctggatcttttgttcctgaggtagagaccatgctgttggtcttcagatcacctctgccacctgactgccaactcaggtctcagctcactgctagatacctccacccacagcctgcagtcagggttgggtgactggcatcccttgtgtcccagttgaggcagtgggaacaggaggggtggagccggctgctgttgtgatgatcatgtgctgccttcctgcgttggagtgttccacttgcccattgttggaggcgaggagactgtgccactgaggcacctgtgccagcccccacccgaagaaggacgccatgtgcgtcttctaaccctcctcctcttcccgcctgtaggtcccgcaggctcccgatggcgagattacggcgccctggccatcatcatggcaggcattgcatttggctttcaccagctctacaaggtgagtcacccccagcggctgcaggtgctgtgcccctgccaccctgtggcattcagcaccctttcactggttcccctgcatggaggcactgccgtgctctgccctggagtgtgttggcagtgagaggctgtggtagaggtcggggttcacagctggatccaggcagaccctgccctgctgcggggcttggcaggctctgcccaccttttctccagtgctcagcatataccacccagatctccacttgcaggggcgtcgtgaggtctgtcccttgccagcccatgtcaggcacttacagtagtgcccgcacggggaagccgtgcgagcagttttgagacacagaataacataatggcgaagagcatggacgctgggccagctgctttgctgagccctggctctgcccctcaggagcttggtgatcacaggctctggtctgtaaaatgggaataacagtccccacttcacaaggttgtcgtgaagtccggaagagtcagtctcccttgtagaggactcagagccatgcccggcacatggaagtgctttatacaccattgttctgccacagcatttaagagcggcggtgagaacctcagtgtcatcagatgtatgggagctgttctttttgctctgtctgttgtgctgccatctatagaaatctaggatttcccaggcttctcaagtcaactttcaggatcccaggttcattgcttgcaacagaactgcaggcatgacgtgaacattgactcccttgtgaaggcccaacttggacgtgaagcaaatgagtctagagtctagaaaatgcaggccagggtaggtgcccagtccagatcttgggaccctgtagagaagcctcttttctttcgaggctgccagctcctccacccctgattggtgatttttttttttttttttttgagatggagtctcgctctgtcacctaggccggagtgcagtggcatgatctcggctcactgcaagctccgcctcctgagttcaagcaattctcctgtctcagcttcctgagtagctgggattataggcgtgctggtgcatgcctggctaatttttgtacttttagtagagatggggtttcactgttggccaggccggtctcgaactcctgacctcaggtgatccgcccacctcggcctcccaaagtgccaggattacaggcttgagccaccgtgcccggctggtgattttcttttttaaacaacctgaatgagcactcagactcgccatggtcactcttagcacatgaaacatggtcagccatggtattccagattcttcatttttgatgtaatacaaaagctaatgacagttgtagcagaatataattttttaagtgtagcatgtattcctggagctggacatttccatgttagaaattgagaaacaagggctgggcgcggtggctcacgcctgtaatcccagcactttgggaggctgaggctgaggatcctgacttgatcacgaggtcagtagatcgagaccatcctggctaacacggtgaaaccccgactctactaaaaatacaaaaaattagcccagcatggcggcgggcacctgcagtcccagctactggggaggctgaggcaggagaatggggtgaacctgggaggcggagcttgcagtaagccaagatcatgccactgcactctagcctgggtgacagagcaagactccttctcaaaaaagaaaaagaaaaagaaaaagaaattgagaaacaaaacatcctgggttggcccaggtgccgtggctcacacctctaatcccagtactttgggaggccagggcaggcagattgcttgagcccagaagtttgatattagcctggccaacatggtgaaactgtgtctctaccaaacaataaaataaaataaaataaaataaaataaaataaaataaataagctaggcatggtggtgtgagcctgtagtcccagctatactcgggaggctgagggtggtgggaggatcacttgggctcgggaggtggaggttgcagtgaactgagatcacactactgcactccagcctcggcaacagaaggagaccctgtctcaatttaaaaaacaaaataagccaggcgcagtggctcatgcctgtaatcccaggactttgggaggctgaggtgggcggatcacttgaggtcaggagtttgagaccagcctggccaacaaggtgaaaccctgtctctactgataatacaaaaattagctgggtgtcatggcgtgcacctgtaatcccagctacttgggaggctgaggcaggagaatcacttgagcctgggaggcataggttgcagtgagcctgcagtgagccgagattgtgccactgcactccagcgtgggtgaaagagcgagactttgtctcaaataaatacataaataaacagaacagaacaaaaacacctcttgggacccggttcttctccctctgaactggtgcccccttcaaatcactgactgtatacaagcaccaagaagaatgtgacacgaacgccagagtcctcagatgaatgccctggctgtaatgagcagtaggcactgtcacatggccacccatggagggcctgtggcctgacgggagcgggagggcagctcggcagcccgccttagcgtgggcactcacacggagctgccacttgtagtttctacgaagctctgggctctccgctctgttttaaaaagaaaagaaacattgcaatatcagtcacaatggtaacaagagaatttctaaagcatctgctcagtttctcgaaattaaaaaaaaaaaaaaaaagaaatggtaaaaagccctcgactggctttataagcacgtgaagactttggctagggcagcgtgtctgctcctgcccttaggacttctgatctcagaaatggggtgtttagttggttacacacacatatatgaattcttttttttttttttttttttttgagacacagtctaactctgttacccgggctggagtgcagtggcatgatctctgctcactgcagcctctgcctcccgggttcaagcgattctccagccacagcctcccgaggagctgggattacaggcatgcgccaccacactcagctaatctttatatttttagtagagacggagtttcactgtgttggccaggctggtctcgaacgcctgacctcatgatctgcccacctcagcctcccaaagtgctgggattacaagcgtgagccaccgcgcccggccaagaattctttacctttcttgctgaggacatttcatcctgaagtgtaaggctacctttgatgagttttggctcagttgtgggtaatagctcacactgtggttgaaaagcactttgcaaaatagaaaatgcgtctatacatgtgctgctgaagaatgatcttcacttaggagtcactctggaaatgagttcccacaaaccccttgtgagagagcttcttttccttccctggtacagaaaccgtaatggagaagtttccgtcctctttcctatctgggcccagatagattaagaaccaaagttatccccgggcagctcctgccaggcttgcactgcactgcctctggcagtgcccactgaagggggcagcgggtctcactcctcacctggggggctttgtctccatgtcccgagtggctggacgtcagtgcacatgttcctacacgcagctgtccctgcaggccccaccacccacctccacccctccacaccctcacctccaaggcaaccaagagcaccagttgccagccctgccctgcctgcctccttcctgaacggctccttcgggcatccctggttctaggcccctgtgaggggtggccctgccgcattcactttctttttccccagagccagtttcttctggtcctgcgccttcctctcccttctgccttgtgtttccttctggggaactcgacttcttttgactcttacgtgaaggaagtttgttctgaggattcaggcttcatttagaaaaagactgaggtgacctcttccagcagcctcagagcgcacatgttatcccctggcgagagaaccaagggtcccagaaatgtgttgttgattttcctttagtttctccagcgatgttttgtttattaatttactcgtttgtttctgaataggtgattcactcacaggttcaaaatgttcacaattcaggagaacatgccgggaagagctgccccgcctccctcgcctcctggaggctccagcattatctgttgcttgtgtgtccatccacatttatatcttacaactttgacagtagagtttataactttgtgttacagaaatagtgtagcatcactaagaaaagtaaataaaggaaccaaaaagttcccatcacagcagatccagctgactctccctgtccacgttccctcctggtccttgtccttattcaggcagaatttttacgtggttgtaatcgcagtctcataactttttcaaatatcttgttcatttatggtgtttgcttagggtttccaaaacccagggatgacagggagaaagttgggcggcagaatttgagagattgttggaggataaccccgggtccgtatgcattcctcaccctgtcccgcttcttgcagaaatacctgctccccctcatcctgggcggccgagaggacagaaagcagctggagaggatggaggccggtctctctgagctgagtggcagcgtggcccagacaggtaaagattaatgactccatcaagtcacccctcacagccttctccaagcagccccttctctgcccctcccctctccctctgtctccactctatgtggtgacttcatttatctgctctgagaatctgttcacatttgcaaatgaagccgccgtcatttcggtttaatttgaaattgcttgtttactgtcggcgcggcctcaattaattatgtttttacggaaaggctcccaacctcagaatattaataaggggaataaaatgacagcctttctaagggctgtaaagttcatttttaatttctgcttctatgaggttttcaggggggttttcagtgattttcccccttccctctaagactcgactgtggggtcaagagagtctgtaattactgtggctcccgggaccccagccacctcccctgttatcgactcaacagggctcgcgttcattacccagtgccccagcgatggcccagattagctgggacctgtcgcgccagaggtggcttctcttctttataaacttgtttactagacggcagctctgaatctaaaaaccagagcaaggccaatgagagagccacctgtcccaggcaggagtctgtgtccctctggagcacgtttgtgaagctcacagaaaccctctgacacgtccatcctgctgccgtttgctcctgcgaggctgacattggtggcaacaaggtcctgaggggtcacgggacaccagggagttgagcaggcagcttgggtcaggtggggagggtgggaaggagcagtgggaaacaggacgtgcggcttgagccactcctggatgtgaatgtggcggggacctgagatgcatctctcccagcattggagaccccaggagtttcacaaggacactgaggcccaggagatgaaggacgcaggcgccagagaagccgggagagctcagcaaatcatagccagctctaattagaggggagaggttctggacggatatactgttgaccatggacaactacacaatggaaagataaagtagaaatactagaggttagatacagtgcaggcagatcacccagagtgcagataaattagatggattgcgggggctgggggtgtctgcagataaattagatggagcgggaacacgggcagctccgaggtgtgcggaccgagcgaggggaacgtctgtgcctgtgaatttgccagcgccgtgactgctttctcctcgcagtgactcagttacagacgaccctcgcctccgtccaggagctgctgattcagcagcagcagaagatccaggagcttgcccacgagctggccgctgccaaggtacctgtctctgctgcacagggccctccaggcccaggtctgtcccatgtgcccttcactcttgtcccttgggccgggcttgccaccttcgggagctggactttgccccagtctcacagtggttacacagccgtggccgatgctgccctttctctccttgtagagacaggaggctgttgctgggcagtcagtgtgacgtttaactgtcgaggccatcctttctctctctatgtcacctcccaacaggaggaaggaaaagctaccctctgcctgtggagatctcatggcagccacatccccgcagctctggaggctttctgtgtagacatgggacggtctctacctataagttaggttgcaggtcacagcatggccaggaggggttctggaacagacaggggagaagcgagtcgcagtcagttcaccagcaccagccccatccacaccgcagtgcagcgggcaggttctctagactcaggttccatgggttctggcaatcctagggagccagaaccaactcccaaggcagtgtccttgcctcactgcccaaatgtgaagaaatcttggcgtggcagcttccaggatcaggctgaatcctggtcctgccacttgttagctgtatgaccacaggcaagttacttaacctctctgagtcttagtctcctcatctgtaaaatggagccataacggcacctaattcctggggctcttcatgggttcaagagggtgcctggctccagccagctcgcaggattgcaggcctaggttctgtgggtgggtaacagaggtcatccctgaggcggtatcagacagaccgggcccaggagacagtggcctggtagctccagaacacccactggctcctctctctgtcccttgtcccacagctctgtggccggcggacactgctccctgtctgcccccacagcctgggctctggagagtcccatcccgagttgcttacccagggaaagccactcctagcgtacgagttggcttgagccagcactcagatcttttgcatttgcaaaaaccatgaaaatgacaatctttccatggagtctggggtgtctcttgtgaagagggtcccaggaatctcccccctggatatccaaaccacacacagaggtgccacctgctcttcctcctgggatggctgtgggtactggtgaccacctccagccactgcaatgcgtgttctccacgggtggccggtccctaaagcaccaggaagcccagcgacagccctgcctgctctcctgggtcaggtcatcttttggatccatgctctgcctgtggccagaagccattccggaaattggaaaactgttttcaggccttacgcctgagattaagaccacatgttgtgtttaagaagcagtgggggcccgggatgtgcttggtggtgagaggggttgggcccctcagagtccctcgagctggctttgctgccgctgtccctggcccaccccagccttctctcccgagctgcatggggccactggcttggcatctaaacgcgtatgtgtgaggactttggttaccccataaaccaaagacccagagctgtgttttctcagctgtaatgtaagtttttatatctggcttccaaactcctactggagcactgtaaaaaattaaaaagaagagctttaagtaattaaaaaacctacataaaactgaaggctatgagttttctacaactgttttttaaagaggctggctaaaaagccccagatgtcagattttatttctaaatcctggcatctggcaccatatgcgtttggaaatctgagtcccttgtaggccagtgagtggaaattgtgcccttgttcatgggctgctgtagctttcaaggtctcagagaagccagagccgtggctcctgggtcctccctgtctggcggtctggagtaggaaccctgaggggctgtgtctgggggtggtgggtgacacgcactcactctcagactgcccgggttttccttcctgagacctacaggccctctgaaggacttctccctgctaaggtgtgccagctggactgcttgctggggtgagcccacagcagcccccgaccccacgtcagaggccaggcctctgtaagccagccagcggcccacagcacactggtagggaacagccagggaacgtcccctctgcccacctcgggggagcagtatcaggagagctggcaatattcatctgtgcacttaaagatggcctggggtggccttcagcctgggcgaggtagacctcacacggaggcctcgtggcattgtcctctgtgcacatgccacaagcaggttgccaccagcagctcgcatttggggacctctggtttggctgtcctcttccccgtctataccagcaagattttccagaagtaagatgtagttctgtgaagtttatttggaaaacagtgttaccttcaaaggggaaaggtgtgcatggaaggatggggtttgtcagagatggtggctgtttcctctttccaccccggaccatcttaaatcccagacatcatcccacttcataccgcacccgcacgcctccgcatgtctctaaaagacgcccacgataccattatgtcacctaaaaacacgtaatgattccttacgtcatcagatgtccaaacagagctgtgggaatgtttaaggatgttgtcatccagagacgtggcaggcagtgggcagtggcagaaccttcccccgggttccccagaacagacccagaaggccccacctgctgcccccacccaggtcctcctgcagccgcaggccccgcccgtgccgcaaggcgcccgccctgagcctccctgtgctctgctttcaggccaccacatccaccaactggatcctggagtcccagaatatcaacgaactcaagtccgaaattaactccttgaaagggcttcttttaaatcggtaggagggaggaatggggaccctgttctggtcgggcctggaaaggaggactgggagctctggggcatgggaggggcatgacgcccacccccacccccaaggaccccatctgtctgggcgactcaggcactgagtctggggccttttgagcttctctcttcattccccagttgacaccctctccactccagaggtgacggtctgtggcacacaagttttgaaatacagttcccaggcctgtgaagacctggtcagggacagcttgagccaaaaagcagggcccttggagcagaggagaacttcctggtttggctcctccttcctgagctccaggtgaccactcagtgacagctttgtcccagggaaagcccctgcgggagagtctttgtgttttgtacttggaagggttccacaactgaagacgtgggcagaagcaggccctgccccccggcttcttggttgtccccctgttgtccctctgtagcgacagcacattgtcaccaatgcagcctcagaggtagggtgaccaacttgtcctgctttgcctgggactgtcctggttttatttatttttatttttatttttttttgagatggagtctcgctctgttgcccaggctgcagtgcagtggcacgatctcggctcactgcaacctctgcctcccgggttcacgccattctcctgcctcagcctcccgagtagctgggattacaggcgcccgccaccactcccggctaatttttgtatttttagtagaggtgggattttgctatgttggccaggctggtcttgaattcccgacctcaggtcatctgcccatggcctcccaaagtgctgggattacaggtgtgagccactgtgcctggactgttctggttttttaaaactgaaagtccagtgtccaggagccactctgtcctgggagccgcaactgtgggccatcctcctgggctgatgccctagtgggccttgcatggggtgtccttgtttccctgctgggctggatttgttgggagctgggtgagtgggagggtgcaggtgggcttttcactagggtccaggatggggtgcagaggggtcttgcggctccagccagaagaccccattttccaagccacccaacttcccggttttccctgaggaaaagaacatgtcctggaaagagatgtggcgctggcagaggccagagcattgtcattaggagacagcctccattttccctaaccgagaccagtgccttggaggctggggatggaggccaggccatcgggtgaccgtgggggccaagaaaactgcacatggaatttcttgttagcgtttaggatgctggtgaataaagcaggccgtggtgtgtgccccactcaagtggggtctgtggtgggagagttgtgtctaaggcccctgctgggggacagccctgcgggcagggctttgtcctcttggctcaggcagagatgggcctgcctgttggagagctctgtctctgagccgttgccaagtggacctgacctcccaggtccctcctggaattggctttggtttgggctggctgctggcccaggaacggagtacggagcagaagggagagctgcctcttctgcgttgaaagtgttgagctcagaagttttctagcaaagggcataaccaccgcccttttggttctgatgtgtctgaccccctgccagtggccagggctccctgcctccaccttttgctcaggccatagacaaatgaggactgtggctcaggtgtctggagtccccagtcatagcccttttggactcctcaccaacctgtctctctcctggccactgggttggaggcagggatggtgctgaggatcagaaggaagcaggctcccgcatggcaggcaggccccacttggcttccagcagctgcccaggcagatgggccttgcccagggtgggggcccggggggaccctgggctgtctgtgggggcacaggacccgcttggcatctatctcagctgtaggatctttgctcctgaaaggaggggtggaagggctccatcctgtcccttgcccagtgtccctgggggagcagctcaccatcgccgagcccttgcgggtcagggaaggcgtggcccttcgaaggggggcgtcctgaatgccgccaccaacctcctccccttcttctccctctaggaggcagttccctccatccccatcagccccgaagatcccctcctggcagatcccagtcaagtcaccgtcaccctccagccctgcggccgtgaaccaccacagcagcagcgacatctcacctgtcagcaacgagtccacgtcgtcctcgcctgggaaggagggccacagccccgagggctccacggtcacctaccacttgctgggcccccaggaggaaggcgagggggtggtggacgtcaagggccaggtgcggatggaggtgcaaggcgaggaggagaagagggaggacaaggaggacgaggaggatgaggaggatgatgatgtgagccatgtggacgaggaggactgcctgggggtgcagagggaggaccgccggggcggggatgggcagatcaacgagcaggtggagaagctgcggcggcccgagggcgccagcaacgagagtgagcgggactagggctgcgcctgctgcctccagccctgaggatggcatctagtgtgcccgtgcgtggccataccctgcctccctctctggccctgggagggcagcttggagcccaggtagggggcagagctgtcctcagctgcactgcggcctggtggcagtgtggggagtcacacttctgtccacctggcctcctctcgcctggccgccagccccagccccagccccagccccaggcccagctgcctttggctttgatctcaagtcaggctgaaggcagcgaagcctcggggcccaagcccctccccagccccctctcccggacagacgccttgcccagggtgtgtttgctgagtgtcttgactaccgtgacaccacgcatggccagagctagcgtccctactgcctcccgactcctcagtggaggaggagctgcggtccctctggtgtctgccatccccctccctccctgggcccggccctggacccgtcaggtgcctgtccccagccccaaccccactcatgccccgtcgtcctcccagacaaatgaaaccacgctgcgcttccgatgcccccgcttgccgtgtaatggttcagctaatcccatggcgagatgggggctcactccggaggaggagccaggcagcagggccttcctgaccaacagccagctctgtccttccccccaggaaacacatgttcatttgtgtgatcatgtatagacctcagaacggaagataggactgtatataattgtaataaataccagttgccactatttaatttctgcctgtggctccctgtctgctcatggcaccctgggcccgggggttcgtctcagcgcagcctctagctggtgaagtgtgggtgagggcccatgggcagcttccgccgctgctgagccagaagcagaggccttgttcaggtccagtggctgccggagggcgacactttgctgaccgcaggaggatcagggacctcgtgtgactgtatatagacctcatgtggagtgaggagctcttccttaaatggacgaatgcttcccggggaggggagtgtggcgtcctctctggctccctgtctcccctggctcttttcctcccagtctccctttccccttcacagagcatttggctaaaaccagaagagcagagccatgggctccttgaggggcgctcctattccctgcagcccccaagtgtcaggaccaggctcgtgggccgcaggcgccgtgatgtccatgtgcctgtgtggacacaagggcttcggaaataggaagccctgggcagtccctgcgggtgcgacctccatgtacctgctccgccctgcccctccctctgctggggagggaggaggccatgtggttgggctcagagacttggtgttggggctgttttgtctcagatgtttcgcttttggcccctgcagcaaacccttcttaatgctgggaacacaggtcctgctaaagtgacgggtttccaggcccgggccgcccccgctcactcaagagtccctgggacccggctgcctccacctgctggagggacccctggagcaggtccacccccacccactggagggtccctgggagcaggtctgcccctacccactggagggtccccagtactgggctgcacccacccactggagggtcaccgggagcaggctgaacccacctgctggagggtccagccccagtctggtttctggcctgcgggttgtgtctttcatgcttgtcacctggaaggacactcctgcatttcctgtttccagctacgtgttccccagggacgagcggagcccagttcagtgtcacactatggcttgttctcctttttccctggcctccttgctgtccctgaagaagcaggtgtctcaattcccaggggctgccaccctcacctggacgagggggtcctgcctaccaggaccccaggagtcccagtgtctgggagctgcggtgggcagacaggtgggccaggcctcggcctggctctggggacagtgactgcctgtgtcccaccctcagacctgctgggtcacaggcctgcatctggacggatcggttcctgaggagtccccgccccctgtcatttgctgcctggtggccattgtctgtaacttctcagaggtccctcctccagtgggactagaaagggagaccagagggcagataccctgggaaggaagggaagccagggctgtggggttggtgctgtggaagtgaagtgccagcttcccggctccatttctccctggagagctggggccaccaagaaagggattccctggggcttcactatccctggggtgggggcaatggagacctcacagggcaagcactctccatcctgggggtcagtgggctggcacatccctgaggctcaagcgtggaggagaaacggacagaaacctgggcccggaggccttttgcccctgtgggtcctgagcaccgaattcggcttttgaggacagagtctggcgtgatttcagggagagaaaaacccctccccaaaacggcaggagtgctgcctaataaagccagctgctggaccagggaaaacagccctttgaaaaaaaaaagcctttcattagaaaaataatgcatttcatccaaataaggtaaaaatattcggaatggggcagaagtaagcagcaggcagcgcctgtcaggccctttctggaagggagaagattattaaactcaattacaatgtatttttataaagtgtcttttaggaaagaactagccccatgcttggaggccgggggacagctgccc

SEQ ID NO: 13598 - DNA, 58597 bp, Human
aggcttccttcttttctccttcccagctacctgctctccctcctccctccctcctttccttcctctcatccttttttacttcaccacggagcccaagcttctgccctgcaccttttgtcctctttgctctttatggccaccactgatccacatggctcgccattccatttgatggtctcgtgttttgtgagagccatactgtagttttccttttggcctaggaattgggatttccttctgaacaacgttcagggttggttcttttgctgcctgttggcagccaggagcatgtgggcacagccagcagttatgctggtattatatgtgatgacgctcaaacatctagacataccctcattgagctcatcttcaccttccctgttacaacccgaagccctgctttgccagggctgggagacacctggaactggcactgtccccctggggctcaccagatgcactctgccatgaaaacagctcttgactgtgctctggtgtgtggatatccaccagggacttagaccctgccacctccatccccaaaatgtcaaccaacaccggacccctctcctctgcctttaatcacttccctctttcccaccctacccacacattcttttcaatttcttaaaaattgaaaacactttttatgttccctcttaacaaagacttggctgctgacaactgaactggatttagatgagtgatttattttatgggaggttgtctgaaggggtagtaaaaaagactgtctcgctcttctgctgatttactaaatcactggatctccttcagtccaaatcaccaccaagggtcctggtgttttcataaagatcagccatctcattgatctgagacgccatcctaccagagcactggcttccctgaaaccctggagacagcttgttaaaaggacctcacccttgtttccaacaggacagagtccttatcactcggaacacatagatctcaatgtttggagctaaacgaccctgctcaagggccaatttgtcttcttgctatgttagacctcactctctgctagtccacaggaaaggtctgaagatttcgttccacatgtactggatttgtgtacttcaggtgattttggaaatgaaaaatttagactgatcaagcattgcaaagaaaggcaatgagtgcacaaccacagacttatggaaatttaaaaggagaaataaagagggaaatgcttttccttaaattgaaattaggtagtatggggatgaaagtaaaaaatatattttgttatgattacatttttctagttgaaattttttattgtggtaaaatatatataagatagaatttacctttttggggggtgggggtgtggagtcttgctctgttgcccaggctggagtgcaatgagtggcgtgatctcagctcactgcagcctccgcctcctgggttcaagggattcccctgcctcagcctcccgagtagctgggactacaggcacgcaccaccacgcctggctaattttttgtattttagtagagacggggtttcaccatgtttgccaggatggtctcgatctcctgacctcgtgatcaaccccccactcagcctcccaaagtgccgaatttaccattttaaactatttttaagtgtacagttgagtattattttgcagccatctcaaaaactcagcttcccaaagtgaaattctgcgctcattaaacaatagctccccactcctccccacaactcatggtacccattattctactttctgcctcttataaatttgattattcgagattccacatacaagtggagtgtaattttggaacaaagcaagtccctccttcattttctcaccctctcagtttctctctttttccagcctttcttctattcctcaaatggcatcttgcaagtaacttggcagcttatgtagccaaagaacacaaatgtgttgtgttttttattttctttcttgggttactattaacgctcccttccctgtctttttctgtagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggtaaccagaaccacctggggctcggcacccaggccctttaggaaagggtggaggaagcacaaccccggggcttgcagagaggagcggctcacctttcccaggtgctggcatccctgtgcccggcatcccctgcccagccacagagccctggccaaacttgagtctgccaagtcctggtctcaactgttaaaaacctaggcattcaatggaggtaaaggcattaaaaaatgtgtgacgctgtaaatgatttcaaggaaacataaatcgtgcatagaaggaacactccatacctggactccagaacgtgtgtctgtgatgtgcaggcctggctctcatccgggcgctataggtgatcagcagagtcaccagctaacctgcaagaaggtgggaggttttctctggcccttgtttttccttatttatcaggaggcctatactttttctgggtgctcatagtatcctatgggaaaggacttaaaacttggccctagagtccctcactttacccagactcagttcaattgagagtcaaacgtattccctcttttacataatatatggtatggaatatgacacaaatcatcctctgtaaaaagggtaggaggttcaggagacccctggagccagacaaactgggattctaatccgggcactccacagatggtttgtgggactcagtgttctgcatactcaattctgaaagctgatgtatggcacagatctgtggatttggagtcacggatgtgaaggaccataaaacttatataaaggaaagggcaagaaaggctgttaactacaaagcagtacatgtagggtctcccgattataacagagcccctctctaatagagaacccccatcccatcctccccacaacacatacacacatcatatagcaatgctagttcctctggttagtgtaagcatgctactttatcaggagtcctttaacagcagcctttcatttagatagcagataagtttgttgttatctcttgggatgcaacattatattgaagttctccattaccctactctcattgaatcattagcttttcttttcttttcttttttttcgtttcttcttttctttcctttgctttccttacctttcttttcttttttttttcctttcttttttttttttttttttttgagatggggtctcactctgtcacccaggctagagtgcaccggcacgatctctgttcactgcaacctctgtgtcccaggttcaagcaattctcctgcctcagcctcctgagtagctgggattacaggcaggtgccagcatacccagctaatctttgtagttttagtagagacagggtttcactatgttggccaggctggtcttgaactcctgacctcaggtgatccacctgcttcggccttctaaagtgctgggattataggcgtgagccaccacacctggcccctttctttttaaaagccaaaaaagaagacagagaaaaagtggaaggtagaagaccttgtgcagtccacttgtaactatctaggtagaaggcaaatgcaaacttaatagaaaatttaaattttaaaatagaaataggcattttaaaaatttaaagtgaataaattttcattactgcactcctatctacctttggaatggatttctacaaaatcctctcttttatgagggcagaaaaattgctgtgaagccaagaatagtgaaatttgaccatcagacaaggtgtagggagggtgaaggggaggaaaataaaagcaagctgtggtaagaagctgtgagtcatcctcctttgccttcttgggaaagaacaaatgttctcgccacagtgttggctcatatagacatttccccagatcccaggcaatgctgagctcagagagctggctgaactgtgacagtttccccaaccatgaccatcatttagaatttgcagtctgctctaacctaaaagggtaattatggaaggcaaatggggacagacctctcgctgacctcttggattcttattacccaatgttcttcctaattcaccttcaccaataaccctgtcctctggcatagcaagctgtcctccagatttgtcctccaggttaactcgtgccaaagaacaggacacaagacaagcccagagtgcgacttccttcactaaaccataattgcaatggatgttaggttgggaggtgttggaaactgtctttaatctgagctcaggttgccagtaatatggaactgcttccttgatttaaaccttcttatcactcttccatcctcatccaaaatgagtaaaaattatgacagccatagtacattttaatagcatgtcaccaattacaaaacactgcggctgacataacggcacttgctcctcaaggcaattttgagattgggtacccaggacaggtattgtcatcctctccattttgatgcaggtgaggaaatggagatgaaagaggttaagatgtggtggaggtcacacatttaatgagggagagaatttgccctagaatccaggattttacccttaccccaagggctcttattagaataatacctgactccactttgtaagaagagaatgtggatgtctttcgacaatggggtaagcaggttgtcctctctgttacttccttgggctagattactggcacctaagagagggttgtgataaaaatattctcttcagaaacttcttgtggctacctacctattctaaataataaagatattggaaattgagaactaaaaagctccatcagtacagaagcaaattatgttcagtgtagaagttgtactactcatctgtatttattatttttaaaagtactaaaatatcatctatttgtttatatgggcattttctagttaagaagtgaatactgcttaatacattttggatgcttaataatttattaatattagttgtgttaattatagtaaatagcagattgtagggaaattatgctattaaccttctagctagtgtgtctgagagatatcttcttcatttttcctgtaacagttccttatggggattttttaaaaatagaaaaccttggtcaagtgaaaatgtcagtattttagtagtacctacctggaattaccaaattggttacttaataattaattttgttgttttatttttggcatggtgatggcagataactatacaataattagctattgtagctcaccctcacccttatccctccaaaaacaaaacaaaaaactacctgaatcagccattgtttcaccctgaggttattaaagaaagaagtcttttgaagacattttttttttttttttgagatggagtcttgctctgttgcccaggctggagtgcagtggcacgatctcggctcactgcaacctctgcctctggtgattctcctgcctcaaccacccaagcagctgggaatacaggcacgtgccaccacgcccggctaattttttgtatttttagtagagatgaggtttcaccgtgttagccaggatgctctcgagctcctgacatcgtgttcacccgcctcagactcccaaagtgctaggattacaggcgtgagccaccgtgcctggcgctataaggtatttaagagctgtcatattataatagataaaaccatgatgtcagaaacctgaattttattccaagctctactttaaaaaaaaattatcttgtggctttgtaggattttttagcttttgtaaataatgctgttggggaatcaacaggactaaatctctaatgttgaactggactgggttaattcagttcatagctaagagagccctaagatcccagttacttttgttgatgagattggcagccaaatccaatctcatccttggatctcaatccaatccatctttttgaaggagtcaaggaagaagataggtcttatagttcaggatgtaaacttaaaccttatacaagacttttgaaaggcttccctttcagtgtctgcttccagaaacaacgttgccctgtaacctgggaggtctattagaaatccctctgccctatggaggcagcctgagctcccagaaagtaactattgttttttatgacagcctacagtagagtctcctctgttgagaaacattcagcatgtgagggttttatttaattaacaattgtaaccccaagtattcacattactgtcacattgtgagtgcctgtcctatcggaagtagcccagcttctttagatacaaggcttgagggaagtgaggaggaggtatgggtagctccttccttcccaggtactggaaaaatctggatcattatgctctgtccatctaaaatgcccttggaactttgctctctgttgtgtgttcctcagcagctgtttagcagctgctttgctccacctcagcagtgggtgaaacgaccccactgtctgtttattgaagagcagaaagggccccgggatagagtgccctgaataaacatcagatattgtgaatatttttattcaccataatgaagcacattattattagctgagcactgtggcttcccagctgagagctggtgcacttgacaatactccctcacatccagcccctcctctctttgagcccagacgaggtggggaggctgcagcccggcgggaggttgtttctctagaaaggtggctaggatgcttgccatgtgcctagccctccactctccatcctgtggtctccaaatttcagctaacttgctgccaggttttatttccttctcttggttgtacagttccaggtgctggggttggctagggaatgagcttactatatagatctcgtgtttatttagcacttttccatggagagtggagagtaacatgctataaggacccgatcttctatggatttgtcttctgtataggcccacagagtaaaaaggaggtatttattaccacctttacttttaccaagagggaaattgaactctggagaagtttacccagttatcgatatatccaaatatgctgggatttctaagttatctatattttgaagagataattgtgacatgtacttgtagggccaggcacacatatagtaactcatttaatccttactacaccttatcaggtagggtattgccatctcggtttcacaaattagaaaaacgaggcacagatacgttaagtaactttgaagatcccacagccaagtgagttccagaggcaggagctgaacccagactgtgctctcactcagcctctctgctgtgttcatgtgagggatttgctcagtctgcaggtcatggcacaagagcatgggtgccattagccttgctgaagggtcaggaatgattaaagccacttttgggtgagttaaatgaagcactgagtagtgaaaggatgtgcccaaatattcatggaggcagggtcaaaaacccaggcctcccattcaccagtgtagacacagcccagtggatgcacctgcctatgtacctttggccaaccaacctcaaaggatttcttagataaataatcagtaaatgtctactattgttattgttattgcgttgtcgacacatatgacaacggcaatgcaatgttatcaataacgagcgtgtttctgctgttaataagttggaggaattgagtctttagttctttaactctcaaagcatcatcttgccttttttgttgtgaatctaatatagttttacagtattgctttgagtgaatctgtgaatagatgttttgttgaatgctcagctaaggaaaccagattatggatgctaagtcatagtaactaaaagagagggcaggagttttcagaggagtaagttcagactctaggaaaggacagaggccctggcctaaaataggaagggctcaggccctacctctgcctcttcatgtttgctgtgtgcctgtggaaatgtcccttcagctctctgggccacttcttcctgttaaataaggaggtggggaaatatgattttcaactccacctccagagctgatgatatgctagtttataacctgagaatttttatttctgcagggatagttcctgaatcctctcaatcatgttttgatgctgtttctgtaagacccctggggacagattccctttgtgttatagacatagtggatcttcagaaggccagaacaggagaggaagttcttataataaaacttgaaacagaaataggtggatgagaaatctcccagaagagttatcaaagcttttaattccataattccatttaaactcttttggctatttatgcattctaaaattgagtatttggaagtactcctatatcagaaataatgagcaaggcagaaagcacatgatacatttgaccccaaactctctttggctgttaactttgggaaaaagggtggtgtagtgtgttttatactagaagtcatattcttacattttactgtggtaaaatcatgggaaaaaaaagattaagataaaatgattaagaaacttttttttctcttaaaaaaatccagcattatcagccaggcgcagtggctcacgcctgtaatcccagcactttgggaggccgaggcggggggatcacgaggtcaggagatcgagaccatcctggctaacacagtgaaaccccgtctctactaaaattacaaaaaaattagctgggcgtggtggcgggcgcctgtagtcccagctactccggaggctgaggcaggagaatggcgtgaacccgggaggcggggcttgcagtgagccgatatcgtgccactgcactccagcctgggcgaccgagcgagactccgtctcaaaaaaaataaataaataaaaataaaaattcaacattatcgccaaaactttgagccacaggggctgaaagggacgtctaccacaaactatcctagttttctttatttgcacaagtctctagaaaagcccacgtggcctaatgtcatagacttgatgcgtgttgaggcttggaccctcaatgacggtgttgattgtcctgccattccaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggtgagtctcccatggggctgtcctgccctctctgggagtccctgatctggggctggagtccacagccgctgcccccttcaggctctagtttcaccccatcaacgctgaaccaagtgataccctgaggatggttctgcgagactagatgggccatcggtttcacacagtaccaggaaaatacatggttggaggggatgatctttatcactactgttatgcactctgggtagcagcaaggaggacttaggtacagtgagatttttttcttttcatagcactaggtacctcttttacagttgcgtcttataactatgggcctgcagctgtcttactagcattctatcacgacaggctctcttcaataaagtttattccatttgcttggaaattgggatcttttccacactgtagatggacagagagtgcactcaattcaacaaatattcctaagtaaattgctgtctctgggctaattttaggagtgcagagctgaataagacatggcactttggacacagagggacaaggaggtggtctaacatgggccaacttggtttgatggtttccatctggcattgctgctcatgtccttacttgtgagttcagagcattcagttgaagaaaccatggatagaaaggacctttaaaagaagacaagaactgagaacacagaacaagtggtcatctcttgtttcatctactctctagaccggtagatttatgtgaaaccctttgattccttttgcttctgttatccagcctgtaagatagtaatagtcgtcatatctttcatctactctagaagaatattttgataattcatctagcaaatacattttgattatgggtatgctttgtgatctagagtttgtcttaaattcatcatctgtgaattcagataccattcatatttaaattcttgataataatcccaatctgttatttttatcattgggacattagatatgtcagggtcagtgtaccatttcacagtctataattttgcctcttttcaatgagataaaacaatttattactcctcttgaattttttcacccctgagatcatgttttattcagctctcctacctgcatttttctctgtgttcacaattatggtctttacagtccttggacctctttaaaacgccctggcatcttttttcctcactcccttttagtcaatgtgttttgggttgcatggaatataacatgagaatgccggctagcaaaatgtaactctgggccagtagaattccatagaataagtcaagagaaagtaaaaacgaaggccgttttccccagctgggtatagtaatggagtggaaataggcaaaatcaccctaaagcaggatcctctgtgcctctccctcacccgtggcctgctgtctgccaggcttctgtaatgcagcccgttctgcgtagtgcaaagtgcaagtgactggtggcctctgtttgggtccttcctctgtgccactgccaccctgcatgtattgcttacatctccatggtaactcccctagttaaaatgctggagttggtatttatgttggcagatattgaaaaaaaaaaaaaaaacaattggctccagactgggttctttcttttcaagaaagtaagcagagagaagggaggggcagaattattgtctcattggatatcttctctcagtaattccagtgtgcccagctgaaggtcagactttaacagacacaaagctaggagggttttgtacgcaagtttctttcgcttccaccagcctttgcctagagtgttccagttggcaccagacggacaatcactttaagacagggtctttttcttgctttggttacaacatttgaatcattgcttctgagccaagattcaaaacgaaaacaactaacctattgtcatcgttactatcatttcattttgggggtatatttattaccagtgaaagaacatgaccccaaattccagcctaaggctgagcaaatggccttctcagttcaaaaacaaatgtctgccagacatcctgattggggaattcacatcaatgcctccagcgtcactagctataattgggagagagagctaagcaaacttagtaagaaagacacactcactgcagatattcacatgctcctctaaaccatgcatctgatgggcagggcctcaccaaaaaagatttcatggaagacaaataaaatacaaagaggacttgatttagtaataggattagtctttgtaatctaataggtgtgtagaattgagtgttactactttgttgtggaacactcattgtattagctttctattgctgcgtagcagattaccacaaattaagcagcttaaaacaacacaagtttattatcgcacagtttctgttggtcaggggcctgggcatggcttagctggatcctctgccctaatcacagcgaatctgtaatcaagcttataagctgaggctgtgatctcgtctgaggctcagggtctccttccaagctcgttctggttgttggcagaattcatttccttctgattgtacgactgagggcctcagttcctagaggctccctttctcaataggcaggtcacagtttggctgcctgctttcttcctgagggccagcaggagaaaccttccattttaaggctttaatcgaatcttccctttcgtttactcaaagtcagctgatgaggaacctaatcatatttactatgccatccacttacagggaaggtgtgtacaccagggtctagagttttggaattctgtccaccacacccctcaactaacctttcggccctttatgccactcaagtcatttcctgtctctcttccttagattgacttaactgtaccacggaagtttaacttaaaaattccacacattcattcattcattcattcattcattcaacatttatcatatcatgctatataccaagcattgtgccatacaacttggtaagtttattatcaggactataaataacattttttttttttagttaaaagagggagagaacttataagctctctaaatgattttcgagcattaatcttaactgtttttctataacatttttctggaaataacagtaacacaaacagataattaaaagtacgtctgtatacttcactgcaatagaggggattacataaagtatattgccaaagagaggatgacaagaaagaggaaaggacatccaagaaggtctagtctggtcacactggcactctacttagatttactggcttatctaactgagctcttactatctgcccgatgttatagtagccactggaacatcaaagatgaaaaaagtgcatataaaggtgggtcctaccttcaaagagctcataggacaaatactgttacaactacacagaacaccacatgttacacattcagttcattcatctacctactccacctgaaggaaatgatccagagagagggcctaaaatactgagtttcagaggagcaggatgtttgccaaatagaaggaataatagcaaaataaaataacagaattctacttcagcaagcattccttgagtgcttactatatgcgtgagacacaagggtctcaaatatgagtgagatctgtcctctgcctttgaggaatttgctgtttagttggggagacgtatgtaaatctgtggcggatgttgtgggagagaaatatgcagggtggtgtgaaaagccacaggagcatgaaagccacgagtctttggggaacgcagaggcatatgatgtggctagatgaaattgttcagagcatgtgtaggattgaggggaaatgaggcactagggataggaaagatccactgaaaacccttaactgtaccagtgaagattttgaatttatcctattaaacagcagaaaccctcagagctgtttaaggaagatgtatgggaagttatcacataaaattgcactggattcaaattctggctacaaccctgatgacctatatgacgctggataagtggcttattttcccaagactcagttttcttacctgtaaaacagggataatcctgtaaataggaataaatattagtatagtatctggcatataatattcacatcataattcagctatcataatgattactgtgttatatattattactgttatatgatatattattgtacattgttatatatatacacattattgttaaattttataatgattagtgacatgatcatatctgtggtttagaaagattagtgattctcttgaagatgagctgtattggagaaaagacaatgtaaagaacaattattgaagcctgtgctcctcaaactggcactgcacaggataaattgaaatacttttcacattttgtgtaagtattccaaagaaaatattcttattttaagataaacattgatatattataaagtggactaaaacaagaggttccaaagatattttatgtttttgatggtgtccccagagctacaatctttttccaggagggcttcttaggaaagcattgatctagtgttgctctggtatatagctatttatttttaaatttaagttaactaaatactaaattaaaataaataaacatttaaaaattagctctctggttacactagccacattgcagctgctcagtagccacacatagccaatgactaatgtattggacagcagagatatagaacatttcactcatcgtagaaagtactcttggacagcactagtcatacagtgatacaacaggcagctgctcctcttcactcacttcacaaatagcagcgcaattagaatgaaacagaagaggtagatttgaaagtgtagaactgtcaggacatgctttgggggcaatcatttgatgaaggtaagaaagcaggaagagttgagaaactcctagtttctagcacatgctaggtactccaatctttgaatgaatgaatgaatgaacaaattagcaaatataatgaaccatatctatagtaatgtcaccaaataataagactaacaaggaaaatggagctgatttgggtaaaaggtgatcttagttttggaaacagtttgtttgaagatgcttggagtctgcagtcataaatgggccaatggctcttagcagaggtattagggcaggagataacaaatttgatagttagcagtgtatgtctgtgatgtctacacatctcactatcatgagtcttttataaaaaacttaccccatggaccctgtgattcaaaaatattctgtccctaaaacaccatatttatccagtaatattttatcagcttccaaatttcttaaattcaaaacctagatgcccaactcacaaagctactgattggtttgaaatcacaaatgttaactcagcaaggtgataacacttcaagccaaagcaaagaaaccaggtgtctcagttagctcaaccttattgtagaaaggtgttattttcactaggtttcttgaaatttggaaaaatcctgatcctaggatttcaaaggccctagattaagacagctactaaaagaagtgataagcgagtccatcagagtaggtgagaccacctagggaagattgcacatcacaaggagagaagagctgggaacagctgtctgcaccatccgcataccaccagctcattccagagaggtttcctttgagttcaattggaagagtcccaaaaaatacacagtaatgctaatgcaaacaactgaatgaaggaacggaggctctccaaattagggagccttcagggtccagttccccaggcctaaaacaacagtctttaggcgaagaagaaagagaagccaaaggttatctaaagcctggcctgcagaccctgttagtcacttggctatcttcctcaaattcccatcatgcaagagcttttaacacatgcccactttgcagttaggcttttaaatccaatctgtacaatttctgatgctgagtgacccagaaactcagcatgatttaggagagtgacttgggcttggcataatctggacagatgtggttaatacctgtggacagatggtgttcttccggtaaaatcaggcacttcattgtgttaattaatccaagtgggaccctgaaaatacaatattagctgaatttcctgtctagcaaggccatcagtgctttctgttggctaaattgggaaatcctatatcctggtataatcagggatgttctggaaatcttttccataaggaaaagcttttaataaaagcaagaaaggcaaaagtgctaagtgagctaatttaaagatgaaggccacacaacttcaaggagggccaaccagcccctgcattgagcctgcaactccctcaactatccacaggccttcattgtcaggaagcaataaagtgattctcactttaaattagttcaattagcactttttttttaaggcagaaaatgcttttattaaaaaaaagtgattttctcctttttggcaacctgtatatgaaaaagaattctgtgggcttttgttttaccatttagcagctgttcttgcttaagaagtgccacttttctccttttgagggatgtcaagctgttgggggttaatttcagtcagttctgtgccctcttccccagatgccttttaaaaatgttacatgcatttacatggggatagaatggaaagaacatgataacttatttttaacttatggctgcagaagctctgcataattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtagtgaaaaatgaataacttgaattgattgccaagagggaggggtcaggcccagtgcctggaacctggtaggaagaaagaccaagttgtagcagctgccacgtgttgggcgctgtgctgagtgctgtctttgtgtggtctcatctcttccctactctcaccctgtgaagtcagtatcaccctcttcactttcacggaagaagctgatcgaaatcacccagctgatattcaattgaccgaggattcaaaaccaagatggggctgggcgcggtggctcatgcctgtaatcccagcactttgggaggctgaggcaggcagatcatgaggtcgggagttagagaccagcctggccaatatgatgaaaccccatctctactaaaaatacaaaaattagctgggtgttgtggcacgtgcctgtaatcccagctactcaagaggctgagacaggagaatcacttgaacccaggaggtggaggttccagtgagccaagatcacaccactgcactccagcctgggtgacagagtgaaactccatctcaaaaaaacaaaccaagatggcccgaattttgaaactttatactcctcactactctgcaaaaatatctgtgaccactcttctgttcggtgcccagatggtacacaatgaagtattgagcaaatgcttttagcgttggttttggcatccagccccttttggtaaatctgctccaaattcaccttttgctcaaaaatttgtcttctcccagaagtagatttattctctcccattttatatttatttggtgtgagcctttttgttattatttcctttctctttacaaaggcggaagagacggaatttcaacaagcaagcgacagaaatcctgaatgaatatttctattcccatctcagcaacccttaccccagtgaggaagccaaagaggagttagccaagaagtgtggcatcacagtctcccaggtaagcagcacctcaaaagcctcagcctgtagcctggccatggcggggcctccggggcaggctcttagaggtcttgctttactggacattcatgccttgcaagttccatcagctatagccttaaaatatcaaggtaagcacttgatgtgtatgcgtataagtgagtttctaggtaagtacttggcaaaacttgagaagaaccagcagaaggaagagaagaataagtagagtacaatgtaaaaacaggattagggttcttcccatcgagcactcctttgcttcaaatgggtgaggtgtctaaagtgtactaggaaagttatctgcattcctcatgctgttttttcaaattcagtcaattccttagccattttttgcccaacccaggaactttaagagtcagtgaatggaactagttgttatatagccttttaaatgaaagaacttaaatgtctcctcttgatgtgctgactctataactgatgggagtgtaggaattttaacatgtcactgcgattacattggaatggtgaacaaaatgtcactgaatgcccccttcccccaaagagcaataaccataacaggtggtgtctgatgacttggaaagatacatgacataaaatttttataggcctagagttttcaacacgaatatgaagcagagaagtaggcaataattatgtgtacgtgtattttgtccactcaaaagatccacccaaacttcttattcagtctgaacctcaaataccaccactggtttctaattgagaaccatagtgataattctgaaatctatcggagaaggtttttcttagaattttgtcacatgcaggagaattaaatgtactgatatttccattaaaactggggaggggagggagtagtgaaggctactgtagcgagaaatttcacttaccatttttcaaatgaagtagatgctcttttatataaactaagcatctgtacctccttgaattgaatcctgacttctgttaatccctgcagggtgctgatcccatcaacctgtgtttagctgtacagaattaggtccagtcagaatatagagctccacaaaagtattgacaatgaagggactgtccaagccttcccaacaaactaagatgattttacagcagcaaatatccttgaaaacattctttcagataaagcagaatgaattgactcctttttaacctgggccttccttaggtgctttgacccagctggaggtcatttttagtcttgacagttctgggaaacgggaacgtcagcggtcaaactcaagtagcctagttttttctagggctgtcaccattcttatccaaatctaaaccccttttccacaaaaaagggaattaatgctttttgatacttgctacatgtttgaggaatgcttctaggtatggaccacaaatatgcagcaaatatcaaatcactgaattttatcatggaaccttctgcttttaaaatataattaaattactactgtctgaattccaagtgtggaattcagaatttcaacttcctgttgaaggtaaaaggaattctcctggaggtaatttgtagtatagctggatacaagttaaaatcctgatctgttcccgcaaccttcacttccttcattatggaaactcaaggtacaaatagtgtgtccattaaaatccttatttacatattgtgtcacctttccctttcctctgtccatgccaaagtcatgccattctttcttccccatcacatctgtctctccccaaagcaactaagctaccattgctaaacaagtccaatggaagacagtataatatgatgtcatagaaggagcattaagcaaggagcctatttttgacaagagtcaactgtgggatcctagggaactcactctttctttttggatcttagttgccccatttactaatcatggtttgttggatcacatgatttattaaatctttctcctaattcccaaagccagggaatacctcttgggctgtatcattattgtctttttttgaagtcacaaattcttttgaaatctactaaaagctattgatttcccccatgacccaaaacaaagatatgttgcccatacacccaaatccatctgaaatccgcctattgactgtatctcctcagatccctaaagagccctttttctataccagagctactctaagtgtgatccacagaatgcagcatcagcatcccctgggagcctgttagaaatataaattcttgagtgtcaccctaattctgaatcagaatctttgagggtgaaatctataatagaaatttgttttaacaacttccccatgaacacttaactttgaaaagcaatgttctatatgctttatctgagtgatcttttccatgctcacagctacaaataatacctccatttgaatacctaatggaacttctcccctgcagcaccaaactcataaattttacttcctaatggacttcatcatggctctgcccagaggttcttcaaaattaacttgttcaaaatgtgaatcaaactcttcccataaaacctactattctttctgtatttcatgtctcattctgtgtctgttatctatacatccctagtgcctaacgcgtattaggcccttagtccatgactgttgagtaattagttcattcatgataacactcattttatacattgtccagatcattgtctgttggacaatgcaggaagtccctgaactgacctagcaccttcctaccagttccattgttgtcatttagaagggtatcattcccacaacatgtcccctctttacccccttcagctcatattttttttacatataattggacctcaggtatttcttcttcaaaagtcctctgaaattatcttcatctttttcccttttctttcagcttgtgcagttatctgagaaaaaaaatctccttaccttttttcttcttttcctatcccataaatcaaaaagcaaccataattatgactgattcctatgaatagtgaaagttatgtcaagaaaaacataaatttcaaagtgaaactagatatgcagtgatcctgaaatacacccaaaagtgtccttcctcctccagtttacctctttttctgtagacatcagtgtttacaataaataaagcattttcttattgaatttttttcttttttgtttaatattgtggtggtacagactgatttttttttaaaaaagaaaggcttggcatttctgctgtagtataagctgtataagcctttcagtgctatccttataagatgttttaagtttgttaatgcgtttaaaaaattaagtatagttttgcaacagttttctttatctgccgtcgttgggagttaaatatcaatgatatgtaagctgtggtacatgtgggatcaactcccccttccctcaccagattcatagtttgttttgtaattatataaaaacatcgacattttagttcaaaatcatatctggaatgtgggatataaaactttccttccccgggcaggaattatgggggtaaaacttgaatttaactgtgtctccacttgtgtctggcagaggtcttggtatgaagggagcagaggtaccagatcaagccaagacacctgctgcgaaccacatgaaggaaataaattaacaaatgaaagtaaattaggtttattgtgtctgctggctttaacatttaaaccctagaattcaaggggataatcatttgtatgctacagtttttccttatgtagataacactaagctttacacaaaatagtcagtgaaatctggtagattgaattatattgatcctaaggtctatagtgaaatacagctaagaatctcagtccacattaaagttatgtaacttctaaaaatttgcaattaatctatcacacgaaagcacctatatggacatttaaagatctgtgtatcttgatggcatcaagccagctttcacattgataaacgctaggggcatttctcctgaaatgttaggtatattttagtgtcataactgaagatgtaagcaaatttaaaatgcttgctctaaattaaaagggttctagcttaaatgagcagctcctttataggaagatttttgtcacagtggtttcgctaaatttcagttatattaaacaagagaatcgcattttatgtagttgtccttttgaagctcttacttcagatctttttactgatgttgccaaattattataggataagaccaattagcttacctcttcacctctcccataaagccttttttttcttctgcaatgtttctgaaggatgaaatgtgaactttctcatcttctcttaaactactctaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttagttttttctttgattgggggtgggggaaggaattgttctccatttttatactggctgttcctacattgggattttcttttaatttgttaggcttttgattggttaatttctgtatttgattgtatttttggatgttaatgtcactttgggctctttctttcatttccaaagagcaatctgttagactttttacaacgtgggttgtctggaggtttgcattaatttgtctattaagttaagaccaaagtaaattggttagcttgaagagacctctaaattctcctctcagggatatcaataagtaagttagacatagtgcttagagatagtctattgggattctgtcatttggcctgttttatataaagcttttatccttgtcagttttgctgttccaacaacataatgtctgggtcacttattagcatgcattctatgcagaaatatttactcttctagcaaatatcttattagaatgctttggtatgcaaagccaggctatgaatatttctatatattgtttatagttgttgttctttattgttttttgttggtcttctttatgattatcggtcatgagctatgtaataggctttgtttcaggaaatatgcattatatcactaatttaagagtttaggtcaaaatactatattttggggtgtgccttgtgtcatcagttcagaatttctacatgtgaaaaaatgtagttaataatgcaaaaaatataacctttgtgtttgtatgctatggaaggcatgtggtaatttttttttccctttggtaaaggaaagacaagtattttctcattaaataagtttggtttgactttgattagggtgcacagctaagaaaactgatgattctaacttaaaaggttaccaatttaaatatgtttgatcgtaatatgattacaaacctaatgtctaacattttttagagtatgtggtatctttgaccacaaagcttgtttgtccactaaaataagttttcttacagcgactcgttactggagaaatgtagggttccacagactgatgtcttctgtgagcttccagatgcataaatttgttatgataaggtcctccaagtcactgggctatacccagcacttcttttgtggccttcttttatctaaatggaatcatgcatgaagagtagcctgggctttttcaacatggatataataaaacaatgtagaattcaatccagttttaattttcccagcactgcaggttagattcctatgaggagcatatttacttttttagaaatattttgtttttttcttcctccatcatggtgtgattgacaagggatcaaagctaacaggttcaataaccagagagagttccatcttctccatctggtcaattattaagaatttcagacccaacaacaccagttgaactgtgctgctaggcagacattttcacttgtctctttggaagaagtacaattctgtcaacattagcaaaaatgcactcaacactcctgcaaaggttatcataatgcaaaacgatatcaaaatgactttttcctgtccctggtatatctgcatcgcagatggcttagcatgatttatgactagtccttagaaaagccctgtggactttcttcattactaaatttgtaactatttattctttcctaaagcccttaaaagagaaaaataagcattttaaccctctattctgtgtttaagaaatatggttgcctcttatggaatgtcagactatgattacagttttctaaggaatttttttctggtggcttaaacatcatgtgactattctgagcacaaagtaaattattatggaaaatttgagctaagccttccaattgtgcgtaagttgttggaaataatctgcacaggaacccctttgtagtgctttttctaaagtagaggcaaaagaaaatactattgtatgtgtgcaatagcatggaattttaaaagataaacattttaacaggaaaagttataaatgggcttttctgtattttcttttgctcttaaccaacctaaatcatccacacaggtaaagtagaactttaaaatgttcaaacttttcacataaggtgtttattatgttatgtacttgctcttcaataatttggaaagataaatgataattgaaataaattttaaataagaggttaatatgtgaaaatatattttggcagagtttgaagtctagagttgtagaacctaggaacttttcataacctcagtattgaagcagaagtttttttttcagagttttacaaaatataagtactcatttctattgtaaagaaatatatttctggctgggtgcagtggctcatgcctgtaatcccagcactttgggaggccgaggcgggcggatcacgaggtcaggagtttgagaccagcctggccaatgtggtgaaaccccgtctctaccaaaattacaaaaattagctgggcatggtggcgtgcacctgtagttccagctactcgggaggctgaggcagaagaatcccttgaacctgggaggtgcagattgtagtgagctgagaccgcaccacttactccagcctgggcaacacagcgaaactccaactccaaaaacaaaacaaacaaacaaacaaaaaaaccaaatatatttctttgcaagtaaatcctcttcctgctagaggcttctgtatggagaacagcacttcagtaagattacttccaaatatttctatttattgatatgttccatgtctcctatcttcttaagcataattttttttttaaatcacttaagactaaaacccggggggattagcaagcatttagagacatttagcatgcttcatagtttataccagcaaagtgagacaaaatggatgaagcaaagaggaagaatagaaggaaggagagaaagttaaattttgaaaaaagaaagcaagaataggggccagttgaagcactggttaaaacctggggtctataattcttctgtagtggcctagagtaatgcattcttaatttcttaatttcgatgagattataaaacctcagaaaaatgaggccctttcaagaagcttggattatcttctgcagaggattttaacatccaagaagaaagaaattgacttgtgcattacagatgttcactgtggcatgccatcagcgttgaaattatatcacattctgtgattagatcagtggtagtgggcttactgaagctcagaaccccaagattggaattcttttgcttagctgtgtgtttgtgtcaaggacaacagcaaattcaaccatgaaagttcttcctctagcactattttagtcaatggcaagcccatatacataatcttgtaatacccctgtattagtccattctcacgctgctatgaggaaatgcctgagactgggtaatttctaaaggaaagaggcttaattgactcaggttagcatggctggagaggcctcaggaaacttgcagtcatggcagaaggtgaaggggaagcaaggcagcttcttcataaggcagcaggaagaagtgccgagtgaagtggggaagagccccttataaaaccatcagatagatcttgtgagaactcactcactatcacaacagcatggaggaaactgcccccatgattcaattaagttcacctggtctctcctttgacctggggaccgtggggattatggggattacaattcaagatgagatttgggtggggacacaaagtctaatcatatcaacccctaaaaagaggtttggtgtttttcaggattgatgaaaggttattatattaaaactcagagccttcatgccctatgagaagtttttatataatacacacagagagaaggtaacacatacagagaagttgactaaaactttagtaaatccacaggaattcttataattttgttttttaaaaccaagtgaaaatatttatcccactgatgttttatctcatgtctttcttagtatgattctcctctttatttttgattgaagagtgaaaacaatttgtcctggaattggaactctacaaccttgagatacatacctattgaagggttttcacattcaaccagacaacactttactcttttgctttgtcccaagtagaaagtaacaatgaattttggaattcacaaagggaaatggaaaagcaagcatgcatgggacataatttaagcttacatctagtaaaaagggcctatcctttgagctcccaaatggtatgagagtccaatctaatcaagctgaatcaggctggccacataatctatctgaagtcttgatttctaaactacagaaaatggcaactacttcattaaaatactgtaaggaatattgagtgaatacatttaaacactgaattccttaaaaggaaaaagtaaatccgttcttgctctaggtcttttgttctcatctaggggcaaatttgtactcccaggggacatttggtactatctggagctatctttggttgtcacaattttgaagggaggttgttattggcatctattggatagaggataaccattgtagggctaaccagcctacaatgcataagataatctcccacaataaagaatatttggcccaaaatgtcagtagcaacaaggttgagagatcctattctaggtttaagctttatcattattattattattattatttttggattatgaagttaactgattttttttattgttttttgcttttaatttttttgtttttctttaacaaatttaagtctcctgaagattctttagagtagaaatgcaattttctggaacttgtctgatgaaaatggatgtggacactttaccacatcatgatgtctgcccaagcaaatgcattataatcataagtgatccagtatttcttctctgcctagttgagtgtagatttagttctgcacatgccccaaatgtctgggtggcagtttaaatgagctgcttgccttccttcccaaaccaaattcagaaccttttaactgacaaccacatcttaaaatgtgcttctaatggtagctgatggcttcaaaacagcctgcaggtaaggtttctgaatgatcttctcagcaagccaagtctttctgtttcagttctttgagaatgccacagcacctccaagagagcccattcactatttgtcagtggatcgtgtgcttcccaggaggttatccattccatgataaattctttccaacttgcagtgctgggtagagaacatgtcctccccttgtagttcagatgtttttgtggacttccgtctgcttcattgtggtgttagtggcacctggtctcttccctcagcacagtcagtgcttctagatacttatcagagagtgagaagccatggtaatattgtacatgggtgtacagacacaatgaaatgctgaaacagcacagccaagagcacaagggactgtttcttcaattactgctctgatacaaatgcacttgtatatgaagtacatttatatatgcatatttatctctgtgtacattaggcagccagacatatttacagtttatgcacatgtattttttaaatcacctgtgtcaattgcaatgtgtatcttttaaatgacacattccatgccttcatggttccatggatgccacgtcattggacatcatgtagccctttgggggtttctcccatttctaagtttgtatactaatttccagaaaaacattggtcaaacttatagtccttatgtttaggctagatttaccacagtggaaccagtggaatctgggtggtgccaggatggaccttaaggttgactctctgggtgatgagacatcatctagagacgatgggagagaagtaaaatacgtgagcctgaaactgaacactctggggagttgggtgggggagtctgatgacatataacaaattataatttgggttcttggagctgattcttcttggttctgatgacatctaaatgcaagcatgtattgtaatacattacaaaatgacttttattatttaggttatatctgtgattacaaaaaatatttgagagggatagaactagtatatagagatattatatatctacacgtgagaatgtgatctgtgccacacattgtttcattcatatgttcaggaagacagtttcaaagataggtcccatattaatggaaggaagttacagaccaaaggctttgtcccactgactgggtataagccacacctggccagatcttacacttgttttgctaaggccctacctttctaattcctttcagataagctaaacagagaaatgtgggccagatgagacaggacaagtcgcagagctatggagatggcatagtcctttggttgatgcttgagtcctcctctaacccccaaagaaagcatttattttttcctgggaaagaaggaatgagaagggagttaggtggaggattgttttatttagtaaaatagctaggttttttttgcatgcaaatgaacatcccacaggacaaagaaaattggagtttttttttttttttaatgttgagttgtccccaggtttataaatcatctgctttctctaaatggctcttgcctttaaagtatgaaaacaccatgaatagcctagatagataccataaataaacagtgcattgtgtcagagtttagagttcatcatttgttaagtggtccttctatgggggaaaaaaagtcctctcttctgcttagctgcacctcttcatgtggggcaggaaagctctcagagctcaaatccctaccttaggagaaaagaaaagtgtcagagctgaggcatgaatcattgttgggtgattccacactgatgatggctgtctcagaatatgagggcaagagcacaatttgagcaatatagggttggaaataatagagtgcaactgacctgggtccctaaggtctttccttttccaggctaatgtcatgttttaaccaaaccttgcacgttgagctttctttcctaatgcgctgagctgcacgatgacttcagaataatattaagcttttgcaagcccttatgcttaggttgaatgtgggctaggttcaccgcagtggaaccagtggaacctgggtggtgccaggatggaccttaggctaactcactggatgatgcttccatccctgggaggtgaaaagcagatggctaatggcccttcttgaggcccacttattattattattactattattattattagcagcgatgtttcatattttatgcatgcttgagaattcctggcccattattttgttttctctgtagtcacaggtggcagagaagggtagatcactcccacatattcttacagtcctcaaggttccttgggctgttgccaccctgcaagaaatttcaccttcattttagaaattaagaatgtcaatagacccatatcatagagccactcctagtaggtgacattgccttcatgcactccctcccaggtgctgctcctcacaggggaggggatggtttagcaatgacatatttagaatccagttgaatagtttatgtgctctatcatggtggcagaagtaccagtgaccagcccatagcctccatcttgtggtcccctggccaaccctagaattttagaggcatagaagagagatcctaggtctagagactacaatccaaatagactaagttgggaagaataaaggttccctttcttggcttgaagttgccaaggggaagcagttctattgacaacttgcagtaaggtatggcttcacataacataaacaatatgcaccctttattgcttgctctgttcttcatgctactaaccagactctgttgatgttatttttattttagtttttatttggggggggttgctttgcatgtcattcttcctcttggctgttagttgcggggtttgagccttttcctttctgtgattcaggtgcctcactctttcctttccaggttcttccagttcttttaacatgtcaaactctggagatttgttcatgagcgtgcagtcactcaatggggattcttaccaaggggcccaggttggagccaacgtgcaatcacaggtagggacccagccaatatgtcgccaggtgaatgccttagagtccaagagccctcagttgtattggacttcctgcttctgtccagagagagagagaaaaacagatcagaaccaaaaccttaccaacgaccgaaccaaaatcaagacaaccattgtcatggggaatctcgtccacactttgtgaatgcatttggctctggcttttcagttgtacttggaaggcaggagaagaacagtaagcacagggcaaggtgaccgagacacatcaggcaggtggaaccagcatattctttattcaccaaagggaaaaggaggaggtgttcaggatgttacctcaatttccaggtctccctctcatgtgttggtttctcctgctcaatatttaccatataaagaggcaattaacaagcaagcaaatatattactatcggacgttttcattttaagctttaaaaacacccagccaggttgactaaatacatttcttagtcatccttgaggtcaagggacttgagtttctggtgatgagtagaagtccacattgggaagcaaaatcaagccatgtgatatcaaattttagtgttccatagtaagcagatttccttcatgatacttgaagaagccatcctactacctcagcatgaaacatgttgtgagagggtaaagtagtatgctgtgggtcagaattactagggaagttctgagccatgtcagcctagtttcccaccctccatgtggaacaagaagcattacaagcccggaacagaccaactggtcagcgattcacccctttcttgagaaacattgcctggaaaccagtttgaagtgatatggtcaggctttggtcaagtgactaaacaactggccatcacttaagtcctcaaaaaatacaaggtctcaatcaagtactgctctctctgtgagatggctgcccaaacctcctctaaacagaacctttgtttttataggatacccagcaaaggaacagctgtataggatgacctgtagggaagaaaaatggggagaaaagaaaattccttcatgctttcccctccagctccctctatcatcctaatccttaccatctcatgcagacttgttgaactagtttcaatgtggagatcccagttttcttttaccattttacgtcttgcttactgaactcagaattctttatggattggcatacggaggaagctagcctcctcctaatggactctcccaggacaactgtctccaaaatgattgcattaatatggcatgcccaaatggtggcctgcctgatgatgatctgcctcccttttcctacacctctctgactaattttctctctgttattgttcatctgtttaggtggatacccttcgccatgttatcagccagacaggaggatacagtgatggactcgcagccagtcagatgtacagtccgcagggcatcagtgtaagaaaacaagcccccccaccccctgctttgtttttattctttcactaccaattatttcaaagccatagggcccagaatgccacttagtagggcttatcttagctttacggtcacctagtttcttgtttctgtatcggtcatgccatcggcagcattctacccacaaaaaaagtggcgattgggcaggcttcatgcaggcagctggcgtctagggctgtcagacgcaatcagtgtttgcatggcacctgcggccacatgcgttcagctagaggagctgctaaacaggtgacacctagtacaacagtggtaggaaatgtgaccacaagctggggcctgggaacctgggaggtgaaaccagtagccaaaatccattgcatccacgtctgtggtctgaaaaaaaaaatactttttttcaatctgtctatggacgattaaaaagaaaattaacacagaagctgggtatgtagaagggatggggagggatgcagaccatcttctacttgttcttgggtacgctggcggctcctgactagcatgaaaattcatagcgacaagctatgtcgcacagagtgaaatcgatcagacagacacaaggagaaccgagtgtagatttgggacagcaatccaacttgatttctcagatcaatcgtctgctttctcagcagcggtgacagcaagctgggacaagagggcagcctggaaaaggaggctgttttttagatcagggatgattcctgggcttttagaggtcacaggaggcttgagtagaactattggctcttaactattgaagaaaggtttgggtggtgggtagtgatcattttttattgtttgtttctgttgctatgattaaagtgaatgagggatcgaaggaagaagagttaggcatgatttattaatgtaatctatactaatggagatataatgtctgcagtgaaggaggtgatgacctcttcaactgcgttggtcaagtcatacatgattctgtctggtttgggaggattaagagaatatcagttatttctcagatcagatgaggaatgattgaacacattaggaattcttacctcataaaagagaaaatttgggggttacatagtagtgtaaggcatgctaacactattagattcatcatgaatgatctaaaggggttaggataggataggactactaagtagtggattcagagaaacaggtttcacttcaacatctgatggacctttctcacagtaagagtcctccaaagaaggggttggctgcccttaagtgttccccatcattggaaaattcaaacatggcttggctagctgcttggtaaggatgttgcagaaggaagtcaggcagcagattttgattgtcttgatgacttttaaggccacttacattagggagtctttattttctacctttttcaggcagaatctcctcttgagtttacacaatatttatcaagtcttctctggaatggaaggagagaagtcaaagttaaccctgttaaacatattctagacaatcattttactttcttggaaggatttttaggacagagagattcttcccatcttgtgcttgttctaactacattaactattagtactgcattgatggctgacttactgggaagactgcttggaaaaatacaagaagccattgtgggaaagtgtattctccaaaagaattccaaatgaatgaagttgtttggattttgtctgagtgcaggtttatacacacatgcatttatgtatttcctgaatctttttgggatataagtttttccagagaaagctttgctctgtgcataagcagaagagaagaacatgaggaaagcacaagagtgtagggacaagaacctggccatactcaaaaggaactgaaggaagtccacatgactgggcaggaaatggggctgacactgctgttatttggcgtctttctttcctaattgggcagcatagaagagagagagcagcagtcagactctggggggtgggggggggggtcaacactgacccctctgacatcatctggtgggctgggaataatttctgaaatagtgtaaccaaacatgtgcagacaattatgtctgatgacataagcccaccacaaaaactgggcctgaaaatgccacttgaaagagtctctcactttgcattaatttttttttccatgaactgtggttattttatttctgggtctttaatatgcagggtaaatgaatcaaaggctgatcgtgatatgttcttttgatatcagttttaaattgtgccacctgcaggaggctaagcttgttatagtgagatgtatttttagatggtggtattcgatgctaagacatgtgtgtatagagcaggacaatgactgccagcaggagagagagaggaggggagacaagaagagacaaggacaggaatgaaagctttgagccaagaaatgaaaataaacagttcctaaccccaaagctgcagtggaattcccagctgggctctggattgtgtttgattcggtggaggacattttctgggcagcgtttatctgctcccctggctgggctttcacagcacccatatcttatccaagcagcatctattttaagccctgtaaagttcagaccatttgcctttaactgaccacacagcagtagaattgcaaggtgcggtggtaggagtattataaagggagttgggagctgctagtcctagtaactcatgtgcccgtgggcaaatattgaatctctcttctagaaaatggggacagtaattcccaccctttatacttacttcaaggactggcttagggcaaatgagaaaataagtcggaaagggattggcaaagcataaattattccacatgaatgcagtatgaaattttgtaagtgataactttctgatttgaccttttttctcctctgatgtgagcagttttctcagtaggtagttcctagtgaggataggttaggacacatttgtcacttttttttctcttctgatggaaaggtgtgcttttgagatggatatagtgttatgcaaggcctaaagacccccttccttagccatggtgagagttaaattatacctccttaagtactttgtgttctcatgtgacaatgggcaatacttactaagcttagagtggctctaagtaatggagggagattactccacttctctgtcaatcagacatacttaaagatcacttagctatcacattctttcctatccattctcactgccaccatcctagttctagaaatagttcattaactagactattgccataacttcctaatcactgttgctgtctttaattcctcctctctcccacacaccctctgaattttgtcattcgttgctcagaaatctattgcctacccaagcaagctcaaaccctgagtacgacattcagggtctcttacatctgggcccagccttcctgtccttctacctcatcctcctgtcatcaaaataaactctggatgccattcagtatggccagctcatctttacctcattacccatttttccccttacatttactcatgtatgccatctacacaaatgtcctttcattcccacatcacctctccatcccaccccactatccaaatcacactgagtctcaagcccagctcctccttcgtgtctttcttcttcttagtccttctccccctcttctctctactttatcacagacacacattttctttgcactgtacatacatgcgcagaaattacctctgtgtctttcacttctgcccatgtgtatggtcctaaaaatgcatgttctagttgctcaaaacatgttcgttgaatgaataaatcagggaggggaagaaaagatgctactaaattaaaaattcattttaatgaccaatagccacatctagtgtaccagctataaagtatctgatgagaattactactttaaatgcttatccacaattatactgtctttaagatccaaaaatatccttaagtctttctttttggaaaaagtttttcaaactttccggctgatgtatattctctgagaataagattcaaatcagcagtaagtgtgtgaatttatatggtgatgatattgcagacataattatcctcagcagtaggatcattcttattatgaattttgtaaaatttctttcactcctcctatccttaaagagtccctgtgtttctatactaaaagaatccctgtttaaaaaaagtatatatacctgtttgtaggatagccatgcatgtagcaacatagtattgtttgtgggatagctgtgcatgtagcaacataacattgttgtaactggattctcattgttgtaattgccctccctactagatgtggtattggaacctccaaggacaacctggaggaaggtggaagcaacttgaaattgggaaacttaggtccttcttgtgacttttcttttaaggagtcacttcacctctgtgttgttgcttcatctgtaaagtttattagataagcaaactgaaagctctctttcagctcaacagctctagaattctacatttatgatctttgattcattgttagctcaagggacaccagactaaattgtagatcatccctccagaaaactctttcattagagttagtaacttctattctttctagccaaccccagtgttcaaattatatcttgaaacccaaatgggaaggaagaagtgctctcgttacacaaacttttccctttgaattccttggatatttgtgatagcagaaagcattattctttagggtaaaccttttttgtttgtttgtttgttttctttttttttgaggcagagtctcgctctgtcacccaggctggagtgcagtggtgtgatctcagctcactgcaacctctgcctcctgggttcaagcgattcttgtgcctcagcctcctaagtagccgggattacaggtttgcaccaccatgcccagctaatttttgtgttttcagtagagatggggtttcaccatgttggccaggctggtctcaaactcctgacctcaagtgatcctcctgcctcagcctcacaaagtactgggattataggtgtgagccactgcacctggccactatatttaattgttttaaaatgtgggttatgggaatgaatttactccagccagtctttgatgtaaatagatacccctgtggatttttcttattcaaaaggtttggtgaaaatggaaataagtgtcagcattatctctacaaaggtaacatgccgttaacatcaatttatgacacaaaaaaaactcattaatcttgctttgtaatcattatagtaatagaaaaatagagatgaagcttttatcattgtaaaactgtaacataggtgtttttgttttttcttttctcccatgttaggtaagggggaaaaaggaacatttaccaagtaaataaatagtatataaatcattaggacaaaaatagcctcctatttaaatgaacatatttcagacatttggataccacggggatacttagtaatacttggccacatgccataattttaattttttcttaactatttctgagagacctccttccacttaaagtatatattagtaagatgttgccacatgtggaattgtaaggctgggaactgagggtaataattaaaattcatatgcatatctttgaaaactcatgttaattatacacagttttaattcttctattttaccagctgaatttgaatttcaaagggatgaaaacatacccagatgtgccccccagttggttgtctttgggtaccttctggtgctatgaccaggaactagtgaacagccccaaaactgaggggtaaaggtaccaaggaaaatcgaggggtctgaatgtggcagaccagactgtatagtgtttgaaggcagcagagatagagtagatagatggaagctaacagcctcactttccttcatgacaaaactattgggaaacagagtaagtaagtgcctttccttcttatagggcctttaaacctagcaccataacaaacctgagaccagaaaagcattttatttcagcccacgatgattgaagaagcaaaaaatatcccagtaatgtgatttcatatgcaatccaatgtttttccccagctcccaagtgaaagcccttaaaagtacaaatgaggtcagatcattcaatggcttattcatgcattcatttattcatttgcttattcattcattcactcattcattcaataaacataagcattttttaccttgaggaatgaagctacatcatggtacatccaggtcaaattggagaaactctgatgtcagtcagggtacattttcccttttagtctcattcagcactttgtctgggattgaatttcctgttcctagaagactagaccaagggaactgaccaactctatagcctaggagggaatttgaaattaaattatatgacagaaggggggaatttaggaccaaccagcaacagtttgagaaaagtaccaaccccaaccaaatagatataccatggacttaataatataataaaaagcattattttgtagaaactgcttctctctttgtagaactagttgcaatgagttatgatcttaaacctagtgatatgatcacactaaacagtatcacatttaggctgtgtgtgtttgtgtatgcgtgtgtgtgtgtgtgtgtacatgtacattccacttttgcctgtgtgactatgaacaagtcagtttctcatgataggactcagttttctgaattccaaagaggacagttgagctggattttgtttagggcatcttccaatgccagttccatttataaacaattattgtttttccattcccaagaaaatgcaagattgtgttttggggaagattctcaactgtgagatgacagcgtatgctatgttcctttcattgcaattggtgttttatagcatcctgcccagcctggcccgcatttggccccgtagccatgctgtcctcaggctaggatctggttagttgttccagactcaagttggtccctccttctgctctgtggagaaaaatcacaacctcaaagggataggtttttttttttatggttgctcctgaaagtggcatggtccctctagatgtcagcaaatattaaggcaattaaataaggcaaattaattatgggaaacattagcattgatttctgaagacagtcttcttcttgctgagtctagcctcaccccttcttgccttttaggaagagttccatgttcttagacaagcttgttttcggataaaatattagacttttttcttagaaaatccctttgttttaaaattggtaatttttaaaaatcccaatctctggctacatttgagtttgaggaaattctttttcacatctctaaatatgtttcaatttgatagtattagtaaataagtaaataaaaatgccttattccacaaatgtttattgagatccttctaatttccagtaccaggaatacacacatcaataggacatggttcttatacttcataaagtcatagaaagcaaaaagaactggcagttatctggttcagttatctgattctctgaaagagaagaaatataccagccagtatagtcaatattattttcaaaaatttggtgaatggccattgtaaggtgcatttacacacatataatcatactcctatcaactataaatatatgaattgcttataagcatgattgacatttgttattcttacatagattttgtgagtgactagcaaaagctgttctttgcttctagaaccatgctgtcccaatataactttttgcattgatggaaatgttctattttagcactgtccaataagttagcctttagcaaaacatagctattgagcacttgaaatatggctagctcgttatcctcagcaaactaacacagcaacagaaaaccaaacaccgcatgttctcacttataggtaggaactaaacaaagaaaacacatgggcacatgggggaacaacacacactggggcctgttgaggggaagaggggagggagagcatcaggaagaatacctaataaatgctgggcttaatacctaggtgatgggtggagcaaaccaccatggcacacatttgcctatgtagcaaacctgcacttcctgcacatgtaccccagaactttaaataaaagttggaaattaaaaaaaaaaaaagtattgggcatgaggtccaaaagagaattggtatcaactaagtaccgttaacatacaagatatgacaatgaagaattaatactgattagctgctagatacgaagatgcttacatataaacaagcacgtttttcaaaataaacatcttgaaactaaaaaaaaagaaatatggctagtttgaaaaagaaaataaatgtttaattttatttaatttaaggtaatttaaattttcagtagccacttttggccagtggctaccatgttggctagtgaagttctagatgctctgccggttatttggtaactgtaacttggtaaagtaagttaaaagaataaatgtgatggtgtgcaagagtaatataaaactagaaaatataatttaaaaatttagaatagctaggaactatgaaaagtaggaagaaataatttactaatcaactacaaagcattagcagaataaaattggcaggagagtgataaaatcacatgtaaattgcaaaatgaaggttaaaatgaagccaccaaagtggggtgacggtgttagaggtgtcaccatgctgtgaaaacagagtagacttcttaacacaaaacatagaaaagcatgctttctgcttaaatcagcctttccaaaaataaatagagctctttattaaaaattaactatatacaagaagtgaactctggttatcataataatatgcttcaaactattaaataatatggaggaagatttaaaatataaatatagaaatacctacatttgttatggtttttttgaaataatttttcactgtgtcagccactaattcatccaacctaataattcttcaagcccaagcaggacatgtctttgaactcatcttgaactctttctttaagtctaaaccctgtagggcttacataagatagagtctttgtttcaagtctcccaggtgacctaagcctttgctggcagcctctgcctcgccgtttcttcctccctgccctgctagtctattccaagtgtagtctgcagatcaacaacattacctgggagcttgtgagccatgcagaatctcaggccccgcccagacctattaaatcagatgctacaatttaacgagatcccctggcaattgttaagcacattaagtttgagaagctctgctctagtgtgtaaagtctacatgctctctagggcttactgaagagaaggaattacatagctttatttgcattaaggataccttttaaaatgttttcaacattttatttaaaaaattttcaaacatatggaaaactggaaagaattttacagtgaaatcactattctcaccacctagattctgtcattaatatttaactctactggcttcgtcatattgtcacccttttatccttctgtgcatccatcaatccatcttgatttcttttcattcatttcaaagtaaattgcagacaacagtacattttctcctaagtaaatatcctggtacatgtatcattaactagagttcaatatttatttgcaggatttttctcttctggaacaaaattgtacacaactaaatgtgcaaatcataagtatccattctcttgaaggttttttttttgtttattttgttttttgagatggagtctcgctctgtcacccaggttggagtgcagtggcgcgatcttggctcactgcaagctccgcctcctaggttcatgccattcttctgcctcagcctcccaagtaggtgggactacaggcgcccgccaccatgcccagctaattttttgtattttttagtagagacggggtttcagcgtgttagccaggatggtctcgatctcctgacctcgtgattcgcccacctcagcctcccaaagtgctgagtctcttaagttttaacaaatgtaatacacttgtatataaatttcctaccctttgttttcttgtgtctacctcatttgtatagtttacaaaacaaaataagaaggaaatggaaggacagggcacatagttgtccacagaatagtctgttcttttcccagcagccaggggctccctcccttgcacctcctatcctcagtccctcattctatcttatagccaagcattgctagaaaggccaatttaaatcaaatgagatggtttagttttattctacacttgtctcatgttctgatatggtgagcctgcttttaaaggcttgtattcaacttatattcacatttcaatgagaaaagtttttgagatatataaaaatagaaactttctaatagatatcagaaagttgaattatagtgtgattacctcactattacatttttcctcttttgccttttgccgtttctcccctttcttctttccctttatccagatagacccttgacctctagtccttaggccaagtgaagggaattgacaagaaccttatagtgaaagaatttatgttgcctggtgataagcattttggagaccgaatgatatggaaaagaactcttaagaactcaattatgactgttctgttgtgtatcctctcagggtggcatatggaaggcttacgactagttcatttctttattaaaattaaatttggaaaatatttagacagctctttcctggatctaggctaccctacacctttattgtgtcatatttggttaacctgcctagatagtgacccagtgatcatacatgagagcaggattttagatcaagtgttacttcgctgagaaatgtgtggtactcattataacagaaggcaagactgttctagaatctaggtgtgaagtatcagcagaggtggatttttaaagtaagttaaaagaataaatatgatagcttgcaagggtaatataatataaatagaactagaaaattaaatagaaaatataatttaaaaaattagaatagcaaggaactaagaaaaagaaaagtaggaagaaagaatttagtaatcaactacaaagcactggaagaataaaattggcaggagagtgataaaattgcatgtaaattgcaaaatgaaggttaaaagcaattaagatacacgggtactgaagagaataataaaaacataaaataagctaggatgagtagttaaaataaataacaccagctaagaagatacttacaaagattaaaaaacagatcaagtagtaataaaataaggaagtggtttaaggcagtaaattaaagaacaattaaaaaacaataaggagagaaaattaacaggccaaaatgacacttaataactgtattaatagctaacatttattgacttctttctatgtggtagacactttatgtacattaacttctttaattcaagtgtattaaaataattaggaatttatttttggggtaagcaaaaaaaagttcagagaagggaaagccaggcatcagggcaataaccctcccctcgctaaaaaaacaaaaacaaaaaaaaacaaaacctgaaggtaagcaaaatagatctgcagatatcaattttcattccttgtctaatgtggtgatttttgcggttgaaaaacacccagtacctgccctggtacttttcttcagatcacaggttcccgaagtggctagcgttataaaatgagcattctctttttctctcgtcatagataagattgacctttgttaggggcaaagacgttttcaatcagtagaatccatagcccagaacctatggcagtgggcaaacatctcataagcccactcatcttacgtgacctagctcaggcctatcttctggaagtacttcctagttccttcagactgtgcctatgtactacttagtacactggagttggagtggaatttcgtttctgacacttatctttcattcctctctagaccatagaattctgaagagaaggatcatagttttatatcctgttcctcaactcaggcctggtatacagtaggtgctcaatgaatgcttttcaaagtgagcctagttgaacctgttgtcagtgggttttgtgtgtatgtttttttaaccagcaaccggtctattctgactggattttctgcctgccttgaacccccacaaacatgtatttttgtgtttctattatccagagaatttcttccacaagaaaatggctttttgtacttttttttttttttctgtttaccacagactggtacccatcttttacctccaacttatttatattgcataccctataatttttatgccagaaatattttatgggtgtatatataccctggatatgggtatatatatgtatatgtgtgtgtgtgtgtgtgtgtgtgtgtgtgtgtgtgtgtgtgtgtgtgtgtgtgtattcagagctcagatatctgtgactgttttttctcttttccatacttttctttggggcagctgttatctctgtggccttgagcttgatccataattcattcattcactcattcactcatttgtttagtagatgttttcttgagacttattattactcagaatagtgttgggcattaaggcaaagaaaatgaaaaggagacctaatgcctgttcttgagcagctctctgtcttgatcttgttgtttagcctgtttccattggccctatttttctttctttttttttttttttgagacagagtctcactctgtcacccaggctggagtgcagtagcacagtcttggctcactgcaacctccacttcctgggttcaagcaattctcatgcctcagcctcccaagtagctgggattacaggcatgccccaccacgcctggctaatttttgtattttttagtagagacggagtttcaccatgttggacaggctggtctcaaactctggacctcaggtgatccacccacttcagtctcccaaagtggtgggattacaggcgtgagccactatacccggccagccctatttttcatggaaaggaaaaaacaactattaacactcttcacaggttattgttgtattttgaaaagagttatgaaatcccttgctaactttctcttctctggggaaaagagtctgagttccctcagcctttcttcctaagacctgtggttggctataaattgcattggttgctcttctctaatgacctctggagattggcaacaccaaacaaagacatgagttagatatggactcttcttcagacactttgtttaaattttaaatttttttctgattgcaaattagtatttaatgtagaaaatttggagaattcaggaaaaccacaaagaagaaaatttactgttaactttgtgctcatagccttctagcactttatgtataagtgtgttttttatgtgggtgtaagaaagttacatttccttttacctacctatattactaaaaatgtgttatgaatattttccatatcattaaacattcttctcaagcataactttaaataactgcataggaaactgttatagggaaagtccacaatgtgtttaatcaatttatactatagaacatttaagctacttttgattttggttttttttttttttttttactattattaataacacggtggtaagctttatagtacagaacatttaatgcacattttctgttatttccttggataaatttctaaaaatggaattgctagatcaaagggtatgcataagtttacagtctttgtgatgtattgtaaacttttcttctaggaacttctattaatttatggttctcactaacagtttctggtagtttccatttcctcacaccctcaactgtttttcagtctttgtcaattatcaaatcattaaatggcatctcgtttttattttaacttgtatcccttgggttgctagtgcgattgaacattttttatatgtttattggccttttgtacatattctggaaatgttcatctcttttcttattgatttctaagaactcttataatacaataaggatattaatcctcctgcacttggccagcatttagtaaatagaggaaattctatttctgagtggaggaggactcctgtggaataaggccccaagtctcatcctatttctgtgtaaagttcttcagagtgaaagctggattgttgccctaggaaaactaaaggcagatctgtaagtgataccagtattgatcttaaaataaataaattaattaaccctacaatctgaactagcttgacattttctatttttctgatctatgaaaaatctcaggttgtaaaatagtgcccaagaattttctaaaagaacctagagatatgttagtggaaagtttagggggagatctgccctaggcctagtatgaccctaagccaaataaataaatccttggcttgtttatatagccaggttgaagagataatagttacatctattaaaaaagctttcttatgacctttgctacacttaggtcaagaaaatggtattttgagtgactagatgttttattttggatgctcgatcagtctccttgtttcttttactatctgtaagataacacattcttctcagttgttgaactttgacatctcaccatcatatgctctgcccatcttattccgtagcagcacacataaagaaaggccaaagcagactcctgaacccacagtacagctggaaggtttctactgcagagattctgggactctttaaaaagaaaaaaattaaaatttcaaaaaatcaaacccccttacacttggatgagaattccagaataaaagagggtgtcccccagcatcccctgaatatttctagggtggtgtcaagtgaattcaaaattcttgagcacatagattgttttcaagctcttgttttcatttcatcagtaaatagaattttaaaaacaacaatatcctcccatcagtaaatttggcacaatggatactagcactccgttctcgtacattcttgtcaacattttctttctgcatcccccacccccaagcctgggcctgcttcccactatatctcccacaacccttctgttagctgtaatgaccctgcaaacactaaatggcatttgagtgcattaagcagcaaactctctggtgacatagcaattatggctctgaaatagatttggtgcgtcacggaagataagggttttgaaagtttctattgtgattatagcctgtaactcccacaaataataggcttcaaaataagaggctgccaacggagcctttgtggctttgtctcagtgatggcacgtaaattgctattaatgtcctaagtgtacttgaatatgccagtctttgggatgtggagttggctcagtgtctctctttacacggcatgtcattgttggtctgataatctggggtaattgctgtctcttggatggtcagaaaagtgtaaggggtttagcttcctgtgtgatggtaaatagcctcaaaatttaccccacgagggcaggttcacacatactggctgtgtgtgtatttcatgtgtagccaccgttcaccgttaagatgtgtatacaatctctgtgtgtacccttagtaaataatagccttgtcaacaaagccaaagcaaaatcaaaggttataaaaatgaaatgacgaattcagggctgtataggttcagccaatcagataatttatattgagagtttaaaaaagaaaaagaatacccttacttgaattatctaggtttagctttatgaggaagctttatgcttcctcttttctagtgtagctactcttttctagtgtaagtagcatctgtgtgtctgtctatattctttaggtagtatgagtacattcgaaatgtatatcagctctacgtgaatataataaatgtggaaattatgcatgttgtcgaatgctgtttgttgatgtttagaagtgtgtttttattttggtttgtgcagctgtgcaggcagaggttatttattcagatataagtagaattctctgcactaaggcacctttgtttagctaaaatcaagctgagcttatttttctttgccaggagatcaggatagcctttggaaaaagtaagaaaatcaaacttgaagctttagcctcttgtatgtccatttagcctaaggaccttaagtctgtaagacatgaacacgttatgtgtaactgtcctatttgtacttttaacagaaatggaaaagcaactcaacccaaaacctggaaatgcacaccatctcctatactatgtgagttatggagaggctcagctaaaaccaccccgtgtctcagatcccttatatggcattattaatcctggatcttcgcaacagattcattagaaaagaataaagctaagaaggagccagagtagatcttgatctcagagttgatgtattatacaagcgcactttaataatgtggcattaggatgttggcaggagggcacactatgatggtgctacagttgatggaatcttccagttggtgactgagcaccccttagcagttagggtgcatgcaagataaaattcaaggtagtaacttctaacaagagagtttgttttcataccgtgtgaacatggatcagatataccatcttactcttaggtcttagaccagaactctgccttgccagtgtaagttaagccatattcactggcaaggtggtgccgcccatggtcaagcctcagaagcatagccctgcaggagcagagcttgtcttgttcaaaaccaagtttgatgaggtggattgttgcttagtagcaggagatattagaatcctcggacttttctgaggccagtcttgtgattcatatgttctagcatcttaataaacaacatagggattcccaaaggtgaactgaagagcacaagtcacctgcctttagctgtgagcatccaaagtagctgtgctctgcatgtggagcgcacacattgtcccacagccccgtcttttgaaaattgaaatgtccaaaaagcagtagcaggcagtgggtactaagtctggcaaatcctgggttctgagatctagttttctctcctgagaagcaggagtaagagttcacactagatttgtgtaccactgtgtatttgtgatccagagcaagagatggacctataactgtgcagttatgctgggcacctgcagccaagccatccagtattcacaggaacgagacaccaagggaaggcttcaaagccatcatttctccttccattcaatcaagtgcttaattgagcagctgctgtgtcaaacatgagcctagtcctgtaatggcttgttgttgaatgatttaccatctcattgaggataaatatcaaagcgcttcatgtagcctgcaagtctgggcatggctaagtcctctcctctccggtcctgtcttgcttcacttaccactgttctcccctgttccattctttctggccttctttgagtcccttggagactctggaaaggcttccctttgccccactcttggcttgtctgttttctgttcaccttcaggctgattttccgtaagcccaagtgaggtccctcttttgtactgtctcctagcacttattgccatctagaatctgtatacattattttgataatatagcaaatgtcaatttcctgcaaaacagtaaactccttgagagcagaaacaagatttttttaacttattttatcaaccactgtatgcccagtatgtagcacaagtgggcactgaatacgtatttacgtaattaaaaactaagtgattacagccaaaaacatatggtgctcacttggagattttaaatgataaataaaagttgcacgtagttttaaatgtcaaaatgaaggatcagtaagtcagtggtattagaggctagagacatgggtgatgtgtgccttgaagaaacctacaataagaaagtgactctcaagctgggccttgaaagatgacacggatttgtagagaccagaggagatagacaggcaaaggcaaaaaaatcctctcacttgacttctcagtacagtaaaggaaggattctcactttgacaatgaaaaattattatttctttgcagcagcgtaaactacaaaagtctttgcagcaaggatttctattctccaccaggaatggctgactgcattgcactgctaatctttctgaacatagagacctataaacaagatctcaggattcaagaggcttgatgggagccagactagagaggagtgtggtggtgtggcattgatatgaagccaccaggggctgacctagtggtaggtggcaattagagaggataccctggcagtcaaaggactatggaaacaggaatcctagagccagcagcatgagttaatccaagcagaggattggcttctgggaagtacgatggcaggtagtagttggtgagctgaggttccagagcagtattccaataacaagagcaagtcactttctcggtctttaaggaactgtaataaatagcagaaaattaagcaaagctaggcataagcttggtagagatggtctcaaccacaagaaagaagttcctatatgaagacactgatgcaaaatgtccaagtaagacaagtggcaaaattgattctgagttacctatggtaccaaactaggccagaagaaaatttcttctgtctgagagcacatgttattcccatatagggttgccagatttagcaaatggaaatactacatgggatatacttataaaattacagtgtaacagggcatcccatattttatctggcaatgtcattcctagatcctaagagggaagctgaatctgtatatgggtctcacaccagagagagaaaagataggggctcaaggacacaacaggccattaggagactatgtctgttttgcatttttgcaattcccactgtgctcagggtggtaactgggatacagatgcaggatgggttgtcttctccttgtgcctttctggagaacactccttgttaagatggtgtgctaagctgtggcactgcaactgtcaggttccagtgtccttctcaattgctttccctaaacgcaaaacaaaacagtataaatattaattatcattgcttgtttgggataagctatgaagcaccaaatctccctgatgccagtttagtaagagaaacgttcactgcctgaagattaaagttacccagaaacttggcagtgcttctgctctgtcttttgagtattttctaggtgtacacagctatttacatatagttggaatgaattatggaggtcagggatctcatgccatatgtctctccatgcccatgttgggggatggatgtcacagtgccaccaagtgtttctttacttcatcctatgcctctccaagaaacatttatcaaaatcggcgatgtgtcgggcactgtggtgggcactttggaataaaagataaattccacacccttgcttttatggtcgggtaggtgaaaccgacgtgtgaaggaacacacgcaatacagcagcacatgtgctgtgacagaggcacatacatagaactgggggcctgcaggaggaagaaacaaaaagcatggccaggggacagatggatgtgcaaagatattcaaattcagtcttacaaagcagccaaggtgtgagtgagatgtaattggaggagtgagggcacggcattcaaggggaaagaagcaggcatgagacggctgctctgtcctgggaaattcatgggaatgtaaataattgtgttgataggggaagtaagcaagatcaaggctgcggcagagctgctgaggacattgaacctcatcttgaggccaatgggtagccattgaagatttcaacagggagatgacatgcacagaatgacacttttgaaagatagctctggtggcagctagagataggactggaggaatacccagaccgggcctggatctcttttccactgtaaaattccccaggaaattttgaatcttttgacgtccctaagggggctttccaatagcatcttttcaaagtgctgtctgtgtaatcttgggaaagtgttaagcatatcaggaagacatatttcttctagcttgatagaagagtgatgaatctaggatgtgacctctgctgtgtgagctgatgtctccctgatatatagtggctctgtgtgtgtttgcatagagagggaaagaggatgcatccgtgtctctgtttttcttcccggccgttcccaacagtgactgggtgattgaggggctggagcacgtgcagctcctcacccacgctgaaggcatctctagtaatggcatctggcccatatgcagatctagctccactctgtgctgacatcagccggtttgtggcacctcagcgtatttctgggttgcaaatgagagtttcttagtgccaggcttgcttgggctgtcacatcaggtgatgaattctctgcatcaaccgtgtgctgctaaggtaatcgcagaggaagagtgggaaaaagaggagatggggcaggtgcttctcagccctgcagccgctgctcagggctaaaagcagcactggatccacaacagggagggagaagcaactatctgtggtccccgttctggttcaaggagggtggtagagaaaaggcagggttttggttgcaattctgtgtcacgtgtcctgtcaggagaaaccacgtgggttttcccatctgccattgccccatccttggctcaagagctagctccctctacctcctcagacaggcatgttttgcattaccttttaggtgaagttctagcaaaatttggtgtatatcaaattatatgccaaattctttaggatagaccatagagtaaatagtcatttttattcccgaaacactttgtttccaaatatctttgtgttttggaaatccagattttcttatcttgggaacctgctgtattttatcttagttttatattctatgagcttctctcttggtgagctccaggttgagctgctctgctggcttaggcttcatctggtagaattaaaagttacattgggtcacacgtcccaggtgttgcatcacaggccacagaattacctatataaaactgagtgcaaatgtagacactcttccactaaattgtttttagcaattaaaagtgtacctttggttttgcagattttacctcccaccctgtgacccctcagtgtggtttatgacattagcatttccaagagtgtgttcattataaagaattgtttgcatcagaaagtagagagggaagctgaggtgcagaaaaaaaataaaaataaaagtcttattttccaccccgcccccacccaccgcacagttgttaatgaaagcatcctctcctctcactctgcccagagataaataaacacacaaaggcggagtttcctacttaatattcacccacagtcgaggtagagggaaggaattgctccccagggttaacgtggcagtaagcgaggtcagctgtttcccaagacggtgcagcctctgaacgtcttccatcacagctagaatgatacagctgaagcagccgaagtgatttacaggaaacccagttaacttgagtttgcttgcagtttctatcttatgatggttttagcagtaacagcagcaaataatataccgtcctataaagcacctctagagaaaagaattcttccacattccccagcatgacatgcttcttctaaaaagtatttgtgtttctctaacttaaaccctataggctacaatgtcctaaatttggtgagaagtgggaggtcatagctggcatatcctggaatagggtggccaaaagtctcattttgctcaggctgttggggtctactcggatctgagactttaggtactaacatgggaaagtcctgggcaaactgggatggatggtcaccaaatctgagggggtgtgtgtgtgtgtatctgtgtgcatatttatggttggagggggagtggaaaaaaggggagtgaaagaggttttgtttaatgtatttcttttagctagaaggttttatatattcttcactaggccaactagaataatataatgctggttttgagattagcttgaaataattcctatttctcccatctgtgggttctctataccccctaacatcttacacactggtctgagaaaacagaactttttaaagaaaagagatcaaatttttactatttgagttatttcaggtctgggatgactcaagaagaagtctcccagaaccttctgggcaatatagaatgccttgtcaattccttcttaatgaaacaccacagaactaattttctttactaatggcttcattttttgcaccacttattgttatcttaatggaattatggcatggctaaaatgatagagtggtgatttgtgagcaatgtaatagaactccattgttccatgacctatgacatgtacgctcactgctttcatagagcttccttatctgcttattttataccagggtgattctaagatacatgccttttttctttctttctttctttctttttttttttttttttaccagaattttactctacttcatgacattgtacttaaaaacttaaaaaaaaagttttcttaaatttctgtactgctgagtcatttttattcctgaaacactttgtttccaaatatctttgtgctttggaaatccagattttcttatctcgggaacctgctgcattccccagtgtgacgtgcttcctctaaaaagtaggacccctacctcctgcccctacagatacactcctgcctgcctgcctgtctgtctacctacctatctatctacctgcctatctacctgtctgtctacttatctatctatctaaatatctatctggtaaacattcacatataaaaatgagtaggagaaacagataccaaagcaattatatgtgtcatcaaagctgaataattttccccaagtagtaggattatgggtgcatgctgtatgttttgttttttatgctttctaatttcccaaatattagcgataagtatatcttatttttattttaaaaaatgacattaaaggatcttctttgggaaaaataaacgtggccgccattcttagtcagcctaaaatggcaccagaatctatattcctggttgggatgggaggctacaatattatcacccctatggcagactttcattaggaatttgaatgaattctgttcttgattctggttatactacagagtctttgcccccaaaagttggaaaagctttctgttatgaaagaaagaattattttcctccttattgttctccgtctaatctgtttatcacaaacagcagggggaaatgtcctccaacagagaaaaggagtgagaggagtgacttgactgggttaggagatgggagattggaacttgagagcagttatttgctgacccaagattggggagcggtgttcttggcattgctcaggatgccctcttggtatccagatctgcttttcagtgaggtgtgaacaaaacctaccctgttgctgaagtaactggtaggagctgctttgaattaaaagcctggctttcctgggaaaattggagcatcatttgggtgagccaatgataaagaaagccaagtggttgaaaagcgcagagaaaatggagcccgaattcaaagatctcaaggcctgtgttctcagtcgtgaaccgggacacctgcttttctcttgcacctctgctctctgatgaataaaatgggaacggcatactccaggtgccatggagtatgcaagagttgaagtggtgctccctcccaagcagcaacaataatacctgccccatctcccccaaatttttcagagaatgagaggatagtacaatagaaaacattttaccagggatgtctcagacctgatctgttcaacgtgaactacaaaggaacacagtaatcgaaggggggaaaggcattttagcacacttatatttcaatgctttaaaacatataagcaatcatgaattatgcatcatgaattaaccactatagcaaagcattcttcaactattttagtgctgggatttttttgaaaggggtggttactaaacagatttttttagaacagttttaacagttttattgttgggatgctcctggatctagagtcttgtaaaatgatctccaaatattgatcaagcctataccttcccgtctcaccacctctctggatatattcacacagactagtccttatggccttggcaccattgttgtatctgttatagtcacctgaattagcctctgtacttttcaaaactcacctcaaagagtgctccctctatgaagtatttcctgatgttgcaacaaaatgtgatattgttttcatttgaaacttcatagcaatgggactctaccatttattaggttctgccttgatttataagttcattcgtgggcttatctccctccttgaacacatgaactacatctcactcatcattatatacccatgagcatctagtatagaaccttgtgcagaacaaatacctggaatcccataaatacatgggacatccagagtcagaaagaaccctagaaagcatttgagccaaccttcttatttttcaaaaaagaagactaaggtcaaataggtgaaggtgctttaccatcgacattagctagttgttgccagagccagaaccaaaacttgagtcccttgacctgcaggacagctgtcatttcactgctggctgggacttaattacagagtctttgggaagtataaacacatcatactagtgggaggtattaacatcatatccagaggctcactgggaggacccaaacttatttgagggtgggggcaatattatcacccacagtaatagttgcccatttgatgagtgtctccatgtgccaggcactatgctaggtcctttacacaagatgcctcattgtcattgtctgctgaaaacagccacccaatctcagaggactgacttctctccctttttcccttctaggctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataa

SEQ ID NO: 13599 - DNA, 17605 bp, Human
tatcatcccattttacagtggagggaaccgaggttcagtgagaggcagggacttgcccacgctcccagtctcatcccatactccccttctctctgttccagccccatatcctactccccttccctctgtcccagccccaacccatactccccttctctttgtcccagccccagggggcttcagttctttgaatttgaaactcacttctcccttgctgtttcctctgcttggaaaatccctgcctgccccagttccttctggccacaacttccatctggccttctctagcctccatctagagcttccccccatcactccttgtctgagacacctatttcctccacagcaatggccacagtctgtcatgatcttctctgtttactcgttctttttttttccttcttttccttcttttttttttttttttttttttgagacggagtttcgctcttgttgcccagactggagggcaatggcgcgatctcggctcaccacaacctctgcctcccaggttcaagcgattctcctgtctcagcctcccgagtagctgggattacaggcatgtgctaccacgcccggctaatcttgtatttttagtagagacggggtttctccacgttggtcaggctggtctcgaactctcaacctcaggtgatccgcccgcctcggcctcccaaagtgctgggattacaggcatgagccaccgtgcccagccgtttactcgttcttgtctcccccaagccagacactccatgagggcaaggactatttctgcctccctcattcctatattcctaggggttggcggttcctgacatttagtggtggatgagaaataaatgaaaacagacacatcgacggtgtctgtagttcatggcccaacttttgtgtcttgcccgccttccctttgcttagccaactcctatgcatccctcagtgcccaactgaaacctcccctcttctctgagccctcagagccccgctgtgcttctcctgctccttcctgggttgtagattcccatgctgtgactctgtctcttccacgacactgtaaccctcgagaggacactgtaatcctccgtggggagctggtttgacagattcaccttgcggggccccgaacccaggaggtgctggagtatttgcgaagtggagcaatgaatggttgcgccgtgagcatgcgcagttgtgttactgccatgattcgggggatgtgtgcatgcctggaacggggtaggggatcctgcatctccctcctgttctcggcagcttccttcccttccccccaggaagccagccagccgcccccgcgacgttacccttctcctggggcctcagagccctgcccatctcgggcagcttggacttgcaaagacccatccggccagcagctcttggggtggtcgcgccccgaccccgcccaggctctgacccctcctggctcggctcaacgtcacaagggtccccgccccggtcattttgcgggaatgacggggtccaccccttcggggtagggggaggaaatgaaccccaaacagacccatggggagccaagcggcggttcgacccgacccgagtaggcctcggttgctatggtgacgcggccttctgggccccccaggtccagagcggcaaggcgcatgcgcaaagtgcctgggagcccgcaagggggattcgtctccctcttcccacccaggatgccccacggtccttgggtgctgacgtcacgagagagggcggtcccccatttgatgaagttaaccgcgttatatacaagagcgccagcgacagaggcccgttagtttatctcagactcggcctaggtttgctgagtctaaaaagggaccgcggtggaccttttgaggtgaccatagccgccgaggagcataagtgactgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtcggaccagatcggaaccactgaccattgcccatggcggccctagtgagtgtggatttggcggggttcgggggttccgacggcgacctcggcgacccctcactcaccgcttcctctttccgcagggccctagcagccagaatgtcactgaatacgtcgttcgagttcctaagtaagtccccagccccatctcccactcctctccaccccccaaaaatgaaaaccttcacgatcttcttagccagccatttctggccctgtctgtggttctccctccagaccgggagagacttggagggcagggctgggattaagctgaggcttctctggggacaacactgcttttttgaacgaatgaatgaatgagtgcattaatacacggtgatccagccccctggcctaaccttcgaggagtatatggtcccatgatgcccaggccagctgtaaggacatattcctcgtcctgtttcaaagtggtcaggctgtctttcctttccaggcctttgtacatcctgttcctctgccatgagtgcctcccctcaacccctaaactgtgactctgctgggtgaattcttgatgattctgcaaaactcaactccagtatcttcctcctccaggaaatactccctgcctgtcctccctcctccccaaggctgagttcacaataatctccacatcttgggttcccccaaatcttcgtccctccatctgctcttcttctgcctggggtcaggagaggatgggtctagcttctctggcagactgggaatccttggagtcttccgtatccagtgttgccaggcaaaacaggctgaatgaagctgggtgggtttgttgagtgaattgaattgaattaatgattcaattgaatggaatgattgaattgaattaatggttcaattgaattgagtgattgaattaaagtaatgatttgattgaattaacgatccagttgggtggttgattgaattaatggttcaatagcattgactgattaaattaatgattgaattgctgtattggattgacactacctcttctcatccactccaggaatacaaccaaaaaatataacatcatggcttttaatgcagccgacaaagtcaactttgctacgtggaatcaggtaagtctctgagtcctgggggtcaggggctggggtggtgagagaacttgaccctgaccttggtggttgtgatagttgcttaactgtcatagtcactaagtcttaattttctcacttttctccaagtgaagaaaagatagatgacaaagggttgggtgcagtagttcacacctgtaatcccagcactttgggaggctgaggcaggaagcttgcttaaggccaggagtttgagaccagcctgggcaatacaatagcaagaccccaactctacaaaaaaattaaaaagttagttggggctgatagcgtgggtctgtagtcctacataggaggctgaggtaggaggatcgcttgagcccaggggttcaaggctgcagtgagctatgattgtacgactgcactccagcctggataacagagcaagaccctgcctcaaaaaaaaaaaaaaaaaaaaaaaaaaaaaaacggaaatggcaaaggcccaggcctagctcctgggtgtccctgtaagttaggtttggtaggcccaccagaggcctctccttaaaggagaacatttagaagctgtgcccactgttggacatttttggccatggtttatctgggcaagggaggggactgggctgggggctttcccagagcccctgccatcagaggctctaaaaaggactttgggagccattaaagcatcttcaattgggaagttgtagtgtgtgtgatctggctgctatggggagacaaactgtgggtttgagggcaaataaacggagaccaaggtagaagcaactggactggtctaggtgagtcctggcagggcactggaggcagtggaggttatgagatgtggctgattctagagtgttttggaaatggtatatatggaccttaaatcaagagcttaagggtaattcggatcacattagccatgtaggtcacgataaattgttaatttgtagagattttggtgccttaatgtcagcaagtgttgcacaatgagtttctttttatttattttattttatttttttgtgatggagtctcttgtcatccaggctggagtgcagtggcgcgacctgggctcactgcaacctccacctcccaggttcaagccattctcctgcctcagcctcccaagtagctgggattacaggcgcccaccaccacgcctagctaatttttgtatttttagtagagacgaagtttcgccatgttggtcaggctggtcttgaactcctgacctcaagtgatccacccgcctcagccttccaccatgcccagcctttttatttttaggaaatagatataggatctcactatgttgcccaggctggtcttttttttttttttttttttttttggggactgagtcttgctttgtcgcccagactggagtgcagcgccaggatctcggctcactgcaagctccgcctcccgggttcacgccattctcctgcctcagcctcccaagtagctgggattataggcgcctgccatcatgcccggcttattttttgtatttttagtagagacggggtttcaccgtgttagccaggatggtctcaatctcctgacctcgtgatccacctgccttggcctcccgaagtgctgggattacaggcgtgagccaccgcgcctggccttttttttcttaagacagagtgtcactctatcacccaggctggagtgcagtggcatgatctcggctcactgcaacctccgcctcccaggttcaagccattctgatgccaggctggtcttaaactcctgagctcaagtgatccttctgccttggcctcccaaagttctgggattacaggtgtgagccacagcacaatgagtttcgatatgcatgcattctggagagatgtgtggaaattctaggtacttagacattttttgaaaagaatcctggaaccagatgcctgctgtagataatagggaagtctaattaattacttctacattcctcagataaggaattttgcctccgatggcctgcttgatggtcaccaggtggtctttttctctttaattttaatttggaaataatttcaagcttttaagttgcaaaaatagagcgcaaggctcgcccaaattccctttacccagatttgtcaaaggctaccgttctcctcccttgttgccaagtggtaagttggttttgagaatctagagcttggcctagggcaaggaagggcgttcctggaggggggcactgcgcaagcaaagccagggaccctgagaggctttgcttcctgctcccctaggctcggctggagcgggacttgagcaacaagaaaatctaccaagaggaggagatgcccgaatcgggcgcgggcagtgagttcaaccgcaagcttcgggaggaggctcggaggaagaagtacggcatcgtcctcaaggagttccggcccgaggaccagccctggctgctccgggtcaacggcaaatcaggcaggaagtaagtggtggggcggtggcggtgccggcttagtgaccagtccacatccccaggcctcaacttacatactttgtggggtaccctctctgaacctcagattcccactgctgcagtggaagtgctggcacttccatccctgtaggattttattatttatttatttatttatttatttatgttatcttattttacttacttgtatttttttgagacagagtcttgctctgtcgcccaggctggagtgcagtagcacgatcttggctcactgcaacccacacctcccaggttcaagttattctcctgcctgagcctcctgagtagctgggattacaggtgcctgccaccaccacgcccagctaatttttgtatttttagtagagacagggtttcaccatattggtcaggctggtctcgaacttggcgatcctcccgcctcggcctcccgtagtgctgggattacaggcgtgagccaccgtgcccagcctacttatttattttgagacagggtctcactccgttgcccaggctggagtgcagtggtgcgatcgtagctcactgcaggctccaactcctgggctcgagatcttcccacctcagcatcctgagtagctgggactataggcacgccccaccatgcctggctaatttttgtatttttggtagagatggggtcttgctgcgttgctcaagctggtcttgaactcctggggtcaagtgatcctcctaccttggtctcccaaagtgctgggattataggtatgagccactgcccaggccctggggttgtgtttttgaagacagttcactgagttggtgcttgtgcctggctctgaggcagctctgagtgccacaatgcaggaagcttaggtggccagccctgggagctcatgacacttgagatgacctctcagagggggcagactgagggcagaacaggaggggtccaggttaggttgatgaagggtgctccaggcacagcagttgggtgatagtgacagacacaggcagctcacacagggcagtgggtgccaggatgtgctgggtccagcggagccttggaaagctgtaggcagggaagaggcactcacccagactgtccggaactttggggtagaaaagaatgaggtagaggcctcaaggaggctgggcagttgtttaggcttgaggaaatggtggcccgggccaggtgtccacttcagatttggccatgccatggctgggcgcggtggctcacgcctgtaatcctagccctttgggaggcagaggcgggcggattacgtggggtcaggggttcgaaactagcctggccaacatggtgaaaccctgtctctactaaaactacaaaaattagctgggtgtggtggcagacacctgtaatcccagctactcgggaggctgaggcatgagaattgcttgaacccgggaggtggaggttgcagtgagctgagatggtgccactgcactccagcctgggtgccagagcgagactccatctcaaaaaaaaaaatttggccatgccttcccgccccatcttctcacttggctcctcagtttcccgggtgtggcccacagatagcagagctggaggcaaatgtagacagtttgactgcagggttgggctctcctgagataatctcacacagtctttccagaaatgatcccgatgtgcacacgcccagcactttgcagggtaggtgcgccggccctgttccccagatgtggaaattgacgaggcccaggtggttgaagggcctgcccaggcctcatgggcatttcttggtcttcctcctatggcaagtgccataaaggaggcaggccccggggggacacgggggggctggggctggtccctatgggccaggccatgaccgtggctccctgcaggttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggtgagtgggctgggtggtggctggggacagaagtgagggaaatggggtgccttgccatggatatatcaccaggccctgtgctgggagctggggactcaggggtaaccagggcagaccccactcggccgtctcagagctgtcagttcaggaggaaacagataggaggccttagggccacaatggggcaccccagagggtgctgccagagccagagtctgtgacccggagctcaaattggcagagcagggtggggtctaactgcccccttggctttccgcaggctgcaggtcacacagcctgatccactgcagggcagcagctccaggcagggcacccgaggagggtttctctagcagtgacatcggcctcagaggtggggcgggtgcagttaagggctgtggagggacacagtgcatgaggccagtgcagagtgactgtgggcagggggacgaggctgggggcccagagcacttggtcttggatgtatggctttggatgagaccgtagggccaccaccaccctagggtgcttgcagatggtggggagggcactctggacgcatctacaaatggcatttgcacaggtcacagatgagcagatgctcaaagagtcgatggctcccaaaggttaaaaaaacacctttttcggctgggtgtggtggctcacgcctgtaatcccagcacattgggaggccaaggcaggcggatcacgaggtcaggagatcgagaccatcctggctaacacggtgaaaccccgtctctactaaaaatacaaaaaattagccgggcatggtggcgggcgcctgtagtcccagtactcgggaggctgaggcaggagaatggcgtgaactgggaggcggagcttgcagtgatcctagatgttgccagtgcactccagcctgggcgacagagcgagactccgtctcaaaacaaaacaaataaaacacctttttccctctttggtgtttttttgtttgtttgtttgtttgtgtgtttttttttgaactgagtttcgctcttgttgcccaggctggactgcagtggcgcaatctcagctcactgcaacctccgactcctaggttcaagcaattctcctgcctcagcctcccaagtagagaaatgggattacaggcatgcaccaccacgcctggctaactttgtattttttgtagagacagggtttcaccatgttggccaggtggtctcaaactcctaacctcaggtgatctgcccccctcagcctccctaagtgtggggattacatccgtgagccaccacgcccggcctgttttagttttgttgttttgtttttttgagaccgaatctcgctctgtcacccaggctggagtgcagtggcgcgatctcagctcactgcaagctccgcctcccgggttcatgccattctctggcctcagcctcctgggtagctgggactacaggcgcctgccaccatgcccggctaatttttttctatttttttggtacagatggggtttcaccgtggtctcgatctcctgacctcgtgatctgcctgcctcggcctcccaaagtgctgggattacaggcgtgagccaccatgcccagcccctgctttagtttttaatcattttctttggttttaaaatttctgaagagtcataggttggctcagctccaaaagcaaccccggtaaatggcacgaagtcagagcgtcctccccaccaggtcatgagcctccgagcctgtggggcagtttctgtacccctgctcccctggaacaacagcccccaggtctgcctgcctgctccactttggttgagttcctggggctccactgtaaaatcagtcgatcaatcattgctgggggggcaggttcgcttttgctgtattttccttagaatctgctttgtaagttttagggagaagaatttggcattttatagaattgtgtaaaacctggatgttaaccaaaggagaaatgccatctctttttttttttttttttttttttttttgagacagtctcactgtcacccaggctggagtgcagtggtaccatctcagctcactggctcattgcaacctcgacctcctgggtttaagcgattctgcctcagccttgcgagtagctgggactacacacgtgcacctccccacctggctaatttttgtacttttagtagagaaggggtttcagcatattgcccaggctggtctccaactcctggcctcaagtgatctgcccgctttggcatcccaatatgctgggattacaggtgtgagccatggtgcccggccagaatgccatctcttgatcagatgttaaatctacttagctaagaactgttcaggctgggcacgtggagagcggatcgcaaggtcaagagttcgagaccagcctggccaagagaccagcctggccaatttggtgaaatgccatctctactaaaaatacagaaattagccaggcatggtggcgggcacctgtaatcccagctactcgggaggctgaggcaggagaattgcttgaacccgggaggtggaggttgtggtgagccgagatcacaccattgcactccagtctcggtgacagatcaagactccaactcaaaagaaaagaaaagaaaagaaaagaacaaatggtgatggtgtctcgccatgttgctcaggctggtctcaaactcctgggttcaagcgagcctccagcctcggcctcccctcccaaagtgctgggatgacaggcttgagccactgcaccaaactgtcactgttttttggtgcatggctcagtgtggtaaagccactcacagtgttaagcagcagtttcattatctttcacaccagcctgggccttgcccatgttagatgcattcctattaaatgcagtcctttttttttttttggagacagattcttactctgtcaccgaggctggagtgctgtggggcaatcttagcttactgcaacctctgcctcctgggttcaattgattctcctccctcagcctcctgagtagtcaggactacaggcacatgccaccacgcccggctaattttttaattttttgtagggatgaggtttcaccatgttgttcaggctgttctcaaactcctgacctcaggtgatccacttgcctcggcctcccaaagtgctgggattacaggcgtgagccaccgcgcccaacctggcctgcagtcctgttttttaaagcttccctgagcaatgagacaacgttacattgttccaatggaaacagtatgttttgtcattaaagaaaaatacatctataaattaagataacaaaagatctggctgggcacggtggctcacacctgtaatcccagcactttgggaggccaaggtggatcatgaggtcaggagttcgagaccagcctgtccaacatggtgaaaccctgtctctactaaaaatacaaaaaaaaaaaaaaattagctgggcgtggtggcaggcgcctggaaccccggctatctgggaggctgagtcaggagaattgcttgaagccaggaggcggaggttgcagtgagccgagatcacatcactgcactccagtctgggcgacagagcgatactctgtctcagaaaataaaaaaataataataaaaaatagcaagaaaccagtgtgactggattggggccagactctgagtccgagggaggtgctgagactccagcagcacatggggacctgctctttgagggactcggggcagaacgggaaggcaggaagggctggctctatccgtgtggtttcagggagtcctgtgccacagcccaagtccccgggggccacatcaccttgaaggctatgtgggtggtgccctggggctcgccccctgcaagcacagatgcagggtggtgccaggcccggcatgagcccccctgtgcctggcccgcaggaggaacaaggtgctgaaccacttcagcatcatgcagcagcggcggctcaaggatcaggaccaggacgaggatgaggaggagaaggagaaacgtggccgcaggaaggcgagcgagctgcgcatccacgacctggaggacgacctggagatgtcgtccgatgccagtgatgccagtggtgaggagggtgagtacgggcgcctgggcattaggtcacagaggtgcctgctcaggcagtgccagtgaaggcaaagtctaccatcgctcacagtggccctagaatgagaggcaagtggggccgggcacagtggctcacgcctgtcatcccagcactttgagaggctgaggcaggcagatcacctgagatcaggagtttgagaccagcctggccaacacagtgagaccgtgtctctactgaaaacacaaaaattagctgggcatggtggtgcatgcctctagtgccagctactcgggagactgaggcaggagaattgcttgaacccgtgagatagaggttgtgttgagccgagatcacgccactggactccagcctgggcaacagagagagactccgtctcagagaaaaaagaatgagagtcaggcgaggccgcctggaggagcagtgatgtcagtcaggaggcaaggccagagcccgggagagctgagccatggcccttcttttttttttttttttttttgagacaggatctctctctctctcacatgggctggagtgtagtggtacaatcacagcttactgcagccttgacctccgagggtcaaacgatcctcccacctcagcctcctgagtagctgggactacaggcgtgcaccaccacacccggctaatttttttttttttttttggagacagagtcttgctctgttgcccaggctggagtgcaatggcgcaatctcggctcactgcaacctctgcctcccaggttcaagtgattctcctgcctcagcctcccaagtagctgggactacaggcatgcaccaccatgctggctaatttttgtatttttagtagagatggggtttcaccatgttggccagactggtctcaaactcccgacctcaggtaatctgcctgtctcggcctcctaaagtgctgggattacaggcgtgagccaccacgcccggcctaatttttgtgttttttgtagagactggggtctcactcactgtgttgcccaggatggtctgaaactcctgggctcaagccatcctcccgcctcagcctgccaaagtgctgggatgacaggcatgagccactgcacctggcctggctgtggcctttacgggggttcctatgagaaactgcaactctaggttgaccagtttcaataactcctgtgcgctccgggctgtaggggctgtgtccctggttatcaggtgcctcgcccgggtggtctgggagagggggagtggtctgtgagcgctagagaaggtgggtgggggtgtggggtctgccgggagtttgtttaggagagctgagctcctgggctggccctggaggtgtagtctccccagtcagtgaggccccccaggatgtcaaaactgcacaaaatgtgaaaaacacaataaatacccactgccttcctcctcactttccctcctttccttcctttcctcccttcccagggggcagagtccccaaggccaagaagaaggcgccgctggccaagggcggcaggaaaaagaagaagaagaagggttcagacgacgaggccttcgaggacagcgatgatggggacttcgagggccaagaggtggactacatgtcagacggctccaggtgaggccgacgggaggcgcctgcgagaccccatgcagcctcgcgagcgcgcgctcatcctttgccatccccgtcttacagtagctcccaagaagagcctgagagcaaggccaaggcgccgcagcaggaggaggggcccaagggtaggcgatggctgggcgggccggggagatgggggcggtgcttccctgctcttgctcataccctgcccctcccaggtgtcgatgagcagagcgacagtagtgaggagagtgaggaggagaagccgcctgaggaggacaaggaggaggaggaggagaagaaggcacccaccccgcaggagaagaagcgcaggaaaggtgcggcgcatgtggcccccatattggaggcttgggtcgggccctggcgccctgccacctcctcccctctcccctgcaggcctccctcatctgcagtggaggcaccagtgggcaccgggtcccggggttgctctggccctgacccctttcctgtgccccgcagacagcagcgaggagtcggacagctcagaggagagcgacattgacagcgaggcctcctcagccctcttcatggcggtaaggcccagcccggtggcgggggaggcctgggcgtctgtttgcagactcacccacctcccaaccctgacctctgcagaagaagaagacgccacccaagagagagcggaagccgtcgggagggagctcaaggggcaacagccgcccaggcacgcccagcgcagagggtggcagcacctcctccaccctgcgggcggctgccagcaaactcgagcaaggtgagtgcccgtggcctccccgctccccacagccacagccacagcctcctgacctctgttggggctcaggacagagaggggatggagatgcgggtggaggcctgtctctccctgatccccttgaaccctaatcctggcactgcccagcctggggtcctgcccaggggttctgcctcctgcctgcaagactcagccctgaccccactcccacagggaagcgggtgagcgagatgcctgcagccaagcggttgcggctggacacgggaccccagagcctgtctgggaagtcgacaccccagccaccatcaggcaagacaacacccaacagcgggtaagttgacgaggacagcagggggcagggcaagggctactggggacaatctcactgatgccaccttccccgtcctcccatcctcagcgacgtgcaggtgactgaggatgccgtgcgccgctacctgacacggaagcccatgaccactaaggacctgctgaaaaagttccagaccaagaagacagggctgagcagcgagcagacagtgaacgtgttggcccagatcctcaagcgactcaaccccgagcgcaagatgatcaacgacaaaatgcacttctccctcaaggagtgaggcttggtccaatacatggctctgccccccagaacttaaggctctcactgccccttcgccatcctagagtgaggctctgtccaatacatggctctgccctccagaacttcaggctctcagtgacccttcgacatcctgcttgctccctgactcccagggccccgtagttagcaattctggaaaagttaagccatctcctcctctggcccttccttctggaatcttcagatgcctgttaggccttcttattgtcctcctcctcctggctcggcctccctcacactgaccaagggcctgtgctgcccactgggtaacttctacagttctcccttccacttccctaagtctctcttcagctgtgacttatccaccacatagcccagtaagtcttcagttttggctgggcatgatggtgagcgcctgcagtcccagctacttgggaggctaagcccagttcaaggctgcagtgaactatgatggtgccactgcattccagcctgggtgacagaatgaaatcctggcacaaaaaaaaaaaaaaagtagccaggcatggtggcgggagcctgttgtcccagctgttccgtaggctgaggcacgagattcacttgaacctgggaggtggaggttgctgtgagctgacaccacgccactgcactccagcctgggtgacagtgagactctgtctcaataaataaaaaataataataaattgctcagatttctttgtttcctttttagatctgctactctgtttggataatgtcttattccttatgttttggtcccatctttcatggttttatttttatttatattttaggttttgagacagggtcttgctctgttcaccaggctggattgcagtgtccaccgtcttggctccctgcaacctccacctcttgggctgaagcgatcctcccaccttaacctttcaagtagtgcacaccaccacgcccagctaattttttaattttttgtagaggtgaggtctcactgtattgcccaggtcagtcttgaactcatgggctcaagcaatcctcccacctcagcctcctgagtagctgggaccacaggcgtgtaccattaaatgcctggctaatgtgttttgtttttgtttttgtttgagacagagtttcactcttgttgcccaggctagagtgcagtggtacaatctcggcttactgcgacctctggttcctgggctcaagcagttctcctgcctcagcctcccgagtagctgggattacgggcgcccgccaccgcgcctggctaatttttgtatttttagtagagacggtgtttcagcatgttggccaggctggtctcgaactcctggccataggtgatctgcctgcctcgtcctcccaaagtactgggattacaggcgtgagccactgcacccacccacgcctggctgatgtttttattttactcatcctgactgaggtctgacaatcctagaagctgaagttcccgggcatccttttgtttcttctgactccccttagtgatagattttcttgtgatttgggattggatgctcatggccagctgggggctctgtgggaatccggggtggcctactttgcaggcagtccttccagatggttcagccttggctttcgctagctacccaggagcgccagccccagcccattttgtgtgtggttctcagcttgcaggtggccaccaaagccaaccccccccactgccccgattgtgggtccctatgtttgaggttcccggtgatgtttcggggggcttctcccttcttacaagctcggtcatgcatatatttgatctggcgttgccaggcattctgtaagggagggcttttccagttcctggaaatggaactggaaaatgtggctggaaacattaatatggctggaaatggaatttgcctgcagccactacttttgaacccatcttccgggcaatcccttctgtcttgccggtggttggaaacttgcaggtggaagtcttccccacccagttctgcagcccttggctgccgagcaggaatgcctgagatgtctggctaattcctcggaatgtcccagttcaggccaacctccctcccccttctcccaccaggccttcttgggcagcagggaggcagctctggagggagccgctgcctcagcagtttcgccccagccacccccactgcctgggccttcatgtaaggaggctgggtggtgaggccctgtggtgaggagcaggggttttgcattcacggaggacctgggttcaaataccaggaccgttgcttaattctgggtgacttcaggcttttttttttttttttttgagatggggtctcgctctgtcgcccaggctggagtgcagtgacatgatctccgctcactgcagcctccgcctcctgggttcaagcaattctacctcagtctcctgagtagctgggatgacaggcacgccccaccacggtccagctaatttgttttttgggtttctgagacggagtttcatgctgctgcccaggctggagtgcagtggtgcaatcttggctcactgcagcctctgcctcctgggttccaagcgattctcctgcctcagcctcccgagtagctgggactacacccagctaattttttaatagagacggagtttcaccatgttgaccaggctggtcttgaactgacctcaggtgatctgcccacctcggcctcccaaagtgctgggattaca

SEQ ID NO: 13600 - DNA, 15449 bp, Human
tccccactcccacccctcaagaaaatttcctaaaattaatcctgataactactactcagaaactcccccactcctcctcaaactgaccaatttcctctaagactcttcaaactgttttcctactgacccctggggcccctacccgtggcttcagcacctgtccgcaacattccagactcctaggaggcccggtcatctctggcctagtcctgatcttgcctgtgtccctgcagataccgtggagggctcaaatcccaccatgcgcggagtcctccagcggatcctggcccagcagggctggctagggctgtaccgaggcatgacccccacgctactgaaggtcttaccagcaggtggcatcagctatgtggtgtacgaagccatgaagaaaaccctgggcatataggctgtgagctggacgacacagcctaggcagaaatgggacaggaggacctgatgacccctggccccaaagagccctcgaggcctcaaggttcaggccctggggcagtttttggtggcaaaagcaggctgggggtgggggtggggctctgggtcagaagattcctgaagctggggttggtggtgggtggaggggggcagtgctgggtcagaaaactcctgggactccctccccagggtgcagcctgagacaagaaacgtggactccagtctggccccttgtgggtcgtcctggctccagggcgaaatggtgaacatgtcacacaacaaggaataaagagatggtttttgctgaacgtgtctggatacttgggcctaggagtggaactgggtgcatgagatccctggacccagtaggggagctggggaccttgggcctctgggtcctgaatgggaatttgtgtccaggagaggaagtgaggacctaggataggagcttgaggcttggatcccagggccttaggcgaagggagtgaggggtgtgaagtgaggggtgtgatcgaggctgtgatccctcgatcccggttgttggaacggttctggactcgtgagtggggctggttccttgagtcctgcaagagaactggacgctctagatggggggtcgagagagaagaaggcccgggggatcccgagtttcctgctttccggcctccccacctccggaagcgctcgatctctaaggcttcaagcgggccacgtgccgggcctacccaaccaggctgccggtgagctaacccagacatcaggcctgagttcgggcagccgattgccaccgcccacgtcggctgccattcactacagttcccgctaatcccctcgctgtctggtggccgactccgccccaatgcagcggcgcttccactggctcccaccaaaagtgggcgctttgatttccttcattcccatttgtccagaccagtgtcagtcaccgaacacccacccatgtcgctcagccattggcttagaagtcagggatagaaaaggattctggttaacaagggaagcaattaaagtccaaagccaacctcatcacccagaactcgtcaggaattggattaattggctgcccatctttacaagcaccacctctcacgtgcattcattggcttgtgtccacgactatcaaacctaacgcccacccagccggtccataggagtcttccactaggcccggccttacagtccacgtgactcttcagaaccgtcaatctaattctgaagccgccccgcgaatctggcactcgcgtttcattgggcctcctgccttctcagatctccttcatttgcccgcccagcacgggcagctcgcagctattgcctctgagagctgtcagtcactctgagcctcccgcccactgcccctcattgcactccgattggccacctcctacagagctcgcgattggtgtccggggtgcggcggctgcctcccattggcccgccggagtcgtccgtcacgtcggcggcgggaggggcgactctctcccccctcgtcgtcctcccagcggctgggttcccagagtgctccgcggccgtgtggagcgaggccttgttcccgcgttgagccgccgccgccgccgccgcctcctcagcttcagcctccgcgccaggcccggccccgccgcgccatgtcggactacagcacgggaggaccccccgcccgggccgccgccgcccgccggcgggggcgggggagccggaggcgccgggggaggccctccgccgggcccgccaggcgcgggggaccggggcggcggcggtcccggcggcggcggcccgggcggggggtcggccgggggcccctctcagccacccggcggaggcggcccgggaatccgcaaggacgctttcgccgacgccgtgcagcgggcccgccaggtgaggaggccgagggcctgaggggcgcgctcgcgcgcgcgcgcaggcgggggagggggcgggggtcacgtgcgcgcgcgcgcgcagggtcgcggaggggggccggggccgtcgcggggtcacgtgggcggtaggcgggggcctggccctcccgctgcgcctcgagtgggatcccaacgggtgacccccctgcagggagtaggggcgcactgggggtcaccaggagcggcgcctgggtgtgcaggcgccccggagctcggagacgcacttttgggaccccccccttagccccccggccttaggacatgcctggaggcaggggtccaccttcccgggcggagggcctttactctcccctccatatcagggcaaagggcagtgtttgcccccaacccagtcccatttctgtcccctctctaggagaaagggacattgtgggggtgggagggacagtccttcctcttcagtcgggaaagtggatggggacctgtctagggctgagcacttgggcgaaatggggaagacgagcatggggactggctcttggatgctttggtggcttgaaagcgtggtctgtctctttgggggaaagaagggagggtctcccacccccgtgtattgaggcgtaatgacaaggaagtgtcacatgctgctaggactgacctctccagctccatttgcagcctccccatggcctggaggggtgggggtcggtagaatgggaggactttgccgccgaccggctcctgggctgtcccaatgcctccggggctagagactggctcctcccaaggtgggaggtcccgttaagtgaacgcctgtgttctggccctctgtcgtctctctcacccttggagttgggtgggttctagcgtgcatttggtcttattgcccatggaaccgtctgattctgggacagcttgaagggaggaagctggtgctgtcagttggtggggacaggccccctgtgggcatcccatgagttttggctctagggcagcgtagaaaaatggagactggtggaaagggagattcttaacatggtttgggtttctaaaccccagactctgatcctaagtttgctgggttgaggtttctttaaagttgctcttcacgtgtctgagatgtaacttgtgtcccatagagtcttggttttttgtttgtttgtttgttttttggaaacagtctcaatatcacccaggcaggggtgcagtggcacgatctcagcacaccacagcctccacctctccagttgaagtgctcctcctgcctcagcctcccgagtagctgggattataagtgtgcaccaccacacccagctaatttttgtatttttagtagagatggagtttgaccatgtcagccagtctgtctcgaactcctgagttcaagtgatctgcccgcctcggcctcccaaaatgctgggattacaggcataagtcacagtgcccagccatccagagagtcttctgttttggtcaaatgaggatttcatatcccttgaagtgatcgctttgctcaaatttattcaataaattgataaaaggattttgagagtgggggagataggggaaagttgaactcttcagcatcccaggaaaacggggctaaaaaaaaacacactttctggttttctgagctggggccactggcaggaggaagtgtctgaaagctcttggagatgacctgggaaccctccctgacacctgagcctctgttccttgtcacccctagaacgaagtcagtgtggattatgggctggccacaattaagacacaaatcccaggagaagggaagaggggaattttgatattcccagttaactggtgagaaccttgaggcctaggttcaaaactcctaggatgtcttaaccaactgactcttccctaagttggagggccagacaccaagacctgatgggctttcgtgtccaggagatgttctgagaagttgacctgggtgccatggagggttgtttttggtggtaattcttctgtgcttactactttattctagattgcagccaaaattggaggcgatgctgccacgacagtgaataacagcactcctgattttggttttgggggccaaaagagacagttggaagatggaggtaactccctgctgctgcctttagcttaggaggaagggctgggggcctaaagaggtgcttttgtttgagtgtggttcagagggggtgggtgtcactgttgtttggtcttttaaaacctcagcaatcccggccttgttaattcttcttgttccgtctgccatcctgaggtatcaggtggcagagaggagggcagattgattgtgactgggtcgaagttgtaagttcccaagatgattcctccctttctgggaggctgaggcaacctggagcagttactgaggcttgatgtgaagttggcccagctctggggtgcgtagtgtgaccccaagtagcggatgatcaaccctgaccaactccactgttatccacgacaccctccctgctagaggcaggtcctgtcctaaaccgggaggactcaggtgcctggtggtggttgcgtgttctgaaggcttttttactctgagcgttggtggcggaattggcggggtctggcctccctcaggggccagtctctcctgggctcctgtctcagctcctgttaagggtgggggccgaggggcactgtttaccttggacatgtggcaccagcatcaggttcgaggcggccgtgggtgggtgggtgctgcatctgccatcctctctctttcccagatcaaccggagagcaagaagctggcttcccagggagactgtaagtccagggggtctggtggcagatatgtggcttcagagggttgaggttttcaggagtcaggagctggaagcactgaggaggtggcagctctttacagaggcccctggtgcttcattctggggcccatacgtttgagggatcccaggaaccctgaaattgagggagatgagctctgtgcttttatggggaggaatccacagcatccatgaggcactggagcaggctggggaccgtggtgccgggctcagctcccactgacccggggcaggcagtgccaagtgcccgaggaggagctaagccagtctttgctttgggttttctctctacagcaatcagttctcaacttggacccatccatcctcccccaaggtaagccatggtggggcccacactgctttcttgtctgttggccagcagactggcctttctgctgacttgggagggctctgactgggggcacatctctcaggttttatcccccagtgccagttgaccagagtgctcagacgggaatgaggcagaggagctgtgtccgttcctcgtaccccttgtctgaagggctgtgggaggggagcgtcgtggcagtcactgtagtgatagggtggtctccgcaccctatggcttcctccgctggggtggggactctgagcagcacaaatgtcgtcttcctggaagaggctaggagggccttgcttccctccctcacacatctgcaagtgcccatcccactcagtgctgtggagctcagggctctttgccacctctttgccccaccagatggactgaggtgaacctgacacagggcagttgtcaggggtcattttttgtttgtttgtttttaatgggccagtagtttcataaaatactaggaaaataagatgaaaaggacatacagccagctttttagaactgagagacatagagtgactgtcagcttgctactcagtgctccctctcgccctgaatcaatgggacggcaccaggccaaggcccacaatgcccagagcaagcctctcggggcacagatggggaaactgaggccttggcagttttgtggcctgtgtggtcagactctgcttagacctatggtggccttggcttcaagtagaccttccagagctgctgtcctcctcccttcccacttgaggactgacctttggcgtgtctctttacaggacttcaatgacagaagagtacagggtcccagacggcatggtgggcctgagtgagtgtgggtcaccttgggtggggaggcccactcttccccaggaggaagtgtcctgtgagctcctgccagcccagaagccctggtctgagagggctcctatgtgctgttctcatttgtccctccttcgtcccctctgggcagaggacaggagctctctagaggactgctgccctcctgaacgtcagaggggctggggccccggccacacagtctcctgaggcctgggctcccttccctcatcacgctttgcttttctccttctttctccatccagtcattggcagaggaggtgaacaaattaacaaaatccaacaggattcaggctgcaaagtacagatttctccaggtataagagcgtcaggttcctgccagagtgggggccagggttgggccctttgcactttcctttaattacttaatttccacggggactgtggacaggaagcgagctggcgcttgttggtgcttactacggaccaggctcagtgcagtatctcactccactagtactgcccacggggcacagctgtgactttttttattttcagtgggtgggtatggactgaggtggcagggctagcatttcgcacaggggcctggttccagacaccgagcttcgacgcactgcactgacctgccgcgtgggtgaaagcaccccggcaagactgcgtgagacagggtggtgccttggacagaggggtcactctgaggtcaggcccaggagcaaatcccggttctggctgcacatctgctctcaggcaatgtagttacctttcgaatctcagagtcctgagctacagaaagcctgctgggtagggggttctgaggcttccttgggcgtgtagcacgtgttgtctatagaagcggctctggtcatcattggtagtgggggtggccggctcctggaccttctggaatctgcaactccctccacctcatccttttcccttaaagtcctacctcccttctgggatctcttcccaaccttggccttgcatcgagcagcctcccaggtgtttaggggaagtaaactgatctgtcaggcactgaatgggacagaagtggcccttggttgttctgaaagtttcctcgtgtccaaggcaggcctttctctgcctgtgggccagggagggcactgactctatctcctctttccagacagcggtggcctacccgagcgcagtgtgtccttgacaggagccccagaatctgtccagtaagtccccacagggcctctcattgtgatgtggggggcaggcagaagcctgctctgtccgtttgaattgaaagttgggagcaacttgcacgccatgtcctccattcttgcccccatctccagacagccatgttaacatgaggctgattccccggcagcccaagacctggggaacctggagcctgaacagcccctgtgactggcccctcttccctgtcatccttgcacactctggggtcgccttccctttgagctgggtgggccaccagaccagtacctttctccagcggtggcacccgctcatcccccgctcctccccttcccaggaaagccaagatgatgctggatgacattgtgtctcggggtcgtgggggccccccaggacagttccacgacaacgccaacgggggccagaacggcaccgtgcaggagatcatgatccccgcgggcaaggccggcctggtcattggcaagggcggggagaccattaagcagctgcaggtgagggcagcacctgggcagcttcctctgcatccgtgtgccacaccccaccgccaccaccacagcagcccaggaagtcctgggagagcccagcactaacggttaaccttgcttgtaaaggaacgcgctggagtgaagatgatcttaattcaggacggatctcagaatacgaatgtggacaaacctctccgcatcattggggatccttacaaagtgcaggtgagcacgccctggggtggtggagggggttctggagaggcacgggcaggtgggcagggccagcggtctcggggtctgcattccgccagagagatatgtgaacagtcggtcataacaccaagaggcttgcaagagcgctggctcgtaggatggccctgaactgactcccagctttgtgtgtgtgaggcaccggcctcacctctgaccttctgcttttttatctggaaacggggctgctggtagtgcctccccattaaagtggcaggtagagagctcagtagggtgctgtgctgggctcacccagggttcgtgggtccttagttgaggcccgcacccccgaggaggtgggggggtgtggggcagcagggctcacccatgggggctgcttcctgtgtgtttgcagcaagcctgtgagatggtgatggacatcctccgggaacgtgaccaaggcggctttggggaccggaatgagtacggatctcggattggcggaggcatcgatgtgagtgtgggccctgccttcacccccctctcccccgccagtggagggaggggccggggtgagtggctccttgtggccagtgggcagcagagggcagcagagctgcgggccgagctgacgctgctgcctccctccccaggtgccagtgcccaggcattctgttggcgtggtcattggccggagtggagagatgatcaagaagatccagaatgatgctggcgtgcggatacagttcaagcaaggtcagggcctggcccaccctgcccctggccagtgcacccccaccctctttgggaggcaggctctgagggagctgggcaccgtggtcagccaggtggcctccatagcacctcacggctcttagtccagccgtcagaacatggccagtcccttctcttctctgggacagacacatgagggctttccacatccagggggaacgtgtgttcctatccctatcagatctcctcttcctccccctacgatggagcctatcctgacaggacagccctgggtgccccgcaggctggatcagggcactccacctcagctctgggctcttgccagtcctcaggcagtctctgagctgcctgccgtggggagaagggcccctctggcttttcagagatttattgttctgtaaaatctctcagtgctgggggtgctgtgtgctggaagaagcttgagccacctcctggcttggccgtgggtttccttctctgggaatgtgggccgcctccccctcaatccctgagcgagtggaggctgggagcggcgcagcgcgtctgagatctcaggccggcgtggtgtctgcgctggaggcggcgttgcagggctctggggtgggctcttcttttaaacttgtgtctctgctctctcggtgctggcctcagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtgagtgtggccccctgcaccctatcccttgccccctcttccctgggccatcactgcaggccaccttcaccttctgcgtttctgcaggtggcgagaatgtgaaagccataaaccagcagacgggagccttcgtagagatctcccggcagctgccacccaacggggaccccaacttcaagttgttcatcatccggggttcaccccagcagattgaccacgccaagcagcttatcgaggaaaagatcgaggtgggttggggcgggctctggggatttggtctcacagcccggatcccagcccacttaccttggttactctccttccttctagggtcctctctgcccagttggaccaggcccaggtggcccaggccctgctggcccaatggggcccttcaatcctgggcccttcaaccaggggccacccggggctcccccacagtgagtatcctctgcctcctgggttttgaggccgggggcttactgagctggcaagaagaatagcagaccccatttccctttccctagaagtgcaggcggggggcctcatccagcccatttttgtggataccatcaacaggccctctcctgtctactggtagagcatgtgcctttcagcatccctctgtgcacgtgcaagtttcgcggcttctttcatgtcctcaagctgacgctgcgcgtccttcgagttgcttcttgtctaggcctttcccaggcgccccgttgagcctggtggtctgggtctctggcgcctccccactgaaaaacatccccaccccaggtggtccggctgcggccacccccgcaccactgctcaagcatccctttcttctctcctgcagtgccggggggccccctcctcaccagtacccaccccagggctggggcaatacctacccccagtggcagccgcctgctcctcatgacccaagtaagtgatgggccacctggcggagggcaggccctgttctgtccccccgtctcacccgaggtatctcctgcaggcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggtgagtctgcagggtggcgggggggctccagccctgccgggggagtggtttctgacctgtctcggcgcccgcacaggccagcagccccagcagcccggagcgcccccacagcaggactacacgaaggcttgggaggagtactacaagaagcaaggtgagtggccaccatgcggggacaggggcaggggcagccctcacccacagcctctcacctgcctttgtccacccacagcgcaagtggccaccggagggggtccaggagctcccccaggctcccagccagactacagtgccgcctgggcggaatattacagacagcaggccgcttactacggacagaccccaggtcctggcggcccccagccgccgcccacgcagcagggacagcagcaggcaagtgggaattgccaccctcctcctcctcctttctccttccaacccccggccaccgtccatcctgccttagtgggtagcgccggaaaccccttcccctgcggggtgtgcccttgatgcctgcagcgggggccgtgtggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcccggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcagtttttactttttatcgctcgtttttaacttcacaaataaatgataacaaaacctccccgtctgcgggtgctgtctgtctccccccctttccttccctccctgtagttttgaagcggatgtttgttctttatagatgttgtttaaaaagcctgataatggtgattgaaatttacaaactttgtgtttttttttttttaagaaaaatataaaatagttttcttcaggctcaatgtgctttcctaaccgtgcccccccccccttttttttttgttaaataaagtgctttttgtttaaaaaagactgcgtgctggccgcagttgtgtttgtgagaggaaacaagttgagcaagtctcagccaattagagtggggtgtggccccccaagactttccccttccgatgtgggaaggggaggctggctgagcccagcactgctgtcttcccctacccagtttccctccagcaccttggggagcaaggcgcttaggagggcctcagggaccggcgttcccatggatgggctgttgctacaggaggtcctctggcctgttaacgttcagagccctgaggtgggagccaggcccgcgtcagtgctcgctgggtgatgggaccggatgtgaggtgggagagggcaccgaggggccacccaagctgtttggacctgggcaggtgtcttgcagccccgcatgcagctgcagggtctctgaggttgtggctgaatgccagcgtttaaaactcgcttcatcttagatgtcctgggctcatgggcctggtgatagccccggcaggagccagtaacagctgtggcctctagggggggctgttgacagtcccctgacccatgcaggtgtgccaggcacctggcccagtggggcatgttccttggtggcccctggccaacctccctggtggggaaacagaccccgggaaagggaacctgttgctctggaatcacagggggcatcggtccccctttctggaggtctcacctcctaggtacgcacccttcccacgtactgcacgggttccggtgaggggcaaggcccacccccagcccctctgtctcactgcagactctcaatgacagagcagcacttggcaaagatgttctctggtgctgcttctgccgggatctagagaaaggggagccgcaggggtcaggtctgggccccacggcagggacaccaccctctcccgctcagaccctgggaaaatcccagaggcatgcacgtgaagggagaggggacagggtcaggaaagcttgtgttgctgactgctgtgtgagggcgtgcagggaggccccaccagtgtcccattgccttcccacgtgagccaaggctgggttctcaaggcatttcctgggggaatgggaatcccccaggttacctggtaggaaagcgaggaccaggcccgggtgaccctggactgttaaagccagacttgttccctaggggttggggtgcagtgagccagaagcggggagcacctacgtttcagagcaggttattgcgctggtaggtcaagaccggctcacacaaggtatagtgcgtgtccaagcgctggtggatggccagctccgagtcgtctgcccggtgctccacctggccccagtgtagcactcgtcggagcatcgtctccatggagcagtcaaacacgatgacgacgctgggggcctggcccacctaggaacccgaacaagggggctgggtgtggagggaccaggcacagtggctccagaaccccggcttccccagaaaccaggtatctaggattacgtgggcaggtaagaaataatcaggccaccctggtctgttttatttatttatttatttatttatttatttatttatttgggcacgtaaggaataatcaggccaccctggtctgttttatttatttatttatttatttatttatttatttatttattgagatggagtcccactcctgtcgcacaggctggagtgcaatagcacgatcctcagctcacggcaaccacctcctcccaggttcaagcaattctcctggctcagcctcccaagtagctggcattacag

SEQ ID NO: 13601 - DNA, 16429 bp, Human
accagctctgctaacacaggctgccagaagcccctggggctggactccctcatacaactattatagtaagaagggttgctgcaatcctcttgctgcccaggcacagcggcgcctccggggcacagcgggagaggggtcttccttggcctgctgaatcttgatttggagtctgaaaatttgggctgacaaggtgttttgggttttgttgtcatcgttttagtgtacaattgagtggttttagtacatccacagagttgtgcgaccatcacgtgattaattttagaacatttccatcatcccaaaaagaaacctcatccctgttagtcacagcctgcccccaaccccctcccttgagccctggtaaccgctcagctcctttctgcttagtctggcatttcacagaaatgcaatcagacagcatgagggggtgtttttcttttgatttacacctttaatttcttccaacaatgtttttgttttgtttgagacaaggtctcactctgtcgcccaggctggagtgcagtggtacagtcgtaactcaactgtaacctcaagctcccaggctcaagtgatcttcccacctctgcctcctgagtagctgggactacaggcatgtaccaccatgcctggctaagtttttaattttttgtagagttagggtcttgcagtgttgcccaggctgatctcaaactcttgggctcatgcagtcctcctgcctcagcctcccaaagcactgggattacaggcatgagccactgcacccggccctaacattgttttatagttttatcttgtgaaatgtattcccaagtattttattccttttggtgttattgtaaatggaattattttcttaattttgcttttgggtcattcactgctagtgttagaaacacaatcgatttttgtatattgatcttgtgtcctgtagcttgacaagggggtgaagcttagcacaaacgcagggctacctccaggagccataatgccacagtctctgtgccttgcccaggaacaggcttgcctgcctgagtcacaggccttttatgacaatccttcctgttgtggatcagattagaccaccatccccactccccgtatgggcacagttgccaagacacacagatgaaggggtccatgtggacaggtggctgggcgaggctgggctctcgagccatcccaggagctcgtgggcattcacctttccctctagttttgtgaatttgtcagcccggactctggcccagggggagctggcctcctccacggtggccaggagtgccccctcactgagacgggaagctccgcaggcacatctggaaaggggaggcaggctcactgtgtgccacctttgaccttttcatcacaaaaacctgtctcacttcccagacatctgtagtggtgccaagattcttcctggccacagccgcatcctctgacagacaagccttctaggaaagggaagtggggcctgagcgcctgtgttccgtggctccctgacattctccagagccaggtacagggccgctgagcagctcggctcctgagcctgcagcaggtcatagacagctgggagggcggctgacgccccacctgcccccatggtcagcagctggcccaagagccatcgttcctcctgcccttgtctctcccctcctccaggcgccttccaggcctgctgatcggacgagacttctgttgtaatttggaaatgttctccctggttctccaggcccgaagtcactgaggccaagaccatagtcctctcctgcccttgccccccaggcccagccccagcccaggcaggcctgctgttgatattttgtcttgtgcttttagaggaaaggagcagtggcttccggttgaagccaccaacgctgatccacggccaagcccccagcgcaggtaggtcgtctacctccctggggcggggggtggctctctgacgtttttcagacctctgctaggccacaccagggcaccgcgggctcagcctgctttctagaaagatcacttgtaacttgacccacgagccctggaaagttcctttaaagagaggctgtctgagcagggaggttgggacccctgactgtgagcgtcgtgtgttcagaaaagtgggcagtggtggcacgggagcaggctaggcggggtgcatcgggcgggctccatgcccagcagtagcgcacttggttcagcctgtctgtccttcatgttctggcccccacataccacagtgttcgccccagttagcagggtggctgcattccagcggcgcgctgctagtgagccggctgctagtgaggctgccggggatgctgcacagggcagggcacatgcaagggtccttgtcccatctgcctttggcagagggacttcctcagcatggctgttttgaaaaacaggtgcaaaatgtgcctgtacgtgaccccacaccgagtcctgagcctccaggtagctgcctgtgaatgcactgctctcctctcacagtctccacttgactgttgagtctgccggcgccccgccacgttactgtgctaactggattaattcacaggcgtcggtcactgggagtttcatgtaatcacatgtaaaaataacagtagccagatctcctggccagctgttaaaaaaagacctcaagtttttaaaaaagtgcttccctgcaaagtctagcctgcaaggggcatgaaatgggatgccaggggtcagtctctgaagcgcctgggggcaggcaggggtccacgggcactgggaaggccgccttctgttcctaggtctgccaagccagaagcccaaggagcagcagcggagcgtgcttcgcccggcagtgttacaagctccgcagccaaaggcgctgtcccagactggtaagaaacagcagccctggcgcccaggcccagacggcagggtagagcgttcccgaagtcgcacccgggacagcagtgttgcgacagaggtgactgctgaatgcaccagaaatacagagagatcagggaagatgatcctttaaatcaccccccagccgtctccagccccaagcctcctgagccctggcaacggagaagggagaggcggctccacagcttcctcacagctctcggctgagtgtgactgtgtgggtgaaacctgctttgttcattcactgtcttcataaaagcaggccggctcctgggaatgagatttatccctgtgtgtttgcagatagaatttcagcctcaattttcacaggttatctttaaaaacttgaaaggtcattttatttatttatttatttatttattttggagatggggtcttgctctgtcacccagactggagtgcactggtgcaatcatagctcactgcagcctcgaactcctgggctcaagcgatcctcccacctcagcctcccaagtagctgggaccacaagtgtgcaccaccacacccagccagtttgttttatcttattttagaaacgaggacttgctgtgttgcccaggctggtctcaaactcctggccccaagcattctccccgcttcagcctcccaaagcactgggaccacagacatgagccactgtgcccggcaggtttctcttttttgtttgtttctcttgtttttttttaaatccaagaattttggctctttgtagagataccaggtccttccttaaaaaggagacatgtgctgtgggctttaccatgggaggggccctagactagacgtggcccagcccctcagctatgtgagtgggggtgggagggccgccaagcacctgtgattccccactctccttccctcccacagtccccagcagtggcaccaacggggtcagcctcccagcagactgcacgggggcagtgcccgcagcatcccctgacactgctgcatggagaagtccttccgaagctgccgatgaggtgtgtgcacttgaggtcagtgggtcctgaggcagggaagcgctgcatgctaggccccttgggagcgggagggcagccttcccagcatgctgtggagtccacacgctgtcacctgttccaagcagtttccacgtgggcctattgtaaggctctctggatttgctcagtaggctctaaataacagtacctgacaaaccagatctagattcccaagggtggtcttgctggtcaggcagaagaagagtgtctcccaagcaagctctgccggaaggacctgttgcccagagttctgccggaagggcctgttacccaaggctgaccgccacatgtctcacgggagtgatccttgagggaggacctgaaccactgcactctgaggagtcactagggcccgaggaacggctgtcactgatgggtgtcttgcaatgtttaacatgaggaatgtctcccctctctgtgtccacacccaaaccacccctcagagactcctatctgtgtggttccagttgaaaatttttctttgggagtcatctcagaaatagtttgtttaggccggacacggtagctcacacctgcaatctcagcactttgggaggccgcggcaggtggattgcttgaggccaggagttcaaaaccaccctgggcaacatagcaagactctgtctctacaaaaaatacacagattagccaggcatggtagcatgtacctgtagtcccagctactcaggatgctgaggctggaggattgcttgagcccgggaaggggaggctgctgtgagccgaggtcacaccactgcattccagcctggacgacagagccagaccctgccttaaaaaaagaaatagttccatttaagcgggggtatggtttggattatatgggccaaaagctttgtgtttcacagccactgtgaaataagggcctttgatgaagagcctcctttgaagttggcagagatgggtttgaagtcagaattagggtaacaccatgtggtatcttctgtgtaaaagccagattggatctttgtgtttattttccgctctgtgtccatggcctgcagttttataccctccatccccagtagatgttctggctcaaagggtgaaaatggctgtccacaattaaatttgaaaacatcctcacgccctttttcaaacgagtttgctgaattggaaatagggatcatttccaccgcattctgcggcttggaagctttgactgctgaggtctcctgagcagatcaggtgtgcagttctgagttggagaaggacttagaagtgacccagcccgtcccgccatctcccagtgtctctgattgtccccgatggtgagtgcacaggctgacctggtagcacccgctaccgagagcttgttcctcactggagaggccttgctgtgtcccatcccaggggacggagtccgtcttcctgccggttccagccccttctcagcagtgcacacagcttgttcccaaatggttgagctcagaagttgtgatgtgctggctgccattcccagctcctgcgtctggctccaaagccactgctccatgtgggtctggggtggagccatgcggccacacccacgctgccctctgaccacacccagtactgttgagattcgccaggctcgctgtgtgtatccttctctggccctacagcaggagtccgagcttttccaagccgcccatgaacatggcacacactgctcatcgggaacgtgagctatgaggcatctcctctaaggagggcttagatgttgggggcgacccatgggggaactcctggtaccgtctttgggaaagtggggaagaggcttcccctcccgccccacacacacacagagtctcagactggttacaggcctcgggattcgtttatcagtttaagcgaatcctctaagcaggctccgccaggtcatagacataccctgtagtcagaaacattttgctgtttgcctgccccatctcaggtgactctgtgggctccacccacccgggattagcaccagtcggtgtgagcagggggcacacagcgcagaaagccaagagccagggagtgtttctgctggacgggatgcaggcggccccagtggggctggggattagcccatcctctgaggacttccaggtcgccaaacacgttgtgtgtttaattttaaaaagccacgttcactcttgcacaggcacaaggatgcagcgtgaagtcagcagtagcagaatttctagggagcacagtagagaaacatttacacttttcacttccttcacagttggaccagaaagtgccctcagcgctgtgatccgctgattctgggcctggcattgtaactccaggcttccctgcccgctggacacgctgagccagtcagaagctgcctgcagcctttctcacctccgagttcacggttgtcaggtcccttcacgacatctcccaggaaaacactccctgcctcacgttcatgtccactgtacacatcgccagagactccaaagatctgccaaaagccttttaaaatttcttttcaaattctacgacacctttttcatcatgtggtataggaaagacatatacaaattactagcaactccatattccattatctcaagataaatgcatttggtcttaggatatttagttacaaaagtcatgcctacatgttgaaaatatttacacaaaatggaaatcctagaaagtaacaagcaggagccaccctccagctaagaggttcccgggtaacctccgtcagtagtttgaattctctctcccgacttattttcctgggcattcctcaacacacatacacaccacacatacacacacacacacaccacacacacgggactggattggctttaacagaaatggaatcgcacttccgtgtcccacaagctgctctcttctctgatccatgtattgtgggcatgtcagaggcctacctccctctcggtggtaatagctgtgctgtactttttttcccccatattttctattgtaaattatttcattccttggccaatgatgagcaaccaggttatttcctgtcctctgccggcactaaggcttctgcagggcacaggtgtttcttgttgtttggagacaggtttttgctctgtcacccaggctggagtgcagtggtgtgatctcagctcactacaactcccaggctcaagcagtcctcctgtctcagccttctgagtagctgggagtgcaggcacatgcagaggagacgtgtggagtacgtgatctggtgtgggattgctgggcatccgtctgggccaagtgtggcactggttttgattactctgttttgttttggtttttgataggagaaagagccccagaaaaatgagtccagcaatgcctctgaagaggaagcctgtgagaaaaaagaccccgccacacagcaagcctttgtatttgggcagaacttgagggacagagttaaggtatgtgagctgttgaaccagcacattgactttttatgccttccccaggttcaacagcaggcaagtaggtagattttccttttaacaggggaggggagcgtgggacaaagaaggtgttagcgaggcagccccatggctcacggcacagtctgctgctggtgtgcgtgtgctgggccctggcacttccccaccagcagcccaggcttcggagccctcacctgcagtgacttctcaagtcagggtccctggttctcatggtagcggggacagggaaggtgactgaacctgaggcctcaggctttcatagcagagaagaaagacagcacggtccagtgttctcagctctgcccagaggtttctgttcccgtatttcagggtttctctgtttcagcactagcagcattacggctggaccattcttagtttctgaggagtcgccctgggcactgcagggtgctgagcagcatcactggcctccacccacccaatgctcctgacatctgacaaccacaaatgtccccagacgtggccagtattccctgtggagtagaatcgcccccattaagaactgtcaccttatttttttttaagtggggcagggtggggtgacaacactgtcttctctcctgaaagggagcaaagcgtctgccacctcttggctgccctccagacatgtggtcctagtttggagattgtgtggtggggaagggatggcagtggttggaaacagtggccctggaccatgcactgggactctaggaagaccagggtcagccagcaccacctttcccagccacagacatggaatgtgctacggcatctctagcagctccactggcaagaagcttctttcaaagctcgagaggcggtatcggtggctgtatctagagacttttgtggttgtcacaactgggaggtacttctggaggtcagggatgccactccgccccttgcagtgcccaggatagccacaccacagggaatgttctgggcccagtgtcaacatgtcagtagtgtcgacggggagggccctgaaataaacaaaaacctctctagcatgcagaaagcaccggcttgtgttttctgctttcctttctgttactcaccgtccaacagaagcccaagtcgagaaacgtggaaagttgatgttgctgttgccatggctttaggcaaaataatgagtccctcaggggctgttccctccaaggagggagggcaagaggcggggaagggcttggcctgtggagttcaggccctgtggaatctctgccttgagtctggggagacagctgctttgaatttggtggggttggcttcttgcagaagtcagaggcttacgtgcacttcgcagtctcagtcaaatcccagcctctccttccagggcaaacttgagccatggattctttttttttctttggacacgaagtcttgctgtgtcgcccaggctggagtgcagtggcatgatctctgctcactgcaacctccacctcctgggttcaagcgattctcctgcctcagcctcccaaatatctgggattacaggcgcccactgccacatccagctaattttttgtatttttagtagaggtggggatttctccatgttggccaggctggtctcgaattcctgacctcaagtgattccccgccgcctcagcctcccaaagtgctggtattacaggcacgagccaccgcgcccagccagagccatggtttcttaaccctctgagcctctgcttccttgttggtcaaacagggtccctaacatccccctcccaggcctcgtgaggattaaagcagatcgtgcatttgacagactcagcatagcagctggtaggaaagaggccctcaagaaattctgcttctatcatgttcatagtaaaccccccaaaacgtcagctttgtaacgttgtgttattggtatgaagcattgaccgagaggccagcttaggcgtggttttataacaaggcgtggttttgtaacaaggtggaaaaggctccttggagcttcatgagctctctttccatcctaactgttaaagcaaaaggtgatggagttgattatagccctgccccccagcacatgcacgcgcacacacacaggcgggtacaggagagggttcatggctccgagcagctccatgcagctcagggggtctgcagacactgagctgtggaactccaggcacccccccacccccgattactgagcgctccgtctcattcccagctgataaatgagagcgtggacgaagccgacatggagaatgctggacaccccagcgcagacacgccaaccgcaacgaactatttcctccagtatatcagttccaggtgtgtgtctcggtgtcagcggccagcctggcatggcgatgcaggtggccgcgagggcttctgccagagaggggtctgtggtccccgtgcccgactcaggcccagaatccaggttgctctcaggcccctctctctcattccccactctgggcacaaccttgggtgggccagggtggtgggccttgtcctgggattcactggacgcctgagacaggaccagagttctgtggggttgtccaggggcccatggaggctacagcccagcccttggagtgtgccctctgtcttgtggacctcatgcccagagcagaacagagcaggccagaggcgactcaggcgcccccttattctgggtttgggcacctggggcaaagacctcatcatgtccttgactgacatggctgggggtaatgctacccacggaccagctgcccctccaggtgtctcagaagaaagcgtgtcccgactgggagatgggcgggtagagcaggtggaaggtggcttccctcatgctgtggggcccctccatcagggcgagctaagggttaatgttttcaatggcacagggaggtgtgtggcttcctgcctctgacacgccaccccgtgcacagtggcggaggcccctccactgtgccctctgtgtcagtgtgtgctccatgggtacccatacatttgcctggccacgttcccacgtgacgccccacactcattgcacatcttctcttcagtttagagaactcaaccaatagtgccgacgcctccagcaacaaatttgtatttggccagaacatgagcgagcgagttttggtgagtggctgtgttgggaatgttctcagggaccagaggctctcggcgccagccacaggtcaaggggacatggagagcagggctgctgtgtcgtcctatgtgagatggggatgccttcagtagcaagtgagagagggaagaccctgctcagactcagcctgaaaactggccagggccactggctgcctacgaactggcattcgcttttcccggctcctccgtgctgaccagggccaacttcatcccaagatgggcttccctggaggctgcagggtcctgctggcagtcggggtccatggttcctccccaccaggccaactgacaaaagtcctgtgggacggagccagccgtgctggtggacagggttgctggcctccctgctcctgtgagcataaccgcggccaaggccttgggtgcacgaaaggcccatctccgttcccaggagcccagccagcctgggagagggttctagaatggtttgcctacctctttacacatgttcctttttcttcctgattccacccagctccattgcgactgcgtgagggcctgtcctgagccgcctggtcactctagctctgtctggagttaggctgcattaagtactctgcagcttctcttccttcgtggccacgctgtgctttttctatttcaatgaaatgttcaaagtcttgcctcacccagacggagtgaccagtgtggctcgaggggactgtcggctggtggcactcaccccgtagtgatgcctgagggaccacgtggggagctcccaggcagttcagggtgtcaccgggagtgggcaggagtgctgggggcagcgtagtgttgggggccaggcagagaggtgctcagagctgctgctgaaggaccacacaagtgccctcttccttgtatgcttttgtgtccctgcagagccccccaaaattaaacgaggtcagttcagatgccaacagggaaaatgcagctgccgagtcagggtctgagtcctcgtcccaggaggccacccctgagaaaggtatgttagcgtcccaccacagcatggggctcatggtaggtcatcttgggggatgctgggtccattcacacccccagccgggagggataaggggcccgactcccgcagcagtaacaaccacatgtgaaccagctccagggccctgccttgcagtgagcaagggtttgtgataaagaactcgagggcctgtgtcgccttgtggccgtggggagggtggggaggcgcaggcagcaggcgtggaggagtccctcactgtccccccgtcgactgctcggcacgaacacgagagtctggggccacacttggcccccagatggtctccctgcagcttctgaggccatatgctctggctgtgtctagggtccacttgggttgccggggcaggcctgccaggggcagcaggcgtccttgagaccagaaccaaccctctcatctcctgtcggatgaggggagatggctctcctctcgccaaataatcagtcagtctttttggccaataacttttcagagtccctggctgagtcggcagccgcctacaccaaggcaacagcgcggaagtgtttgttggaaaaagtggaagtcatcaccggggaggaggcggagagcaatgtgttacaggtgaggggccggcccctcctcggtggccctgggtcttccatgcacctgggggtccaaccgcaagggctgggcccacatcctctgagcacacaggcctgcccctgagatgacggaggggccactggccccacgctctgggactttgttggtggcgtttgtagagagagcttaggctcaggggcttcttgcatgtctttggtttcagaggaggaggatctgtttgagacattctttgttttgttttaattttttttgagacaatgtcttactctgtcacccaggctggagtacagtggcacagtctcggctcactgcaacctctgcttcctgggttcaagggattcttgtgcctcagtcgcctgagtagctgggattacaggtgtgcaccaccacgccaggctaatttttgtatttttagtagagacggggtttccccatgttggccaggctggtctcaaactcctgacctcatgtgatccacccgcctcggcctcccaaagtgctgggatgacaggcgtgagccaccacgcccagcccgagacatttttgatggttcagggaatgacaaagactgtcataccaaacatattctcttgtcgcccagagctggcaactgtattatttgtcacctggcatcctgtggtgtcttcgtagggaaaagatcaggtgcggccagaggttccaccccaccgtcccctcctggcatcccccattcctgctcctcaggccgcaccacccggcttgggcagcatccatgtgcttcctctcccgtggcacataagcaggtgtctgtgtctgtaaaccgggtggcgtatcgtggcgttcttaagagcactgttcttttttcccacttaccactttgtcatctgttcatgttgaaagagattgacttagggggtatgtggaaagccatgtaggggtgtctgtctcgtatttttctttgtttatatatacaaaactgctgtattgaaatatagtacaaatgctatataatccatccttttaaagcatacaattccgtggtttctagtatattcacagagtcagacaactttcaccagaatctaacgtacaacatttctgcccccaaaaagaacactgtcccattcccccagaaagagcattgtccattcgcagtaactcctcctccctccccagcccctggcagccacagatccacttcctgtctctgttttttgcctgtccttgacatttcatataaatggcatcaacgcactatgtggcctttcgtgtctggcttctctcgctgagccagaggttcatccacgttgcagcgggggtcggagccttgttctttattaagactgagtgagatgcgctgtaggggcggaccatgtgtgtcactccattcctccttgagacttggctaccgtgaatgatggtgctgtgcacgttcatgtgcgatctgtgtgtgaacacgaacaaatgttccatttctcttgggtacataccgaggaatggaattgcttgggcatgtggtaattccttgttaagcagtttgaggagccgccagactcttccacagcagtggcaccatgcggccttcccgccagcagtgtgtgagggttccagcttccccacatgggtatagccgtcctagagtgcgcagagaggcttctcaccgttgttttgcttttcatttccttagtgattcttttaatttcagataccccttatacaatgtaaagcctgttctagcttgagggcaggacaaaaaactgaccaaggtggcccccaggccgtcgttggctggccctggcagtccccacaggctaaagggcgactctcagggtgtggctgcagcaggacaccagctggggtccctgcttaccggcggccactgtgttccagatgcagtgcaagctgtttgtctttgacaagacctcacagtcctgggtggagagaggccgggggctgctcagactcaatgacatggcgtccaccgatgacggcacactacagtcccgactaggtgagctgccgacggcgggggctgtggccgggtccccatggggagggctggggactatgcaattccaaagggaatgaagcgggggagatcctgaccctacccttgtgagagtcaaggcacagagtcggtctcccatgagagccgccccccaaaccccctccctgcacccagccctcaacaccaccctcacacactggctccagctgccagctcgtccgtgaccctcttagtgtcaaaatggacaaaagtctatggaagtttttaagctgattttctgacaaagtggcaggtttatgatagaaaggaaaatgaaatcaaacatcaagtctaatctcttgataaagacaaattttggccaggcgcagtggctcacgcctgtaaccccagcactttgggaggccaaggtgggcggatcacctgaggtcaggagttcaagaccagcctggccaacatggcaaaaccctgtctctactaaaaatacaaaaattagccgggcatggtgatacatgtctgtaatcccagctactcgggaggctgaggcaggagaattgcgtgaacttgggagacggagattgcagtgagccgagattgagccactgcactccagcctgggcgacagaccaagactccatctcaaaaaaaaataaaatatactgtttttgaaaagctttcatgttaatattccattgacagtcaatggacttttccctattggtggacatttagcttggagtacctgcatacacacacccacttaaggaaatcagcctgtgtgtgtgcacatttgaaatgtgggcgtgtcttttttttccttctaaagctgatttcactccatcacccaggctggaatacagtgtgatcatcgcctcaaattcctgggctcaagtgatcctcccacctcagcctcctgagtagctgggactacagatgcaccaccacgtctggctaatgtttttatttttgtctttataaagacaggtctccctgtgttgcccaggctggtcttgagctcctggcatcaaacagtcctcccacctcagcctcccaaagcgctggaattacaggcgtgggccactgcgctgggaccatctttttgttttatcttcccaaatcaaagtgtcttctggccttttcataaatatgggtttcaggcccagcagtaactcaagcagcccccttgaagggtagtgttcatgcacttcaatcagaaacactgctctggtcagaacagacaggggatgtccctgcaggctgggactgctcttttgttccccatggacgtctttttttttttttttttgagacggagttttgcccttgttgcccagtctggagtgcagtggcttcgtttcggcccaccgcagcctccacctcccaggttcacgcgattctcctgcctcggcctcccgagcagctgggcttataggcacccgccaccaagcctggctaatttttttatactttaagtagagacagggtttctccacattggtcaggcttgtctcgaactcctgacctcaggtgatctgcccacctaggcctcccaaagtcctggaattacaggcttgagccactgtgcccagccttatggacgtcttcttgtgtttttccttttgtctcgtggaaatgttcaaatgtccatggaaagagagggcatagagccctgagcccccaggtcatcccctctgcctgggtcatcagcctgtagccccgtggcagcagtaccctccccagcttcagggagagcaaaatcacctctgtctttctcccactcggcctctgaggtgggcacctgggctcagggaggtctgttcgctgggccagggcagggggacaagtttctgaccgtctccaggcctgctccagtggggagaggcggctggcaggaaggtaggggcttggctgagtccacggggtgggcccaggccaggcgcaggggtgttgcatcctctagaagagtcagggccctcccattttcctccgtaatctgctgcccacagtcctctcgtctcctctccatggaagcgctaagctgcggtcctactctgccttctcctaaggaaaccagagggcagggctggcccactcaggggaggccagtcaggaggacgtggactcccatggaggccgatgtctcacacacacagaaagcgcatgcaccttgagtgtcagcccctgcctcccgcagcccaccccgtactcctctctaatccccccttctccaagggaactgccatcctggtgcccacctgtgtggaccaaacacaacctcccacaagctgcatgtggcctctggtcactgatctgcagcac

SEQ ID NO: 13602 - DNA, 16429 bp, Human; identical to SEQ ID NO: 13601

SEQ ID NO: 13603 - DNA, 16429 bp, Human; identical to SEQ ID NO: 13601

SEQ ID NO: 13604 - DNA, 16429 bp, Human; identical to SEQ ID NO: 13601

SEQ ID NO: 13605 - DNA, 4916 bp, Human
gtctgcctcggcctcccaaagtgctgtgattacaggcatgagccaccgcacccggctgactaatttttgtatttatagtagagacagggtttcaccatgttggccaggctggtctcgaactgctgacctcatgatctgcccgcctcggcctcccaaagtgctgggattacaggcgtgagccaccgtgcccggccagtttatttacttatttttaagaggcgggcgtcttgctctgtaacccaggctggagtgcagtggtgcgatcatagctcactgcagcctccaactcccgggctcaagtgatcctcctgcctcagccttccaagtaggtgggattacaggaacacaccaccatgcctggctaattttttgtagtttttgtagagatgggggggtctcactatgttgcacaggcgggtctcaaactcctgggctcaagtgatcttcctgccctggcttcccaaagtgttgggattacaggcatgagccaccgcgctcaggcaaggcaacttctgacaatataattgtgctgtgagcgaggtaaagccaggcttggagaaggctccgattgatgatccttgggtcggggcgaacagtgggtcctcaaacagggcccacgtttcaagtcctggaaaacccacctatcttagcgggcaggtatatccgatgtctccgttgaaggccttcagtgaggtggcttcgtctcttgaggtttatgtccaggatcagggctgctcttccactcggggtcacaacctctggctcaccaccttgtcaggagccagcccactaagtcacgtttcaggcctgaaaaccaacaacaaaagatccgtaaagacagaaatcctgggactggctcctaacaacggccagtgacaagctttgtggcagtgagcagaggtgtccctcaggctcagctcagtctctgtgggttgcaggacctgcccttggaggtgggcctgggtgggaggtcttagggccccaggacctgggccacctggggctttttttttttttttctttttgagatggagtcttgctctgtcgcccagactggagtgcagtggtgcaatcttggctcactgcaagctccacctcctgggttcaagcgattctcctgcctcagcttcctaagtagctgggattacaggcgcccaccatcatgcacggctaatttttgtatttttagtagaggcggggtttcaccatgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcacccatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccaggtgagcatctgaacaaggggcagtcggccagggtgggcttgcgggagtccccaccttgacctctctcccttccagctgcccagagcccagaccaagcatggacgccgtggatgccaccatggagaaactccgggcacagtgcctgtcccgcggggcctcgggcatccagggcctggccaggtgagctgtcccctctcaccttcctgaccccggcccctgagaccactgttccaaccgtgtcccctgcctccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcgggtgagcccccacctcacagtcaaggcgtgtgccctgggcatggggcgacagaggatgctgagatgcggagacggggactcctccctaagagctgctgttaagaggcgcctgctggggcatacagccccagtgctctgcacagcgtcttgggggtttgggtgtgctacccaccacccccagtcaccacctcctgtcccagccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtgggtggctgcgcggggggccccctccccaggcagttcctcggccgtgccccctcacggccctctgttcccaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagaggtcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacacgtccagcgggcccagtgtctacattctggtgagcggcccgaggctgggagctctgggcgggggcagaccggcggggccttgcagcaggggtgggggtaaagtgcgggtggtggtggagagaacagggctgtggctggaccccagcactggtgacacgctgggtgggagcatgaggccccaggctgctggaggtcctcgcccggggaggtggaggccgttcctggtcaggggcttcctgaggcccctggggcatgcagaggccagggttttagttaaaagtttaatgtagttcccaaatacatttcatatgacaatcttacataaatgttccaaaacacatgggcgttatctcgttgtactcgtcactagctggctaaggcttaaagcagagacgtgtgactgggtctctcgggagggcctctggttcttcccgggctcaggcttgctgggggctgggggccagggctctggcgacctagaggtgtggacggcacagctgcaggaggccttctcttaaccctccgagagtgggactgggagatttcctctgaagtcccaaagaggccctgtgcccaggggacctcctcctcggcctcccaggtgggtggtgcaagctggctcttggccatgctccaggctcgggtgggcacaggcgtccactccagtgtgctgcgtgcttgtgagactgcctgttctgggaccagcccctgggctcttccaccaagatttggtgagggtccccctctgcctctcacagaagcccctggccctggactgtcctgggggcagggacacctgtggctggggaagggatggccaacagcgggaagcagtttgcgcctggtgcctgatgatggtgaaccacgtgacagatggagacgggagtcaggggaccctggggacccttccaggtccagtgaccttttcccagacaggcactctccaggcctaggacagacagggccccaactcctcatcaccccatgacttggcctggaggaacctggggtgggaaacaagtagtcccccaacctcagaggccagaaccacaggtgggggacagggacctcgacagagctgtgcctgctcaacgctcgagagcatcttaacctaagaaaccaaaacaaagccttcgaaaataaaaagaaaaaaagatgtaaaatatacacccccaatcagagaggggaagtgggaaatgaagatagtagttaacagcacgtccaatgggcccagtgtctacactcgtacgagcagccccccaagctgggcgggggtcccaggcctatagttggggagccctgggcaggggcagagggctggctgctccccacaaaggcagggccccacagcagggtgggaagggtgtgggtggcggagaagccaggggctctggctggacccagaggctggcgacacgcggggtgaaggaacgaggtctccagtcccagtg

SEQ ID NO: 13606 - DNA, 119982 bp, Human
atgtttgtgtggactgagcccctaggtaaaatgtatttcctgctgtatgctgtggtcaaaaatgtttgaaaaccacccatctagtgatcaagagcatggactttggcactagactactagggttccgatccctcacaagctgtttgacactgggcaaattcactcattctttctgggcctcagcttcctgatctgaaaaatggggaaaggccgggcatggtggctcatgcctgtaatcctagcactttgagagtccaaggcgggcggatcacttgaggtcaggagttccaggccagcctggccaacatggtgaaaccccgtctctactaaaaatacaaaaattagctgagcgtggtggcgggcgcctgtagtcccagctacttgagaggctgaggcaggagaatcacttgaacccgggagacagaggttgcagtgagcgagccagatcgcaccactgcactccagtctgggtgacagagagagactctgtctcaaaaaaaaaaaaagaaaaaacaaaacaaataaaaacggggataatgcctagcatctttctaaagatgcgattgtaagatttaatgagtttgcatatttaaaaaatgcttagatcactttcaggcacatagcaatttaatcagtgctcactaatatgatttcttgttgaatgaatgagtggggctgaagcctaatctcctgccttttctcagtacaagttgttttctcctattcttccagccccttgtctcgaataactatatgtttacctctttattctgtttgctgtcaatgttccctcactagaataaaagttctatgaggatctgtctgtttctgtcctactcgtagctgaatctaccagcttgagaggagggctggtgagtttggcaaacattttctgtaaaggaccgtatagtaaatatcttaggcttcgcgtgggacatgccgtctttgcgcaactactccactccgcccctgtagtgtcaaagcagccttccaagctgttcaaggaaatgggcgtggctatgttccaataaagctttatttacaaacccaagcaggcagaatttgacccgcaggccgcagtttgccaatctttaaactagttcaaaatactgggcccaatacaataaaagagagtctcctatcaggttcacaccccacaaaagctccttttgatagtttctttttttttctttctttcttttttttttttttgagacggagtctcgctctgtcgcccaggctggagtgcagtggtgcgatctcggctcactgcaagctccgcctcccaggttcgcaccattctcctgcctcagcctcccaagtagctgggactacaggcgcctgccaccacgcccggctaattttttgtatttttagtagagacggggtttcaccgtgttagtcaggatggtctcgatctcctgactccgtgatccacccgccttagcctcccaaagtgctgggattacaggcgtgagccaccgcgcccggccgatagtttcttttaaccatgtaaaaaatatatatatatttaaattttcagctgggggtccgtgaaaaacaggcggcgagcgagagtttgctgacccctgatcagactgttcccacatgtcccacactcctcctgtggggtaaacggagtcccttgggtcccctaaaactggactttcccaaaacgcgccaccaacccacggcgccgcgcgcgcgaccggttcgccaaccctctgagccgcgcgcgcctcccgccaagacccgcccctcttcgcggccattggccgagtctcgcactctttttcaagggggaacgcctcctccttccgacagactctgcagacagccaatggaacgccgtagggtctcgcgccccgccctcttgggggcccgttggaggcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccaggtgaccgatgcgaccgccccgggcccagcccggccggggagtgtggggggcggcggggaccccgttcgggggccggggggcgggcagcacgtccccgccgctcaccccaaacgtccgggtggtgcgcccgcgggacccgcctccgccaccccgtccgcgcgcgcggcggagtttggggggaccctggcgacgtccccactttccttattgactgaacgcgggggaggtgcggtgccgtcgcctcactttttacaaaacttcctgaggttggggcgtccggggacccctttctcacgcttaccttcaaactcgctgagttgggggcgccccgggaacgtctctcaaactcctcaaactccctgaattgggggcgcttggggaccctcttctcaccttaaccccctagatctctgagttgggggcacccaaggacccctcttttactcataccctcgaattttctgaattgggggcgccaggggaccctcttctcacgtttactccccagatctctgagttgggggcacccagggacccttcttttactcaaaccctcgaattctctgaattgggggcgcttggggaccctctcctcacttttactccccagatctctgagatggggacacccggggacccctcttttactcataccctcaaactccctgaattggggccacctggggccctcttcttactttactccccaaacctccgaaattggggtgaccccagagcccttctgtcactcttagtcgcaaacttcttgcatcggggggacctcgaagactcccttctcatttttaccccaaattcctagatctgacttgtcccggggaccccctttttaatggactcccagacatactgaatttgggggcacccctggaacctttttctcattccttaactaaaagctggtgcgtctgccctggggagaacccctcttgcccttctcaccttttcatcccaaactccccgagcgagcttccccgggaactgtttctcacctttttgccccaaatcctcgcgttcaggtcgcctcggacaccccctccccttctccctgtgaccccatattcctgagtataggggttcgtgcgtccgccagtctttccacgtgcccccaagatgcccctccgcacgtccgcagctctcctcttaggactgatctggaagggagaaaagtttcaccaacgcgagtgaaactttttttttttttcaatttatttattttgttaaagaacctaaactgctccaggcattttctccgaggtagtgcgagtgcgtgtgtgtgtttgtggatttaaactccaccccctgcccccaccgcccaccagcgcgctcgcgggcgcacacacacactcacacacacacactcactcacaccccaaatgctcatttctttctttttcctccctccgagaagcctccgcgctccctcgccaccagcctccggctccgttccttttggttttcctcgctgcaccgctgggaaagttggatttcccgatcctagtggctatttcaagggcccccgagggccccaagcgcccgggccattctggcggctgccggcgcggttcatcttcctattttaacctcctggttgtgcggcaagaatggggaggggagagggcaagatggagctcgggacccagggctggctgccttacccccgcccccccaggcttcattcctactttggggtgttgttagcattgtgcctccctgcaattattttcctgctttgtatcataaatgaccagcgcaggcttcgatgagttcttttccctctcagtcagcttcatctctgtatcaaaccttgtacaagcttcattctctgtttcaactaagagttccccaacaaagtaacagtaataataataatgacacaaaacaacaaagactttttaaaaaaatttttgcctgtacatattgttgacatgtattttatctttttacatcgtgccctgaaacattgtttgcttatggaaagatccttacctcccgtccttctggataaggaggaggggggcatctgtgctttctcctgctctagtttaaagacttgaactgactctaaaataaccttagaaacgacaactcacctactctgaccagagaagtaagagtttatggtaacctccctaggaaaagaatttaagttcttgaattactagggcttcttcatcaacaggcgtggtacggaaggcaacttataatgtatgatgggaaagatcactgttctgtgattctgtgacagttcaacggacttgggttgggaatgagttctgaaatagtttgctcctgcaggaaaagcaatactgaaatattttagttttttaagttctttcttataaaccactgaatctgagaagagagagacagttattacctcaataacaggacaagttctttgaaatcacttgatctttgctttctgcgtgaagggcacgcattaccttaatgtatgtgtgatgtatatttaaatacaacaatataatataatgtgtatgtgatgtatatttaaatgtaaatactcatcttttaacattgtttatcattgaagtactgctaaggatggttctgtccaccagaaatgcaggtgctggggaattgtttatctgggtcttattccttagatctaattgtttagttttacattagcattataattaataaaaatattaaattggcttaactttaatattataatcgagtcaaaattttaaatgcacctgtggattttttttttttttttttttttttttttgagacagggtctcactctgtcacccagactggagtgcagtggcaagatctcagctcaccttaacatgcacctcccaggctcaagggattcacctgtctcagcctcctgaatagctgggattacaggcatgcacccccacacccggctaatttttgtatttttagtagggatggggtttcactatgttggccaggctagtctcaaactcttgacctcaaatgatccaaccgccttggcctcccaaagtgctgggattacaggcgtaagccaccaaacccggcccctgcacctgtggatttttgtttgtttgtttgtttgtttgagacagagtcttgctctgtctcccaggctggagtgcagtggcaccatctcggctcactgcaagctccacccccgaggtttacaccattctcctgcctcagcctcccgaatagctgggactacaggcgcctgccaccacgcccggctaatttttcgtattttttagtagagacggggtttcactgtgttagccaggatggtctcgatctcctgaccatgtgatccgcccaccttggcctcccaaagtgctgggattataggcgtgagccaccgcgcccggccggcacctgtggatttttatagtagctagtgattgttttgctcataaaatgctggggccagaaggaaccacatcttataatatatatttgtttctaaagttgacatctatttattaaatatttaaatatttttaaaatatatattgaaatattaaaacatgtatatataatatatacttatatatttaaatataataaaatttaaatataaatatatgttaaatataaaacaaatatatttaaatatttacaaacatttaaacagtatacccccataggtacccacttacttgtaaaataggaaacttttgaaaaaccaagggaagttctcatcttgcttgtcaggacactcactaaactgcaggggaggagaatgcgagtctgtgggcctgtctctgaaactatgggtccagggcattcccactaaacacagccgtatttctgaactgaactatatgaatattcacccgaagtggggaagagaaggaccataagtaacttcatgtcaattcaggccagcttttgtcaccaagtgagtccatgccaaatttacaaaaaaattgccagttttcagagtttcctggatttcagtattgttgtaaggggttgtgggcttatgtattttttaaaaagatgttttgactccgtctctagaatttaaatggcaattagctcctctgctggtcatgttctcatgttctctcatgtagacatatgcctggtgtagtgaaaggtcttattttgttggatggatggatggatggatggatggatggatggatgggcaggccgatggaatatacactgggaattagagaaaaaactgaaaaccacctacttgcttcttggaaactctaagatcagcaaaaggattctcccaggaaaaaaaatataggggaagacccagaatgaagtgggcgaaagggataagggtaggtgaaggaggagtggcaaaaggtccagagagaggccctaacaggcctatagggaactggagcctgggaagctctggactggcttaggattctaagctcttctctgcagaaaacatctatccagctgcctgctgggtacatccaggtggattctgacaggcaccttaaacttaaggtggccaagctgagcctgtcatagtccccccagatctactcctcccaaagcaccccccaaactcgttggtacatatcaactcacttcttcccattactcaggccaaacctcaggactgtccttgactcctctctcccaagccatcagcaaatcctgttgactccaccttcagtagttccccagaacctgaccatgcctcgccacctccactgccagcccctctggtcccagccaccagcatctagcccggatgattccaccactggtgctcggcagtctctcagcccagcagccagacggggcctgttaaccctgggagaggcggcgtcatgttaagttctacttcatacccctcagctcgaaaccctccgatggctcccatctcatctgcagcaaaagccaaagtcacccctaactccactccccgccaagcctaatacctctttgacctcatcgccaagctagatgccttccctcactgcacttccaccctgctggcctctggaagctcattccagctctgcctggaaagctctttgcccaggtatttggagggctggctctccgactttcttcaggccttttctcagatgtcaccaggccacccacttgagaatgggtgctctcagcctccttccctgctttctctgtctccttagcatttattcctatataacacaccataagttatacgtatttattgtattatcactgtcctcttgttagaatgtcagctcagtaagggcaggaacttctgttttattaacttcttttttttttttttttgtgagacggagtctcactctgtcaccaggctggagtgtagtggtgcaatctcggctcactgcaacctctgacacccaggttcaagcaatttttctgcctcagcctcctgagtagctgggattacaggcacgtgccacaacgctcagctaattgttgtatttttagtagagacagggtttcaccatgctggccaagatggtctcgatctcctgacctcatgatctgcccacctcggcctcccaaagtgctgggattacaggcatgagctgttttattaacttctatatccccagggctgagaagaattttggtgctgagtaggcaattgagaaatatttgtgaaatgaataaacaaatggtttccttgacacttatggggaaagcatatgtagaaatgaagagttgagagctgcattgggtgtggtggctcacacctgcaatctcagctacctgggaggctagggcaggaggatcgcttgaacccaggagtttgagaccagcctgggcaacatagcgacaccctgcccttaaaaattttttttttttttttgagatggagtctcactctgttgcccaggctggagtgcagtggcaccatctcagctcactgcaagctccacctcccaggttcaggccattctcctgcctcagcctcccgagtagctgggactacaggcatccaccaccacaactggctaattttttgtatttttagtagagacggggtttcaccgtgttagccaggatggtctcgatctcctgacctcatgatccgcccacctcagcctcccaaagtgctgggattacaggcgtgaaccaccgcacccggccaaaaaaattttttttaaattaagaattgctcataggtaccttaagttcatattgccatctctgagtcagtagagcccaaattggatgaatctggatgaatggggcaggggaaagaggaaaggaaaagttgcaggtcatagtgctgggtgttgcagaccagggctttggggcacagcagagaaggagttaaattgtggtgccaccgtttattagcttagtggctctggggcaaggtttgacatctgtgaaatcgataataatagctcgtgtggttgctatattagaaataatttctataagctatttagcacaggggctggcatctaataggtgctcagaaaaaagtaactgttgttattattattattattaggatgaagcaaataagtagtaagtggcctgggatgatcagttttttactgtggtttcctgaccaggaccaaatgctaaggaggcgtttagtacatacatcttgcttgactgagtggtcggcctcatgctgtctgttttagggtaggaaattcccttaaattaacctagaaactcatgggtactaatatgtccctctgcaaacataagtgcttcgtaagaacaaaaacagcacgaaaagttgttggagtcctacatcttggttgtggcatgggtccctctgaaatgactccccaaacatcacatttatgatgagttttggggagtggccagctctacagatgagaacattttaagactggtttcccttctctgttatcactggctcttggatgccaacacagtcagagtctggaaatgagccacttggagccggggactggcctggtcttcgtgccaggacttgagttgggcccttaggagcagacggcctggccttgctgcacctcagttgttttttcctgaaagtgcattcctgttttatgatacataggtcttgcatgtttgaaaaccctgttgtatgccctggcaattccttattcttatttttaatgtttgtgaattccatgactttctaaaaagtacagttgacttgccactgcctgtagatgatacataaagcagatagattttaaatgctgtcagtccatttacacctgctacagtccatgtttcaaagtggagaaaaagctgaaaagccattaaaaatatgtagaacttacatgtaatggtccaatatagtgattatttgtcatttattacataatgaagcccagatgtgctatatatggtaagcctatttctactaagatctctgcagtttttttggacgtgtgtgcatgtgtttgtgtatatgtctgagactgggggatgggtaattcataataaaaaacgagatgaagtctcgctctcttgtccaggctggagtgcagcctcaaactcctgggctcaagcaatcctcctgcctcagcctctcaagtagctgagattatagatgtgagccactgtgcctggccataagaggcttcttgtatttgaacttggctgaaaaattgaacagtagagacaaaaaagcaaggccgtgtgatgcggactgggctcctggcgtccagcagtttttaaggaggtgacagttgagctgagactgaaatgaggagagggaaccagcgctgtggggttcagaaggaagagccttccaggaagggggcagcaggtacaaaggtcctgcagttgtgtggctgatgcctggcgagcaaagcaaggagaggcagaagaggcaggggcaacctgcagggccttggaggccatgggcaaagtttggatgctattcgaagtataaactggatcattggtagagttcacatcagccggtacctgtcagatcaaaggtgtccagtcatttaccggaagacctgcttttcagactcctgacatttgttcatcattcattcatacaatcttcattcattcatccttcattcatttattcattgcctattttgagtaaagtgctatcctatccagttacaaagaccaaagaccaacaaggaagaggagtcagtatcaaataggctttgctagatgtttctacagggcacagagggcagacaaagtggggaggccagctgtccctggagctgaggaaaggtctgaaaagaggatgtggatctgaactgcatcttgagaatagtgttctgcaggcagcagatgggggagaggggtgtggccatgttttcaggactgggcggcccatgttttcatgtccccgtgaatgtgatgactatacactatataagtggaatcatagagtatttgtgtttccgtgactggattatttcacttagcacaatgtcttcaaggcttatccatgctgtagcatgcatcagaatttccttcctttttaaggctaaagaatattccattgcatggatatgccacattgtgtttccccattcatccatggatgaacacttgggtggtttccaccttacagctattgtgaaccatgctaagcagagatctcaaagggactcttaggtagagggagaacctggacagaggctcaaaaggcaaaggaggaaataacttcaagaactgagcaccatgaagagtgagatccaatggcaaccagaaagattagacttgcccaagtcccatgtgaaaaaggattgggtccccacagaaaggcagaaggcttgactcatgaacgcctgtctcctggaaaactgttgaaattataccaatgatatagaagtccattcctaaagctgcaacagcacttaattatacttttttaaaaatgcaaactgtttatcttttagaaactgtgccatgtttccaaggatacatttctgtccaaaaggtgatctgtggggaaaggccttagaagcagtttccaaaaaaattaccagcccacaaaaatgtatgcgggctccacccaggccagtggaaacccaaagaaaataacacgaaggcctttttcccacctctcctgtccttctcagaatacatacagacagatgtagcctgccttgagaaaaaatatatttggaattccagacccactgaaaacagactaaaagatgtgcttctgattttaaaaggaattattcgttttcttgaagaattcaccctactagggacttcagtgaggagctctctggggtctccatccatttctttagaaaatatttgtgggcctgaaatatcaaacatctgaggagcttataattagttaagcatttacgtgtattaatatatcgtcatgtggacagttgagaggggagaaggcactagacaaatttaaaattgttagaaaccattggcaactgatattcagagcctaagttaaaagcaggatatgtctcaggagcaaatcttttgtgtaaatcctggtatttttactgcagacctttaaaatgacagacgcgggtgagtaaaaattacttctggaaatggatatgattaattaattcaattaattaattcaattaaatcaatataattcaattaattaattcaattaaatcaatataattcaattaattgccagccttggttcacactgatgagtgtgctcattggagagactcagcatgcaaaagaaaagactcatcaatttgcagttatttaatttcacgaactgccggatggtggagtcagtagcagcggctgggccgcaacatggcgcctcccacctagacttccggtcaggaaacttccaccttcctccgatttacgtgggcctgcatgagcctacttctcttcttattctagtgccagtggcctctggagtcttggtccttcttactggaagtagccctcctctcctgttacagaggcaataattctccagccttccggtcgccgccaaagcctcctgcctaatcacttcctgtattgtctccctgcggctctttgcacagaccttgggctctgtcgtctctggattcttactgatctcttcctcttctcccaaccgccttgtcatgtctctttgagctatgtcaggaggaacggaagggcactttcttactacttttgttagccaaacggacaaactgtcccctcccctttgttgtaaccacacattcaaggcttccttcagtccagccccatctcccttttcgttgcctccctttcactactccaaatgagcttgccatactttaaacgggtcttgtactttcttatcccttctctggaatgtcatttctactgaagaaaatcctactcttccctcaagacccttctttaatcccctcttgccatggaaacttgagattttcattgaggagctaagttggaaaatataaactagagctgagtctctaccctggcactattgacatttggggccagattattcttggttggggagactgttctgtgcactgtaggatgtggagcagcctcccaggcctctacctgccaaaagcacactcccctttccccaagtggtgacaaccaactgtttccagacattgccagatgtcctgaggtgggagtgagggtgaacagaattgcctcccagctgggggctgctggactaatcaacaagaagtggcaaggactgcaggcaaattgcctcagcacttagatttagcactgcaaggccacttcgacaggtggtagtgatttgtgcgtctcatttcctattcttgattgtgacaaggttctggaggatggagacagctacccctgccacagttcccacaggctatgttgtacatagggcttcatatttaacatgtgagtgaatgaaacacatgagcccgagtgctcttcaggacggcaaggcctacatcaagatggtaaaccttcagttcttaaaaaaaaaaaaatcacgcagcccgtgcctgagatccaataaccttcaaactccatgttttcgatttgatctcaattaacattccagctctttcaatatgtacttttcctttaccaaatttcaaaagaaattttaatcaaagacccctactgttaattaatttccctttttacccagccaaaattgcaaatgaagttctttttccagaaagttcggggagcggggaggggttttataacagagctgctgctgagtctcattgctaggagctgagtacacagtggagaatatgaaatcccgaattctatgtcccagcccattgcagtggcttgatttgtctcttgttttgctttggaacttttcaaagatttcactctgttaaaaagtcaatttggaacaaatatagagctgttatgtctattagaattgtttcagcaacgaaatgtggcactcagcatttgttgaaccaatgaattctcctttttgctctgagggaaagcaaggttatagggcaagttgtattttaacccttagcttttttttttttttttttttttttttttgggggttcaagcagtttgtgaaagatttgaaagctgcatacatttggggtcaccccaaaaagtcagccctgggccacgagcagtggcagaggaagcagttacagagaattaacagagttacataaaatttactcactttgtaggcaaatatttctaaccttggctccctttcttaaagatctatttccccagctttgttccccagctcaaaagcatttcccaacacgtggatctgctaccactggatctgccaaagcagaatcctcttttttttttccagttcttttttaggccttcccagtaggctgaggagaaagtctctcgtgggtgttaaggtatctttaacccctctataacactcctgacctctcacgtttaacgaagaacagacttcaaaacttgagagctgagtgttaaagaaaaatagtaaatggtagtattggtggtcctggaatgtgctaaaaccaccaaagagacactgactcaagatcattgcccaggtggctctgacgaacttggacgaaaacgcatctcactgaagtctctatcttgcggcctctttacaggtgttattatcagccaagcacccactgcgctgtctcggtgcagggagagcccccatttctcaagttcccgcaatgtagccccacatttctagttagaccagtaacagttctcatcaggaggagaggtcgtttttaatgcaagtcaaaatataaaccactgaggctgggataaacttcaggggtagcaaagttcttttattgtttccaaatagacactctggaataaattatacatttagttgtctggttacaaagctcatagataaaatcatgtatgacgtcatttatcgagtcattcaccttctctgatctatataagaatgttcaatgctgtgtgataacatttttgattcttgtataagaaaagaagaaagagggtttttcaagaacagcagagagtgttacgttggccacagaatcaagcaaatgggcaaaaaaagcagccctcagtaaggagtagccagactttaaaagtagtgcctgttagatcaccaaggttatgttttaaaaataaagggaacctggcacagtggctcatgcctgtaatcccaacactttgggaggctgaggtaggaggatagcttgaggccaggaattcaagaccagcctgggcaacataacaagactctgtctccacacacaaaaaattaattagctgggcctggtggtgcacacttgtagtcccagctactcaggaggctgaggtggaaggattacttgagcccacgagttacttgagccgtgtttgcaccactgcactccagcctgggtgagagggtgagacctgtctctaaaataataataataattaataataataaagggttgccatgatgttacccatgggtacatactatgtgcctggtgtattacatgtattacttctaatccttgtaaaagcccggtggaattggaatgatgatcacgccctcagaagggtaaagatatcttaatgcatgtctcagtcctttgggcaggtagctgaggaatctttcctgccgctaaactccatgcaatttgcctttctccttagttgcttcccctctttgttgcttcagaaagggttgggcccagggtctaggaagaaaggcaaggcccaagtgaaagagagatgtgtgggtcccagcctgggcaccctgctcttgccagaaacccgagtagcctggaccgctcgttcttcctccccagggtctagtccaaggctgtagatggagctgtctcctctgttgcccagtgttgaaggctaggggtcatctcatcctctccccactctgcttcacccccactaacccactgccctcttttctactcactacttcctataggtcccaccacccaaactggtcttgtattgattcttccctttctgtttctgattatactgttccagttcagaccctctcatgcaggactgttaaagtaaacttccgatttcttcccttagatgaagggtatggtgctggtcctcttgttctgtgttcttccaaatctggtgcttccagctgccctcaacaatggccttaagatggtgggggaccctgggagggggagaccacatgatatggtggaacatcatggaataccaggagtgcgttgaattaaatcatgtgaactcatattttattaatgcaacatgattaaattataagaaacgaggccaggtgcagtgccttacgcctgtaatcccagcactttgggaggccaaggtgggcggatcacgaggtcaggagatcgagaccatcctggctaacacggtgaaaccccgtctctactaaaaatataaaaaattagtcgggcatggtggtgggcgcctgtagtcccagctactcgggaggctgaggcaggagaatggcatgaacccggggggcggagcttgcagtgagccgagatcgcgccactgcactccagcctgggagacagagcaagactccatctcaaaacaaaacaaaacaaaacaaaacaaaacaaaaaacaaaaacgagagtgtgcgcagtgtcaactatgagcatacgttctttaaaactgctgttgattgggtgagacagactggtacagggcttcccaataatgtgaaacctgcagggtatcacattagtttttgttttgttgttggctactcttcattagcaaataagaggaaatatctaccaagggtttaagaaatattggtagggaaaatgttttaaattcgaggaacctattcaataaatatttctgcagattggcgcaagtgccattattttatttgagcagtgcctttattttatttgagcaaaggaagcccacaggatgttttagtattccaaggaagtggggatcagcaaacattctctataaagggctagatagtaaatgttttagcttttgaggcccagatggtcactatctcaactactcagctctcccgatggagcttgaaagcagatgtagacaacatgtgagagcttgggcatggccgtgtgccaatcaaactttatttatggatgctgaaatgtgaatttcatgtaattttcatgcatcacagaatattttgattttgatttttttctaaccacttcaaaatgtaaaagccattcttagctcatgggccatacacaaacaggctagcggctgggccagatttgggtggtgggcggtagtttcctgacctctgcccctgtggtgcagtccaggggctctgactcgcattcgtagactttctccaagtggtccatcctatttccccctttattccccgagctccacccagcttggtctcttgaccccttccctgccccacacaccctccccttgtttacacctctgcctgattttccctaccccacctccagcagggtccaggacgggatgctgcccagactcccctgccccattgtttatggtaccctgttccatctggagtctgcacctgttaccttttgccacgtaaggaattatctgtgtatgtctccttttctttctcaccccatccatgcaaaacccttgaggatagaggccatgtctaactgtatttgtgggacaccaaatagagtaattatttgtcaaaattacatgagttcttactagatagagatcacatctacatctaaaaatcattttgcttactttctagtaaaatagaatctcttaaaatatttgtgaattcttaaacttatcctgagatgatttattctaagtgtcttctagatcattaccggccaataaagaaacataacacaagccacgtgtgaaatttgcaattttctagtagccgcattttatttatttgtttttatttatttatttatttgagatggagtcttgctctgtcgcccaggctggagtgcggtggcgcgatctcggctcactgcaagctctgcctcctgggttcacaccattctcctgcctcagcctcccgagtaactgggaccatgcctggctaattttttgtatttttagtagagacggggtttcaccatgttagccaggatggtctcaatctcctgacctcgtgatccacccgcctcagcctcccaaagggctaggattacaggcatgagccactgcacctggcctagtagctgcattttaaaaagtaaaaagagacaagtgaaagtaatttaataatacatttcatccaatgaactgtattgaaaatattcatttcaatatataacctatatgaaaaattattgtcgagatatttcacattcttttttgtgtgctaagtcttagaaatgttagttcggaccagccccatttcaggtgctcagcagccacgtgtggccctggcttctataccgactgcacaggtaaaggtgttaaagtcaaagcaggcacaagttttaagtcaactcttccttttaaaaggtgaccactatattggctacttactggcgtgcagatacttcatagccgtgaaaacataaggtcactgacaaagtctgagtagcgtgggtccacctgacctcagcgttgtccattttctaaagtgatcatcactggactttgaaacacaggtggtgccctccaagccacctgagtgatctgtccccagaattccctagtgaccatttcaggactttgggatcctgtgtgtagtccccataattctgactgcttctcttttacattataaaagtcttacgttttcatcattaaaaaaaaatccaaattgtaaaaaagaaaaaaagagcctctggctgcttcttcctctctcctctgcccctcccaccactaagaaaagtttggtgtggatggtttcagatatttcacaggcctgtaaaacatacatacgaattctttagtgttttttgcattgggatgtaattcacatgccgcagaattcaggctcttaatgtgtacaatttagtggctttcagtatattcacaaggttatgcaaccatcaccaccatctaattccagagtcatcaccccaaaaagacaccctgtccccattaagcagtcactccccacctcccttccccagcccctggcagccactaagccactttctgtctttgtggatttgcctgttctggaaacttcatgaaaatggaatcatatagtaagtagccttttgtgactggctgtttttagcatgatgttctcaaggttcatccaccttgtaccacgtgttggtgcttcattccttttcatggctggactaatagggtttttttgtgtgttttttttttcttcttcaaaaaagagatcttatttttctcacttttctgccacctgctcttttacctaatatttagcctgtatctttccttatcactttctactgtgtttgtgcttcattctttctactaatggtctgatattccactcctgtcctaagtacttacttagccttttattctattttattttatttttttgagacagagtcttgctctgtcgcccaggctggagtgcagtggcacaatcccggctcactgcaacctctgcctcccgggttcaagcaattctcgtgcctcagcctccagagtagctgggattacaggcatgtgccaccacgcccggcaaattttttgtattttagtagagacggggtttcaccatgttggccaggctggcctcgaactcctgagctcaggcaatctgccccactcaacctctcaaagtgctaggactgcaggcatgaaccaccgcacccggccttagttatttatttataggcattttggttataccttccactttaccgccaatgctgcagtaagcacccgtgtccaaatatatttgtgtacacgtgtgagatgtttgcccactcgcggcagggaaattgctgagcctgatggacttcctccccttggcgttagcttgccgccacttacatctgcgctccattcctactataaaggtgactttccacttttgtcctctcctgaaactacgccgcctccagcaggaccggggccacctcctcgcctccccgacaccacagggccttttttttaccacatgcgtgtccgttgccctaagtccccgtcccactccttgcctctcaggccaacacaaactctttagcttcttaacatttcagagtagcaggtcccggaccctttgacagcctcgtgaaaacttgtgtccccaccctccaggagaatgcacactgaactcacccacagtgttctgtgggccacttaggaggtgctcaaaccccctggcagcctctccctcccccggcccctcctctggaacgtgttccctgtcagcttagctctgcctatcctacagtccacgtgtgactgactcagcctcattctgtcaccgtgagctgcgcccatgctcgcgtgtgcctcttggggaggcctggctgctgggctggtttgcgcagccacaagctcatgcttgtcgcccttgactcctgcgcggactcgagcctagcaacggcctgccccgcccctctgaattccctctggacgcgtggctgtaaactctgctacctttattctccagcagagcactcgttcttctgccttctcagcggaagaccttccttccagcagcccagcatgcagcctgcggggccaccctccgtcccaagctgctttcttgggtcattgaccccctgctgccatggcccgggtttagggacttgagcccctgctctctccagcccgaggagggagctcagttgtgcagccactagatcctgttcttgaatgtcttccttgctgttatagttggcttcttcttatggtacaaattctttctctttaactctacgtaaacaatttaaaaccagaattcctgtgacctaatcctcgataaagttattcattcttaatctgagcttttctcctattttaaattcagtgaatcatggttttcttttttaacatcctttaagatttctgagacaccaacctccacagttttcctccccccactcccggatgtagaatcttctagaaactccctgctcctttattctccagggttaatgttcactgagggcttggcccagaaagtctacaattctctgactcccaaactgggacatagtctcatttcagattcctgattgtaaaatgcctacctcccgcagttcattcctcattcagtccctcggcttattctgttgatgggtctcatgtaaacacgttttgcggcttagactcagagttcctgaaacagatttccccacacctacttctctcccatcactcgagattttcacaaacagtctgttagggatcgtgtccaacagatattgttgtttgttactgaagtttatttctgaaaatgttcgaattgtactttgtacgttctcgtgcctaattttctcataattatgagaatattgcattttacttctcctgaggtgaggaatgcaggaatgcttttagtctctatatcattgtttctcttcgtggctggcatttgccagcactcagcgtcatcttcttttttcaattgtgataaaattcacatacaattcaccttttttttttttttgaagatagggtcttgctctgtcgcccaggctgcagtggggtggtgcgatcatggcttattgcagcctccaccttctgggctgggactataggtgcacgccaccatgcctggctaattttttgtagagacaaggtctcactatgttgcccaggctggtctcaaactccgggattcaagcaatccccagcctcagcctcccaaagtgctgggtttacaggcatgcgccaccacacccagcccaaaatttaccattttaaccactttaaaatggttttcatttggtggattttaggattttcacagtgttgtgaagccatcatcactctctaattccagaacatttccatcaccgtgaaaagaaactccatacctattagaagtcgatcacagtcccctactcccagcccctggcaaacaccaagtctgcttcttgtctatgtgggttttcctattctgaatatttcctgtaaatagaatcatacaatatgtgacctttttcgtgactgacttctttcacttgtgtgtatataaatatatatttaagccctggaaggttgggtaatattgttttgcagttcatccacattgtagcctgtgtcagagcttcattcttttttatggctgaatagtattccactccatgggtggaccacatctgtttatgcattcatcccttgatgggcatttgggttgtttctaccttttgactattacgaatagtgctgctatgaatatttgtggacaagcttttgcctggacatatagcttcatttcttcagggaatatacctaggagtggagttgctgagtcgtatggtaactgcaagttaactgccaaattgtcctttcacagtcccaccggcagggagtgagggctccagtttctccacatcctcaccaacacttttatttttccctgtttttagtataaccagcctcgtaggtgtgaagtggtgtttcatggtggttcttatttgtgtttctgtaatgactgatgatgctgagcctcttttcatgtgctttcatctgtctatagctcttctttggagaaatgtgtattcttttttttttttttttttgagacagagtctcactatgtcacccaggctgtagtgcaatggcgtgatcttggctcactgcaacctcacccggctgagaaatttgtattcaaaggtgttatctgggctggcatggtggctcatgcttgtaatctcagcactttgggaggctgatgcaggaagatcacttgagctcagtagttcaagaccagcctgggcaacatggtgaaaccctgtctctatgaaaaattcaaaatgcaaaaatagccaggtgtggtggtgtgggcctctggtctcaactactccagagggtgaggtgggaggacctcttgagcctgggacgttgaggctgcagtgagcgatgtacatgccactgtactccagcctgagtgacaaaagcgagaacctgtctcaaaacaaacaaacaaacaatccaaagatgttatcttatacaaacaatccaaagatgttatctcatataataattttctctaatccacaagtttctgttcctctgtgaaatgcccaaagaccctgaatcatgaaggtccccagcacatgtaagagctacacagggtggtggagggaagggagggtgacagttcattcagatgctacaacaaaaatattagagactggctggcttctaaacaacaggaatgtgttgcagtcagctctggaggctgggaagtccaagatcaaggcactggcagattcagtgtctggggagggcctgctttctggttcggcttctgccttctagctgtgtcctcacgtgatggaaggggcaggggaggtctctggggcctcttttgcaaggaccctaatcccattcctgtgggtgccatgctcatgacctaatcatctcccaaaggccccacctccagatgccgtcatattgggggttaggtttcaacatgtgagttttggggggacacaacattccaaccatagcacagggtcagaatccagaggacatgagggctggcctcccccttccctgtgacattgctccagctcctgcccgtgcacactcccttttcagagactgcccaaaaccccacatcctccgccactgagatggagacaggacaggagtgttggtcttcacccccagagtgtccctgacctgctggacgcagatttctagcgtggttatttgtcattacatgggctatttgatacctgcccttttatttatttggagttattttaggctctgttttaaagacatgagtccaaacatctgagtctaatacagagtgggcaaactagcccatgggctaaatccaactcactgcctgtttttgtacagcccatgaactaagaatgcttttttcctacatttttaagtagttggaaaaatcaaaagaagaatattttaggacatacaaaattatctgaaattcacatttcagtgtccataaattgtgcttgcttcagcagcaaatatactaaaactggaaccataaataaagttttattggcacacagccacagtcatttcaccctacaatggatggggttgagtcatcttgacagcgagcgcttgacctgcaaaacctaaaatatttactattccacattttacaaaaaaagcttgccaccccctggtctaacgcacattacttggctatatgtgactagtactcatgtgtatatgaatgtgatgctgattttgaggtttataaaaccccttaggctcttcaatggtgtttaacatatttttgctttctctaagagagagaggaataatatttactttgttatcttctccagtttgttgtaattaaagaagagtctttggctacatccatcttgcaggatgaatttcgttgccttcttatacctatgagaactgtgcctttaaaaaaaaatgctgggctggcatggtgactcaagcctggaatcccagcactttgggaggctgaggcgggtggatcacctgaggtcgagagttcgagaccagtctgaccaacagggagaaaccccatctctactaaaaatacagaattagcggggcatggtggcacatgcctgtaatactagccactcaggaggctgaggcaggagaatcgcgggaggcggaggttgcagtgagccgagatcacgccactgctgtccagcctgggcaacaaaagtgaaactccgtctcaaaaaaaaaaaaaaaaaaaaaaaaagctgtagtgccctggcccttctctgtggcattcttctttgtctttcaggccctggccagcctgggttaggcttagagcagcactctgggctgggaagggctctgtgttcaggggtcattgcttcctctttgttctcgtctctgactcaccaacatgcagctctgggtgactgtcccttgaggactgtggcttcctggcgggttaagccagttctggaagtgggtgtgcagcttatggcagccaggagtggtttctgaaattaattactgctctagatgatgatgtaaggagtgagactcctggggagaaactgcccatgtggagaaacccagcacctgtaacccatcaccttcgtatcaaaacacgctgtccacctaagaagggcgaatgtgccatggctaatcaaggaaaataatttctgtttagctgtcaaaaaagctatttccatgatatcagccctttgatttggagctgaaacctccaaatcaaaataaattctgcagcatctgaatcttttgttgtagctggattttttagagtgaaggcattgctaggaattactgacagagtccagggaggggctagaattggaatcgggcttctctgaggtgagaaagttagtggggactcgccttaatgcctggctgtggaactgatcaaggtcactggctagatgtggtaaatcagatgggcttccttgggttggatgggtggatgctagaaaaaactgcacttctctctaagtccctttactcgcctctggcaggcatctccctcctgggcttcctctgatcctcgatcctcaattcctgggcttggtggactgtgggttaattatctcctaagtgttctttgaaagcagagccaattatcagcacagtcccttcccaggctgtttgaattcctaaatacagggcagtgggagggaggagtagccacctgtggactgtggctccctgctggagacgggtgtgcgtctcgcttcgcccctgtgaaggttatgcctgtcgccctgtctatcatgagtctgtctctgcagcttgtggcttctgacccgctgcgaccatctgcctgtgctcagtccccacccaggaagtgaactgattctgtcactttcttctaaagaccacagatctgcctggtttatacaacgaagctcgtctgaattggagtcctcaaatttgtgaatttaagttttaaaagattaaaaaaaaaaagacatactgctgtagcccagtggtttttaatctttcatcagtctggatctctttcaaaatctgctcaacactgggaatttctcctcagaagaacaggcatggaagggcaaaaattacatgacaatctacgttagtagtaaacagaaaaggcagaggtgcccatgtgatgtttgtatctctgtagagttgtgtggtcagaacagacaaattccctttgcaaataatagtaaggaagcgcatcactgaaaacaggaatgagccgtgtgcgtggatgcatccattactgtcaaaggggagacacagaagtcatctaattcctgtgagcttctcttgcaattcacttttacagtgccctttccggcaagattagattcttgtgtgttattacttaactttaattatttgcttataatgcagtcatgccatgcataacatttccgtcaacagcagaccacatatacaagtgatcccataagattataatgctgtatttttcctgtaccttttctatgcttagccatgtttggagatacaaatacttaccactgtgttacaattgcctgcactgttcactgcagtcacatgctagacaggtttgtagcctgggagcaataggttataccatacagcccaggtgtgctacgtaggttgtagcgtctaggtttctgtaagtatcactctgtgatattcgcacaatgatgaaattgcctgaggttgcattgctgagaacgtatccctgtcaggaagcgactcatggccgtattttactcctgcaagggtgccaagatcattcgatggggtaaatacagtctttccaataaatgatgctgggaaaactgggtttccacattcaaaagaatgaaattggatctcccctgccttttttttttttttttttttttgagacaggatcttgttctatcacccaggctggagtgcagtggtacaatcatggctcactgcagcctcggcctcctgggctcaagagatcctcctgcttctgcctcccaactagctgggaccacaggcatatgccaccatgccaggctaatttttaaattttttatagagacgaggtctcactatgttgcccaggctggtcttgaactcctggcctcaggcaatcctcccacctcaccctcccaaagtgctgggattacaggcgtgagccactgtgcccagccaggacttttattttataacatacacaaaaattaactcaaaatggatcaaagacctaaacataagagctaaaactgtaaaattcttagcagaaaacatagggagacatctttatgacactggatctggcaatgatttcttggataggacatcaaaagcactcacgacaaaaggaaaaacagaaggattaggccatcagcgttcaaaacttttgtgcatcaaagaacagtagcaacagagtaaaaagacaacccaaggaatggaagaaaatgtttccaaatcatttctaataagaggttaatattcaaaatagataaagaatttctgtaactcagcaaaaaaattttttaatgggcagaggacttgagtagatatttctctttcttcaaagaagatattcagatggccaataagcagttggaaaggtgcttcataccagttatcattgcagaaatgcaaatcaaaaccctaataagataccacttcacacccattacgatgactgttacccaaaagaagaaagacagaaaaatgttgataagaatatggaaaaattggaactgaacccatgtgaactgttggtaggtgtgcaaaatagtgtagctgctttggaaaacagtatttgtacactcagacagggatttgtacactcatgttcatagcagcatgatttacaatagctaaaatgtggcagcaactcaggtgtccaccaacaaatgaatggataaataaaatgtgatccatctatacaatggaatactattcagccttgaaaaaggaaggaaattctgacacaggctgcaacatggacattatgcattatgcttaagaacatcatgctcagtgaaagaaatcagacacaaaaggacaaatccagccgggcgcagtggctcacacctctaatcccagcattctgggaggccaaggtgggtggtggatcacctgaggtcaggagtttgagaccagcctggccaacatggtgaaacccagcctctactaaaaatataaaattagccgggcgtggtggcaggcacctgtaatcccagctacttgggaggctgcagcaggagaatcacttgaacccaggaggcagaggttgcagagagccaagatcgcaccactgcactcctgcctgggcaacaagagcgagattctgtctcaaaaaaaagaaagaaagaaagaaaaaaaaggacaaatccagtgtgattccacccctaggaggtccctagagtcatcagatccatagcgacagaaagtagaatggtgggtgccaggggctggggagggggtagggagtgagtgtttcatggggacaaagtttcaatttgggaagatgagaatgttctggagatggatggaggtgatggttgcacaacagtgtgagtgtgcttaatgctactgaactgtatattaaacatggttaaaatggtaaattgtacattatgcacattttaccacaattaatgataaagagtaattgactcgtcatatttcccagcattactttactaggaggcatatgctttttatggtttgcctctagtaagtccctacgctgtcctgctaaagcagaggatcacagctttaataaagaccctaaatatttatcttgcctgtggtcatgtatagctgaacaatgcacagcgaactcatttagtttccatgcgcttaactgggctaactctgcttttgagcctaatggaaagcttggggcaggtggaggaccggttctttagcactcacagacgattcccacaccacactcccatatccggtcttctctgccgagaattctccctgcccaagaggtctggggtgccctggacacgtgtgctcatctcctgtatttggagatctggggctgggaagagaatgtaaagcaacctaaacagtaatttaagaatggagaaaatgggactaaattattcagacacgtttgagtgcctactcgctagcaggcattttccgctgcctataattatgagtaagacatgttcccccaaaggccatccaagataggggtcacagcctgggcaagatggtgagaccccatctgtacaaaaaattaaaaaattacccgggcatggtggcacatacctgtggtctcagcttctggggaagctgagcaggaggatcacttgagctctggaagtggaggctgcagtgagccatgtttgcaccactgcactccagcctggatgacagagcaagacccggcctcagaataaataaataaatgaataaaaattaaaaaaaaaaaaacgggtcagcagactacatctagcacactactgtgggtttttatttttgtttttagtttccacgagttgagaatattttttgcgtttttaaatgattggaaacaagacaaaatattttgtgacacatgaaaatgatatgaaattaaatttcagtgtccataaataaagatttattggaacagcaccagcaccagggtcagaactagcatgaggcagtgaggccctcgcctgggatgcaaaatttaaggcagtgcctacaaaaatccacagtcatcaagatacacaatgttttaatgcagtattttaaaaaatcaaaataaatgccaaaaaatttcatgatgaaggccgggcacagtggctcatgcctgtaattctagcactctaggaagccaaggcgggtggatcacttgaggccaggagttcaagaccagcctggacaacagggtgaaaccccgtctctacaaacaatacaaaaattagctgggggtagtggcacgtgcccgtactccctgagcccagggaggttgaggctgcagcgagccgtgtttgtgccactgcagcctgggcaacagaatgagaccctgtctcaaaaaaataatgggaaaaaaattccatgatgagcaaaatgttgaaattttacataaagacaggatcagcactgctgcttctttttcctctttgccccaggctctagcatggctctgaaaagcgctgagtgcagcggccacactcactcctcctactgtccagaggcagagttgagtagtctcaacagagacctgcaaagccaaaaatgtgtattttctggcccttatagaaagttttccagtggctaacacctgtaatcccaacactttgggaggccaaagtgggcggatcccatgagccctggagttcaagaccagtctgggcaacatggcaaaacctcatctctacaaaaaatacaaaaactagctgagagtggtggtgcacgcctgtggtcctagctacacgggaggctgtggtgggaggatggcttgagcccaggagttagaggatgaagtgagctgtgatcgcgccactgcactccagcctgtgtgacagagaaaggctctgtctcaaagaaaaaaagaaaactttccaacccctgatagacatcaattcaggagagaaggaccctcctcttactatattaatccccagcaatgactataaccaaactagattcaacatctggtccatttcccctgtctaccattttttttttttttttttttgagacagggtcttactctgttgcccaggctggaatgcaatggaacgatctcagctcactgcaacctctgcctccttggttcaaatgattctcctgcctcagcctccctagtagcctccctagtagctgggattacaggtgtgcaccaccacacccagataatttttgtttttgtttttgttttattttgttttgtttttgagacggagtctcactctgtcgcctaggctagagtgctggagtgcagtggcatgatctcagctcactgcaagctccgcctccaggttcacgccattctcctgcctcagcctccagagtagctgggactacaggtgcccaccagtacacccagctaattttttgtattttttagtagagatggggtttcactgtgttaaccaggatggtcttgatctcctgacctcatgatctgcccgcctcggcctcccagagtgctgggattacaagcgtgagccaacgcgcccggccaatttttgtatttttagtagagacggtgtttcaccatgttgaccaggctggtcttcaactcccgacctcaggtgatccaccctcctcgacctctgaaagtgctggcattccaggcatgagccgccgcgcccagccctccatctacctttatatgtacctgtttaaaaaagtgagtgtacactcaaattatttaatttttggataatggtacatgtaagccaatagcaattaacactgaattaataagcatgctaatgtttgtgtgctgtgatgatttactgagagtataattacctgcattaaaaatgtatagaagccatcatttactttcatgttaactaaatgcttaattatttaatccttcatgcaatgggcttagtgttacttggtttgtttataaaatgatatgattccttccccggttccacagacaggtcttagaagcataattaattattctttttatttgtttaaaatagagacagggtcttccttttcggcctggttggcctcaatcaatcctctcaccttggcctcccaaagtgctaggattacaggggtgagccaccatacccggccgggaagcagacttattatgaacttttttaaagtagtgaatgtctttgtcttggttttcctgcattcactctttctgtctataatctaagaagagtgctcttttaaaagatgtaagtcagattatattgtgcctgtgggttgagcctcctggggcttcccttagcaattggattttttttttttttttttttgagatggagtcttgttctgttgcccaggctggtatgcaatggcatgattttgactcactgcaaccttcacctcccaggttcaagtgattctcctgcctcagcctcccaagtaactgggactacaggcgtgcatcaccacacccagctaatttttgtatttttagtagagatggggtttcaccaggttggccaggctggtctcaaactcctgacttcatgatccacccacctcagcctcccaaaatgctgggattacaagcataagccactgagccccgacagcaattggaattttaaaactccagacatctgaccttgtccagggcctctgctgctgcaagacctttgcacagctattcctcttgcccaggctgctctctcccacatcctcccaaggttggccccttctttgcagctgtcaggtcccagctcagtgccatccttagtgccacccataactggctatcaagaggggagccctctccaccaccacccctggctctatccctctgcaatcaccttgcaccacagcccggatctctactgaacaaccttgtgtatctggaaccttgtgtattcttgcctgacaaggatactggcaccctgagagcagcactttcatctgacctgctcaccttagaatcctcaggctgggtgtcgtggctcacgttttaatcccagcattttgggaggccaaagtgggaggattgcttgaagctgaaagttcgaaaccagcctgggcaacaaagcaagacctcaccttctctctctctctctctctgtctctctctcacatacacacacacacacacacacacacacacacacacacattaaccaggcatgtgcctgtggtcccagctactcacaggaggctgaggcaggaggaatgctttagccctggagttagaggctacagtgagttgtgatcttgccactgcactctccagcctaggcaacagagcaagacccatccctaaaaaaacagaatcctcagagcctagaatggggctgggcactcagtagatgcacctggtttttctttttttttttttaatttatattttaaatctacatacagtcgtgtttgcctttttaggtttgctgttctatggtttttcacacttgcatacttttttttttttttttttgagacagagtcttgctttgttgccaggctggagtgcaatggtgcaatctcagctcactgcaacctccggctccctggttcaagtgattttcctgcatcggcctcccaagtagctgggactacaggcacgagccaccatgcccagctaatttttgtatttttagtagagacggagtttcaccatgttggccaggatggtctcgatctcctgacctcgtgatccacccacctcagccttccaaagtgctaggattacaggcgtgagccaccacacccagcccacttgcacagattcttataacctccatctcaaacaggatggagagcaagtccaacctctctctgtagtcagaccctggccccattcttagcctctggccaccatctgctgtccctttctatagctctgccttttccagaatgtcgtataaatggaaacatacattgtgcagcttttgagactggctacattcacttggcataaatgcctctgggattcattctgtcattgcgtgtgtcagtcgtttgttccttttattgctggagcacagtccttgtgtgatcctaccacagtttgtttgtctggtatattttctcttcatgatggatgttgaattaacatgaaaacctctggttgtaagagcgacagcatactctagaccaagtacactaaatcgcagtgatactccctgcacaaacagccattctgtttggtaatttacaggattacagtttggtaatttacaggaacctgcatgtcttagaatgtttaccaatgaattacaacttttaaaatgatatgcaagtaatggccgggcgccgtggctcacgcctataattccagcactttgggaggccgaggcaggtggctctcttgaggtcaggagttcgagaccagcctggccaacatggtgaaaccccgtctctactaaaaatacaaaaattagctgggcatggtggcatgtgcctgtaatcccagctacttgggaggctgaggcactagaatagtttgaacccgggaggtggaggttgcagtgagctgagattgtgcactgcaccccagcctgggagacagagcaagattccatctcaaaaaataaaatgatatgcaagtaatacaagtaacattctcctgggaaggaccaccatctacagcaggagattcagaaatgaaaatttctcttttcgtctttctgtctatcccacctcatatgaggtaagcactgttagtcatataacttgtgtccttctagatctttttaaggcccctttacctattttatagtatgtatagctggggttttttcaacataaatttattctgcaaatatttgagagcctactgtgtgccaggcactgcagatgttggctttctttcttggagacggtacctcttctttttaatggcagcatagttttagagctaggatgcaccataaggtacttaatgattttcctgttgatgaacatttgtttctaaatttttatgacttaaactaatgccactggggacaggtcgtcaatataccttttttttttttttttttacagctgtgctgagatctgttttacataccgtaaagctcacccatttgaagtgtatggttcagtgggtcttagtatactatcttcacagaacattttcatcactccgaaaagaagaagaaaccctgaacctgccatgaacagccacttgcccttcctcctcccagccccgggcaactgtgaatccactttctgtctctgtggatttgcctgttttgaacctttcatataaacagaatcacacactatgtggccttttgtgactggcttcttccacgtaacataatgttttcagggtccactgtccatccgtttacagcatgtgccagtgcctcgttcctttttttttttttttttttttgagatggaattttgctcttgttgcccaggctggagtgcaatggcgcgatcttggctcactgcaacctccgcctcccgggttcaagcgattctcctgcctcagcctcccaagtagctgggattacaggcatgtgccaccacgcccggctaattttgtattttaatagagacagggtttctccatgttggtcaggctggtctcaaactcctgacctcaggtgatccacccgcctcagcctcccaaagtgctgggattacaggtgtgagccaccgcgcccggccgccttcgtttatccatccatcagttgacaaacatttgggctgttgctactttggggccattaggacaacgctgctgtgaacattggtatccaagcatttgtgtggccatgcactgtttagcacatgtctacttctgcaggatgaattttgaggaggggaaaaagaccccacttatagctagctctttgtctctgactgtgtaggtttgaacatctcgtaagtcttgagaaatgcttggaggccatttcctgcagaggcacacgcccctcttgggtgggctgggggaggcagtggcagagcccagcccacctgccccagccaccagtgctcccgggttttgcattcagcccctggcacacactcatggctaaccctggtgcccttgcctgtctttgacccagcactggcgaaggaattggcaaagccaccaggttaatgatgcaagccccagaaacttgcggcatagatgagaaggcaaatggcctctccttttggagaactaaagagatttaaggaagcttgctggctcactccctctcaccggcaaggatggcactaaacacagtccgcatcaatcactgtttttgttatgcgatttatgagttgctcagccgagaataaggttgcacgtggtaggaggagttctgtgtgtaccgaggtctcatggaaggactggatttctagggaagaaaagggaaaagggagttgatgttaaaatatcatttctataacagtaatgcagtagtgttcatctagaaggagagctgccacatttggcaagatgctgggagagaaacaagtattaagtacttggttaaaatgacaaaccccacaaatatgccctggaatgaatatagctcatagcaggaggcactccctaaagggcttagcaacatcacaaatagcgaagagtttttgaaatcacaaatagcaaacagcataactgcttttagtttcagatatttaaatctgcaaaaaatcagtaaattatgtgggttacgttataatggtgtgaattacaacgatgacgctaatgaacatttatgggcattttccgtgtgctgggctggccattaaactccacactttgtaggactcctctcatttaacacaaccacccaacacagatagaagtattttctccgtttatggacaaagaaatggaagtgcagaaagatttaagtccctggctgaggtcacccagctagaaactggaggacccaggaactggacccaggcaccggacccaggcaccctcgcctagcctcctgttttagagctaggatgcaccgtaaggtagttaatggtattccagttgatgaacgtttgtttcttatttatgtatttatttattttgagacagagtctctctctgtcacccaggctggagtacagtggcaccatctcggctcactgcaacctcagcctcccgggttcaggcgattctcctgcctcagcctcccaagtagctgggattacaggcatgcaccaccacgcatggctaatttttgtattattttttagtagagatggggtttcgccatgttggccaggctgctctcgaactcatgacctcaagtgatctgcccaccttggcctcccaaaatgtgctgggattacaggcatgagccaccgcccccaacctcgtttctaattttttgtgaacaccaagctccgaaagccaagtaaaggggtgacgctgtgtatttcagagctcgatattccctctgctttcttcctctcctctgtcccctatgccagatcctccaactgttcatgacctttgaacttgagaagggacctcttttctgctttatctacacctgctttcctggtgatctcaccgaggtacaagagttgaaatgcatcttagaacctccagtgtcctagtgtctgcagcctggctcactccccgaatcctggacttgtgtacctagctgcctaggtggcagctgcatgtgggtgtcatctgatgggcatctgaggcttctgtcacccaaaactgggtgcctgattcgacctcacacttgtctctccccagaccacgggcttccccagctcagcaccgggcagctccattctctaggtgctcaggccagccccaagccttaagtcagcctcgactcctctctttctttcaccctttatgtcaaacccgtcagcaaacctggctggctctgtcttcaggtgtctcccaaatgagagcactgctatcacgtaagtctttgtcacctctgacctggttgtccagccctgacgtttgcttccattgaccgttgatacttccaaaatatctgtcagattgtgtccctgtgccctaaaccttccagtagcttcccagcacactcagagcgaaagccaaacactccactgtggcctccttgtgtctctaagtccatcttctcctcctcctcctcctcctcctccaccttctcctcctcttctttctcctcttcctccttctcctcctgtcttaatctgtttgggctgtttcagcaaaaggccatagactgggtggctgtaaacaacagacacacatctctcagccctggaggtgggaagtctgagaagagggtgccagcagggtcaggttctggtgagggcttccctctgggatgcagatggctgtcttcttgctgtgtcctcacatcacatggtgggaagccagagagagctctctggggtcccttccataagggagggcatgatcccaccctcatgacctaatcacctcccaaaggccccacctcctaaagctactgccttggggtgaggagttcagcataggaatttaaggggacacaacattcaacccccagcattcccccagctccctctggtggcctcctcacgtgacccgtgtgaccccacatgtcccgtgtgcctcagccttgccgagcaccatccctggcagagccttctcagcggcgacactttcctcacctcactctgcctctgtcctgtcactgccccaggtcaccttgttgcccctggcccatgtcgcactccacttgtgcatttgagtgtatttttcttcagagcatttgtcacctcctgctgttctgtgtccatggtgtcgtctgtctctccctgaggggtcagccccacatggtcagggactcaatctgtttcattccctgctgtgtcctcagcacttgaagccggcacatggcagatgctcagactgtgtttgttgaatgaatgaacgatggctgagtgtccaggctctgagggagtgtgttatgggcacccttcaagccccagcccctgtacccagggcactgtgtggggtgaggagatgcaccagcacaggccgggtgctaagaggaaggtggaaaggttctagcccaccttctcttctcgctgacttgaggttaggaaggggctagcttgggatgagaggaggagcttcctccacactgtggcatctgtaccccgcctgatgttccacctgaactcctgccacaagctccagatctgttcctgtaccgcacccccacccctgctacaaaaccccggctctctgtttgcccacctggtccgccgctttgggcagagctgcccttcattcattttccatcttcccgagggctgaccttggctgctgtgggtcattagtgatgaggcccagaacctcagctggggcagaacgagttcctgctacccagggccggcctgtctgggggctgcctagaagtcgccctgtggtcctctacagtcattcctgtgtgaggacgagacacacactttccacttgctggagaggagggtctgggtggctttttattggtgcattcaccctctcagatacttcctgatcagtatgagctgggtaaacagccaattcagatggctcagactcccggaagaggagcgcttagcccaaattactggtattagccgtccgcattcaacctcatcttaaccatgaaatttgcacggtaaaaaagagaatttgacttacacagaaatgcaactgtgtcttcatcgttccactctacagtaagcttcagagggctttcatccattcagccttccttctttccatctttaattgttttgaaattccatttggatggaaatatttcaaatatttattttttgtttttatatatctttttgcagtttttatggttttatttaaacacaaaacatgcacatgagccgtctactcattttcttcactgcgcagcctggcattggggttggtgactctgacggcagctgggcggccctttccacgatggttttgtttcttggaggaaacactgtgagcgatctcagcacagggagatttgttgcacatcagcacttccagctccttgacgctggggaccaggaacttccggaagccactgggcagcatgtgctttgttttttgttgctcccatgaccagtgttgggcatcaagatctggcccttgcaggcgcggtggctcatgtctgtaatcccagcactttgggaggctgaggagggtggatcacctgaggtcaggagtttgagaccagcctggccaacatggtgaaaccccgtctctaataaaaatacaaaaactagccaggcatggtggtgggagcctgtaatcccagctactctggaggctgaggcatgagaattgcttcaacccggaaggcggaggttgcagtgagctgagatcgcaccactgcactgcagcctgcacaacagagtgagactctgtctcaaaaaagaaaaaaaaatatctggtccttgaaccttctgcaaaccctattgtcaatacctctgggtttcctccagttacacttaattttgacatgttggtctgactggtgccagatgaactccttggttctctttttgacgatcttgggcttcacgaggggtctgagggcggccatgatgctgaggaggagacagctgccacctccgtaggcagcactgaagagagaggggccttttttttctcttttttctttgttatgtccttggaaggaagacttcatgtttcttttttgagagacaggatctctctctgtcgcccaggctggagtgcagtggtataatcattgctcactgcatcctccacctcctggcctcaagcagtcctcctgcctcagcctcctgagtagctgggaccgcaggcacacccaccttacccgaataatttttaattttttttctctagagacgaggtctcgctttgttacccaggctgttctcaaactcctggcctcaggcaattctcccacctcagcctctcagagcgctgggattacagacatgagccactgctcctggcccaaatatttatcttttaaaatgtatgcagaagtgaaacatgctttccaagagcagcaacaggcagggtcacccagcacccaggtggatacttgggccgccaaggcttctggaagccaggacaaatggaaagaatattggaacatggaaaggtctgaaaggtggcaatttgtccaaatctacagttgaatcagaagagaagcggtgggtcaggaagagggtgatttgagttctgtttcatcagactcatctctgtttctctttccatctctcaggcggagttagaacattccatttttttatccaaaattatcttttgctcggatttgggaactgacttaatacggagctgggaatggagacaccaaaaacagaaccagacaaagctgagggtttgttctcgcccctcctggacagcgtgagttgctcgctgctttcaggccctgtctgaagtcatccccaaccccacaccgggagaaaatgtttcctgagaaaaatgaaaacccctctcaaaacttgatggaataggaaagccatttaaaatattttacaggttttaaggtgcctttttacattttaaaaataacatttcccctcaagcttttgtattaaattgcctttctaaaacagaattgattttagtgtatcttcttagaattaattgggactaattagtttaaaaacctaaaatacctccaacatttccctctttgggtttaattctaataatgagtttaacaaaaagacccttttgctgcatcttctcagcgcacactgaggttttgctttggggttgaaactttcatggggacagaaatagaatgtccttttgtcgttctcattgggttggatggtggcatttgagacaagcaaagagatgacggatggaataaatatttctaattttgtctttcttcgcttcattttcatttcttcagagatccctgggtcttgctgaggggatctctgacttggcttgattttctgtcccgggccaattgagatatgtctgtgcctcaaagatagacgatcacttaaaagtaccgacaggatctttccctcccaaagacaggcgagacctcctcccgtcaggctgagtccattccttgtctggagccagggagctctgcttcccaaactctcacagcaagattcctggcctcactcatttgtcttgcattaaatttccttgcaatcttgcataattcgagcatgacttagcaagaaatgcatttttaatatgtgactctaacactttcttatttaaggatgcatgtttgtacgttgacatagcaagaaaaataggtatattaaaactcatttctaataatactcgagtgtggaaagattagccatttggcaaatttgaaaagaggtatggagtaaccataaggaaagcagtgagggccaggcacgggggctcacgcctgcagtcccacactttgggaggctgaggtgggaagactgcttgaggccaagagttcaggaccagcctggacaacatagtaggaccttgctactacaatttgtttgtttgtttgttttaagtagccaggcgtggtggtgtgcacctgtagtcctagctacatgggaggctaaggcaggacaatcactgggctgagggcccaggagtttgaggctgcagtgagctatgatccaaccactgtactccagcctgggtgacagagcaagaccctgtgtctagaaaagaaaaagaaagcagtgaaaaaggcaaatcatgtgcataaacctgaggagtggggcttctgtcaggcattgaggtgggaccatggggtgggggcaagtattggtcacatggagcccatatgtgactatgaacccagggtctgctggaggctctgatgtgaggtctgtggacctaggtcatcatactttatacccaggccctatcgtgtggcttcaagcccgtccaccctgctgagagtggaggcccccagcagccagctattgaggctggcgaggagtaaacacagggattccatggatgaagaatgggactggggaccaggacccccctccagaaggactatgacttggtgtcaccttccagggtggacactctgtcttctctcctgtactggtggatgcatatccatgcacctagccctggccaagcccacctgtgttctgcaggacatcccattccatcccatccacatcccatcccatcccatcccatcccatcccatcccatcccatccacatcccatcccatcccatcccatcccattcacatcccatcccatccacatcccatcccatcccatccacatcccatcccatcccatcccatcccatcccatccacatcccatcccatcccatccacatcccatcccatcccatcccatcccatcccatcccatcctatccacatcccatcccatcccatccacatcccatcccatcccatccatgaaagaacatccacttgcaagtctcccttctttctcctatcccagttccctcctggtaggtcctacctgctattatttctttcattttcagaaacccgctctcagtttcctcttccagctgcctccccattcctcttcctatctttctagcaaaaattcctcaaaagagccatctggtcctcctgtctccagttctgctccacttggggctctcttgaacctgctccaacctctgtggcttttgcacacacttttcccctggagctcctctgtcacaatcactggtgacctccactttgctgattccagtgatcaccactcagccccagagtcacttggttctcaggacaccacttgcttatacttctttggcctcttttcaggctcctgcttctttgggatctctaaatggtagacagccccagaactcagccctaggcctcttctctctgctcttccttggtgagcccagatagtcttatggttttaactaggtcatttatacactgatgactccagcctacatcctgtatacactggtggctctagctcatgttctctatacactgatggctccagccatgtcatctatacactgatggccccatcccatgttctctatacactgatggcttcagcccacatcctctagacactggtggctctaggtcatgtcccctacacactgatggttccagctatgttatctatacattgatggctctagttcatatattctatacactgatggctccagcctgcattctctatacactgatggctccagctcacccctcagcctgagacttatgtaatctgcctgctttctcagcatctcaacctgggtgtctaggagcctctcacactttacaccttcagaactcaactcccaagtgctctccaggcctttttcttgggtaattttcctgacctcatccttttagttgccaaaaaccttggaggtacccttgacccgtcagcagatctggctgactctacctcctatgtttatccagagtctgacggctttgcccctccatggctcacagccaggcccccctcccttgcccagattatcacattagcctccagattgctctctctgctcccacccttttccttcttcccctattctcaacccagcagccagaggggcctggttaaaatgcaagtcaaaccaggccattcctgggctcaaaccttgtgatggcttccatttaccccaagcaaaagccagagcccctacaatggcctgtgtgggcctttctccttgccttctggttcactcagctccagtttcaagccaggcattgtcccacctcggggcctttgtactggcttttccctccattaggaacgctcttccccaggatatctggacagctccgtcccacaccttcctcatctctttaatgagcccacccagggaagcatttgacaaccctttaaaaattgcaaccccttcctatcccagcactccttctgtctgcttccttttccccctggtacttgtcaccatatgatatagggtgtcatctgacgtacgacatatttttctcacttaccttgtttactgtccatatgctcctatcctcccgcatggtctagaatagaaactccatgagggcagggaattgtgttttgatgactggtcaatgccaggcccatgctatggatccaataaatattttattgaaatcaatgaatgacacaggatctctgttactcatccttctggacatggggtttggagtcctcacagccgcacctcaatgcctcccttgggatgcagcatccaggcagaacccagccgtgtcccctaagcaaagcctcccatggcaccagctgctggtgatttgacctccaggactagcattcaaggttgtcaccacatcaccacttagccatacattaacagcccaagagtctggcttcaaattcctcatctccctgcaacacagattcaaattctaacagtatagaatctgtcttcctttcttctcagggaggcatgtctattccattcctattctaggaatgactcctggatgatatcttaaaaaaacagtttctgtgcactgactgtgtctgtctcaaagggcaaacctccgctgagagctccttgaaaggtatgcttggtcatgcacaaatctatcagcattgtgtgcttttatcatccaaaatgttgacccatcgaggctgcagctacatgttgctcattctatcaaaatgttttaagatccttggctgggcccaccaaaaacaagagcactgcttagagctctgtgttccccttgaaaggtggtggtgccacttcaccctctcctggtcccaaagcctcagagaagccatgctcagcctgaactgctccaggcagaacaaaagctgcactagcttcagtttagcccttttcttttcccccttcatgggtcgagattgcccaaccatgtgcctcctctttccggagatatgtgtcccttgtgtgtcctgccatctgggggcatctgatgtggcctggcttcctcttagaaaagtcttcctctctccgggtagggagggaagagccggcgcagtgatgtcaaagatatactgtaagtccctcccggcaaagccccacaaggcatttctgacgctgagtcagtggttccctttgcacttgttccatacgtacatgatatttccaaaagtcgttttaatttggtatcaactcctctgttttcacacttttttccaaatagcttaatccatgattcattttacttcgcccagaaaacacttgtgcagctatgaactctcccacattgtttgtttgatgataaatagattctttcctcttggagaaaagggcactttctcctcccagtactaggaaggattgaaatccctcctgtgatgccctcttacctcagagagagttgttcctccttgggttttgttatttcagaacaaatatggtaaactgttttcccctcagttactatagagaagagattatttgcctttctcttagggcttctgaaaataatagattacatatttgagagggttttttttagatctggttaatgtgagatagagggggttgctccgggatgacattgtttggtttgggaagtattctcccggttgcccagcaacaggctcttggaaacgggagtggactgcgttgcccctggcaaccgttgttacttagcaaacaatgagggccgggcaaacagtgccaagactgcggactccaggttttaattgaacatctgcatatatttttctctgattaaatttgagtttgatttgccacaacaggcagacatggatccactcgggatctgcttgaaagaaccaatattgtaatgttgactcccaggctgcacaaacgcagaggccccattgaaacaaacttctggccattcgaatatgtcctagactgctctcaactggagacttattttagtcttaagtggaatttcttttttgatctaattcctggtgttcagaaaatcattacttgtccaacctactaccgtacatcactgataaatccgcaatttctggagcgcttttcagcacgatgccttcatttctgctgcctaagaatttcagaagagcaaagagttgagccctggctggctcacatgtagagacattcacagatagggttggctgagggtggaaattggacccagcaccttctggtttcatgtgctcaatgttcctgttaagaagttgggtccacccgtggccctcagtgggatgtgtatgttatgtttattaagagaggtcgcacgttcccactaacaaagtgccctgttgatgggcactttgcagccacaggttggattttgatcaaaacagcctcactcccccacctcctccgctggcaagccagagatagcgattgttgacaagggtttgttgcttaggtaaacaccacccctgaacttcattcagagcgggtgacacatttcttcccctcctcccagccccgcccccagcccccgcccccactgccagggctataaattcagaactgttagccaagacaggtttttggtgaagactttattcttcctcattcatctcgagtgcaatctgactaatgcagcaacagccgcaaaagtgccgcctgtaacagacactccagcccctcactaaaacagctcctgtggttcccgtggtgagactcgctttagttgtatggattttttttaaggacgattcactttgttgctgaatgcccccaagaaaatgttcattgcacgtttgttaccggcatttcagctaatcttaggactatttaaagtatctaaacaaatttcccaactttcttttgcagcagaaacttataatggaatgtcatttgtgttttttttggagacagagtctcgttctgtcgcccaggaagctccgcctcccgggttcacgccattcttccgcctcagcctcccgagtagctgggactacaggcgcccgccaccgcacccggctaatttttttgtatttgtagtagagacggggtttcaccgtgttagccaggatggtctcgatcttctgacctcatgatccacctgcctcggcctcccaaagtgctgggattacaggcataagccaccgtgcccggcctttttttcttaaaaaggcaagctgattagccatcagccttattagatgtgataattaggatccaatggctgcgagtgttgttggaatgaaaatgaataaggtctgacttacacaaagactcccccaaagattaaaatacattatttgtcctgcaacctgttgtaggatagtggtagaagaccactatatacttaaaaagataaatcctcccaaagaaatgctgttctaccttctacaatattattttctgcccagtccccagtttaagtaagtcatttttcaggaattagagcctcatttaaaattttttttaaatttatcattttcttatttcccatggaagtattttcccatatatcaggctttgcaatttgggcaaaccacttaacatctttaggtaagtttcttcatctgtttgatgaaagagctgggttaggtggtttttaaaggggcctctccatgctgtggttttagatggaaattcttgaatttgaactaggctctttctccgcttcttaaattccagaatcaaatcacgactggaggggaggtaggaggtagattgaaaaggtcccctatgtgatgttggtgggatccagaaagccagcctcctcctggccagaatcagtcatggagatgtggaaagaacatgcactgcctgttgccctgccctcactggctgtctctagagatggctgtcaggaggaagggtcacacaggcaggacgagaccccatccccaggtgggcacaggtgcccagtgggcgtgctgccgggtcaggtcaccaggctgagaaagcaggagatgctactgctgaggaactgtcacttgtcatttcaaggtccactcctccaccctctggcagcatgagtcgctctgaaagattttgaagctgggacaggagagggtgagtgaggtgaggcctccgcatgccaggttttcactggcacattccccatcttcatcttgaccatcagcagctgcactgcagccctgctcatggtcagaaagggagagaaacgtgagagggaaagaaaggctggtaagagaaggagaacacaaaagcatgatgccttaggaagccgcttccaagaatcctgggacaggcccctgtgctcagctgaagacgggagctggaggccaacatggtgaaggtggctagaacaggtgagcagcccggagcaggcgggctgctcattctcttgttcattgcaaaacacgtcttgagcatctttgcaggcaatgtgctacgtagggtctggggttggggtgagggatctgtgagggggctgctgagatgacatagatccagactttgttttctcaagaagggctggctggccaagaagccagatgtgaacagctgcatgacatgaagtaatctgaggggacaagcacggagagtggtttggtgaatctggaaatgctgtgtggagtaaaggtgtggccttagacgtgtggttctccatgggggtggtcctgcccccaggggacactgggcgatgtctggagacatttgtggctgtcagacaggggtcggggggtttcctggcatggagtgggtggaggccagggatgctgcccagcaccctgcggtgcccaggacggccccaccccagagtgtattcctgcccctcatatccgcattgctgaggtcaggaaagcctgtatgacatgacaagctgactggagagagggtttccccactgctcatcacttgcctgggatcccctttggagctgctggctgctgtctctctgcctccctccttcttcaacgcagcagtcactttaatcttagctgtcatgggcgggtggactttgagggacagagggctgcccagcctgcctggccctgctggaggggtcttgtccatccccaccctggcaggtgcatggaccccatcctcaccctccctgcgttgtgtgcaggagacaccagtgccagcctccggtggccctccatgcactgcagccaccttgtcactgcgagtctggaccgctgtgtgccatgctggcctccctcgattctgcagaccttagacttgcaggcagaggctagctgatcagtgaagggctggcgctcaggcctgggggtctggcaggcgtaggctccaattccgttggaatcagagggtccttgggggttgtgtggacatctcatttaaacactccatccggaatcagaggaagcccggctttccccacagagcaggcgccaggggagagtttcaaaccaagtagctggatgcatgagggagaaggcggcctaggagcaagagcgagagcggcaggacaggagggatacgagacacagcagctcacgggaggggatgtgggtgaccccagcaagggccaggcaccagaaaaggacagacaggtgacattggtctctggaaggggagggaaaggacgagcagatattgaatatgcgcgactggccagggagcgacccccagatctttacattctgaaaaacccactgctttaaacgcacagggaactgcttgtggggatagacagagggaacgatcattctaagtcacgctgatttaccttttcctcctggttactgagaatgaatgaagagcacttacttctcaactggaaccacagagggctggagaaatgtccaagtccagttcgagctcatacagtcactccccacggggactgtatcagttcatgatagctccaatagcatcaactaaattctagaaacttctaaagcaaaagctaagcttgtgttgttatttggagttctctttggcatggggttggggaagcgatttatatacagaaaagagacggaagctccacgtaggtcgggaagctgtggctccggaggctctagtcataaaaacatgtgcttcctcctcctaaaggagtgacttagccaaacccaagccaaagccagttccagtctagcctgcctcttcctgctttgtgaccttcagctcatggctcgccctttctgagcctcagttgcgtgtgtgttgtgtctagagcagaggtgatgtggtcacggcttcctcagagtcagtcagcccccacgtataccagctttgcccgcagtctggggctcggtctggccaccagctactgccgctgctgttgtccttggggttgtgtccctctttctttcggctagtttggttttttggttgtttttcattgttttgttttgttacttgtttattctttttagagacagggtcttcctctgtctcccaggctggagtgcagtagtgcagtcagcttacttcaacctcaaattcctgacctcaataatcctctggcctcaacctcccaaagtgctggaattacagacatcagccaccttccccggcccccagtttgttgttgttgttgtttgtttgtttgtttgtagagatggggcctcgctatgttgcccaggctggtctcgaactcctgggttcaatggatcctcccgcccctgcctaggacatatttcattgatcaggcacctgctgggatccacactcggggtgggcacatcagctatatcattcccttccccctcccagcccctttctcagatgaagaaaccaaggccactgccacagtcagtaagcgagtgacaagcctgggacttgaacctgaagcctggcctcctccctctgctccgggtggtcatacctccttcccagccactcggcattccccttggcatttgttcttatttatataaataatggaggttgcaaagtctttttcccccggctgcagccgactccccagtaagatccagaggcggggccgggagtaggaagggaaccaaatgttccgtttctttggatgcattctgtggggcagggctctctgcctgcctacggacagtcttcaggtgacaaggtcttgatcagccagacttgtaagtgtgaagggtaggctccaaccctctaaagaagggatcctacagacagcagaccttttcgacatcgaaatgtctggaacccccaccttggtagttaatcccttgatttagcacacacactgtctatgcggtgaaaattcttgggaggattttttgagccagggaatgagaagacattgttatcttttgaatcaccccaatgtgaaagaaaattggctgggagagggcagaggctggaagcagggagaccaattaggaggcggatgtggtggttccaggtaggagatagggaggcaggggctcactgaaatagtagcagcaggagcggaaggaagggggaggcagagatggtatcaggtggagacagcaggctgagtcaccagcgacacgtgtcccggggcgcagggagatgcccagtgccttgaacagccccctggcttaggaaacgcaagaggagcaattttggcggggggagagtttcccttggacttgttgaggcacctgaggggcgcccaggcagagaggtctgggaggcagctggagaagggagccggagtcaggtgatttgggtggtgctgggagtcctggtgccgggaggtcgtccacattgagtgtgacaggggaggggcacaagggtggaggccgagggtgggagacaagcagggaccagtgcaggggactgagaaggtatcattagggggaaaaatgaaaccagatgacaacagcacccagacacgagggaggacagagcttcgaggagcgacacgaaacactgcagagagtacaagttcagaggaggcccgaaaactgccccgtgaggacctcaagaagaacagcgggcagacatgagaatgcagagagaagacgacagaggctccctcctgagagtctggacttacaaataaaaaagaatccatatctcaagagaagataaaggataaagagcagggtttcagtggcagtggatgttctcctcaaatgggtgtgatgtgagcttgtctataagctgaaagaatggagcctgtgcagaagccagattgcaggcttgatcggtgggtccttggagggagacggaaggctctagaaccttcaggaagggggccagcagccttttcctgtaaaggaccagagagtacatattttaggcttctgctggggtctgtctcagctcctcgcctctgctgttggagcacaaaagccatcatagataatgggaaaatgggagttgaagatgcaaggaactggatgtagacagtctggatgtgagatagtggggggaggtcagcacagggaaggagttgtggggtagaaggaagtggaagagacagcatggcaggggcatggctgagagccaggaggtgcagaggcggtgtcagaaaagggggacaaaagagttgcaattttagaatggaatcttgcaaggagaaaagtacagagaaaaaaatgtactttgaggctttctcccaaaggcatgtgtgtggatgtgtgaacacaggctcccccccatcactttttactacaagaatcgttgtttttgtctagtgggaggagtcaacattcaatttaatagaaaaatgtatggagtaagaaaatgacgtgtcttctgagtggttttggccattcttctcatattatcctgcgtcaggtggtgtatgtgtgtgcatgtatgtgtgtctgcatgtgtacttttgtgtatacatgtatgtacatgtgtttgtgtgtgtgtgtttgtgtatatgtgtatgtccatgtatatttgtgtatatgcatacgtggggagtgtatacatgcgtctgtgtgtgtgtgacactctcatgtccactcctgggggacagatatccactcctgggggacagagcaccagctgctgctcggcctctagcttggtatccagttacctttcactccaatgtgttggactttagggcaccccataacctaaggagaatttccatttcctagaaaccaagttttgtggtgttgaagttattgctagaagcagtggaatcaggttgcctgccaaaagagtatttgctgggtgaaagtgtcatgaagacttggtggttttttaattcaaaattcaccctgaatttggtatattattgatggcagttaaaatcagaccacatcagagatgaggtaaccatactttagtttggacaatttttatattaatagtcaaatcaaggccaggcgtgatggctcacacctgtaatcccagcactttgggaggccgaggtgggaggattgcttcagtccaggagttcgagatcattctgggcaacatagcaagacccctgtctctacaaaaaattaaaaattagccgggcgtgctggtgctcacctatagttccagctactcggttggctaaggcgggagggtcacttgagccagggaggtcgaggctgtagtgaactatgatcgcatcactgcactctagtctgggtgacagagcaagactctgtctgaaaaaaaaaaaagtcaggtttctaaaagggaaggaacgggtgtttccactgttaagacgggggtccctggcttaggggaggccttgtcagcgcagcctgctctcagcctctgaagattagaacctgcgacttaagggcctactgggtgtctgcactcccccatcccccttccagtctgcaaacagccctttctcaggccagttgtcaagggcttggttctgatccttttctagagaaaggagggaaagtttggctcctgagaagaaaacaggaacagaagcccaattcttacgaaaagaaaaaggaatttgaattctgaagatacttgatttcagagaagctcggagccagctccagtccttgaaagcccattgctacaagaggagaaaaaaaaaaaacccaaaagtgaggaatgacgggcacccccgtggcttaggcacggagggaacgatggttgcccttggtgtgcattgaagcctgctgctctggaatgtgtgggtagccttcagagggtcctgttcatttatttcacactccttgcctggctgaattgtcatgattttgcatcctgcctactctcctttttcatcttcctgttctcaccctgtctacaggcctgttttactcgggggctgtttgtccagaccccttcttagacatcacaaatccattttgaacagaggtccttctgcgccccaggggacactgggcaatgtctgggaacatctgtggttgtcacaactgggggtgctcttggcatggagtgagcggaggccagggatgctgctcagcaccctgcagtgctcaggacggccccagcccagagatggatccgtccccaatgtccacagtgccaagtggggacacacactgtcatctttggtgattatcagggcagagtaataactcttggcactgagaaccaactgggtccacagggagtaatcctggtgccagaaaggacatggttccaccatcaaggagggttcgagaatccacttttcggcaaggagatggcttggaggtgtcctccctgtgcgtggggccaggccacacaagcctgaacagtgaggacagaatcttaaaacacgcatcacttactccgaggacctggccctcagaggggagccgggagaaggaaacggacaagacttttctgggcagcctaatgacactgggagtgttaagacaagctaccaggacagaatctgggctttgaagcaactggtactcctgagagcactccgggcttgttccttcttgttcagagggaggaaattaattgctttcttagggcagatgaactctggtaccatctggaggccagcgagtaccaggagaggaggagctgatggccggaggaggccacgtgcctcccaaacaccgaggctcatcagccaatcagaatgaaggtaactaaaaccactcagctaactctgccccaattatcaccaaagatgacaaaacattgtctaaatactgatctgaactatgtgaggcaggtgacagctccatttggcatatggaggaacaggaatagaagagagattgcttaaggtcgcagtgagtcagcggctcagccaggaacgggcccagaaattgctctcagcgttttctgcatttcctttcctgacattgctggttactaggtgatgggagtatttttctgtaaacagaagcctcttccctttgtgcccaggcagattcattcatcacggccgtagtccagggctgcttctagctgcgtctctcctgtgccccctcacatgaagtcaggaagccacgggagatgttcccactggcgcgtttgactcagcagtggctccaaaaggtcaagtgcgcatctggttcacttgaatgttcgttcaaggtcaaatgagcgtttcgtggattccaaaggctggtgccggccaaggaggggaaattgcgccgctggttctgtgcttttcccctttatttcatgcccgccctgatcttggaccagatggtaaatgaaacgtgctcagcttataaacagcactccgggcatatttctgaggcacgagggagggagctttgggccagccaagcccgttggccaggcagggccaggctgggtgacaggtcgtgttgcggcccctcccctttatattggctgttccgaggctcctgtaacccagtctaagaggacacaggggaaggcagtcaaagtaagactgcccaggtcctcgccacaggaagaaaaacagaagagaggacaaaggaacgcgagaaagcaaggacggcagggcagtcactgaatgggtccaagttcccacagcagattcaggttcagagaagaagcatggcctccactcactcacatctactgtcttgcactggattgaggggttcccaaactgggtgctgcaaaggtgctccacagtgtgcgtccctgtgccctgtggactttaccttgagtacacccacgccctcggggccctgccctctgcccactctctgctgcgctctcctctgccaggtggaggagttactcaggatccagcatcaccccttctgggaggaccatgtgagctactgcgcttacctggaagcaccgccaggatcatgagccactcctgctcatcgctggtgtcttgtgtgtgtgtttgtttaactccttatcatggaaatttcaaacatccacaaagtaaatacacaatgcaatgaaacttatgaagccaccaccctctacagggtgtcagggtcctgccattcttataacacctggatacctgtacccactctccgtcctcctctccacccttgtatttttacaggcttcgttgtcattgttaaaattcacatacagtaagtgcacaaaccttagctggctaattttgacaaatcacgactccatgtaaccgcacactgtattatcatacagaatgcgtccatctcactggagtgtcccctcctgtccctttccagtcactctcgcccaccgccacctgcccccccacccactattatgatttttttttaactttagttttaatccactctactcatctactcttttggactcaacttctttcactcagcgtaatgattttgagattcatccatgcattgtgaatttcagtaattaattcctttctattcatgaagagtattccagtagtattcctctattagctttttagctatgctcttcttttccatttttagtggttgttttagggttttcaatatgaatctttaaatcatcataatctgcaatttctcgtccactctcctgatgaggaacatttgggttatttttactttttggtgactgaatcaaactgctatgaataaggctgaggtgggcagatcatttgagcccaggagtttgagaccagcctgggcaacatggtgaaaccctgtctctacccaaaatacaaaaattagccgggtatggtgctgcgtgcctgtagtcccagctacttaggaggctgaagtgggagaatcgcttgagcctgggaggttgaggatgcagtgagctgtgattgtgccactgtactttatcctgagggagaccctgtctcaaaaacaaaaaacaaaaaccaacaaacaaaaagctgctatgaacatgcttatacaagttgttattatttttttgaagagatatgtcttcatgtctcttggataaaaactacaagaggaattctgggttaaagggcaggtttaactttctagaaaactgccaaacctctttccagtgtggtcatatcattcatatctacacatgggggtgtgtgagagttttagttgctccatgtacttacaacattggatgttgtcagacttgtcaggtttagccattctagtgagtatttagtgatatcttgatatagtttgaatttgcatttccctagtgactaatgaggctgaccactattcatgtacttttgggcatctgtatatcttgctttgtgaagtaccatttttttaagttatttgtcatcttatattgaattgtaggagtttatatatatagatatagatgtagatatattaggatcaaagccctttatgagatacatgttttgcaaatatttctcccaggctgtggcttacctattcatattcttagcaaaatcttttaatgagcagaggttttaaattttggtgaaatctaatttctcaagtttttcttttatgcttatttgtgcattctaagaaacctttgtctaacctcctatgttctctctgagaagtcttatagttttagcttttgtgtgtaagtaagttcatgttctaacttgaaatcatttttatgtatggtgtgaggtaggggtcaaggttcatttattttccccaatatggatattctgttgatccatcaccatttgtttaaaagacttctttctctgttgaattgccttgacacctttgtgaaaatccagttgaggaagaaaagagctgaggctccattagaaaaaaaaatcaattgataatctaagtgtgggttatattatttatatattgttgaatttgatttattaatattttaaattatttttgcatatatgtgcataagagatattagtctaaacactttccttgtaatatatttgttaagttttggtgtcagggtttactgacctcataaaatgagttgtgaagtattctttttttattttctgatggcatttgtgtaataattcctttttcagtatttgatagcattcaccagtaaaactatatgtgcctgaagttttctgtgtagggaagtttccaataacatattcaatttttttgttatatgtattacattcacatttttttatttcatctgtgtcagttttgttatgttgtgtttttaaaaaagtgttcattttatatgttattgaatttatgggctaaagttgtttgtaatagttctctattatcattttgatttctgtagaatctctagtgatatatttcatttcattcctgatattggcaatttgggttttcttttcttatcagtctttccaggagaagttgttaattaactttttttaaatacttgctttttttttttttttttttttgagatagagtcttgctctgtcacccaggctggagtgcagtagtgcaatctcagctcactgcaacctctgcctccttggttcaagcaattctcccacctcagcctcctgagtagctggaattacaggtgcccgccattacacatggctcatttttgtgtttttagtagagacagagtttcaccatgttggccaggctggtctcaaactcctgacctcaggtgatccacccgccctcggcctcccaaagtgctgggattacaggcatgagccaccatgcctggccaagacttgcttttttaaagagcagttttaggttcacagcaaaattgacaggaaaatacagagatttcccatataccccatacctccacacatgcacagcttccctcattatcaccatcacccaccagagttgtacatttgttacagttgatgaaatctgcattaacacagcattttcacccaaagtccatagtttcctcgagagttcactgttggtgttgtacattctatggtttggacaaatgtataatgacatgtgtccaccattatagtgccatacagaacagttccagtgtcctaaaaatcctctgtgctttgcctactcatccctctctctgatacctggcaaccactgatcttttcattgtcttcatagttttgccttttccaaaatgttgtttaattagaatcatacagtatgtagccttttcagactggcttctttcacttcatagtatgtgtttaaatttcttccatgtcttttcatggcttgatagctcctttcttcttctgaaaaaatttcagttttgaagaaatattgcttttgttcattttctccattgtttgtggagtttctaatttcattaattttgttctttattgtttttccttctttctattaagtttagtttgtttgtctttctatatagctttttaaggttgaaaacgttcttaaatctttctaacataagcatataaagctaaacatctctttctaagcactgctttaggtgtgcccacttttttttcttaataattttacttctttttttcacccacaatatttgtaccagtgcccacaaattttgatacaaagtgtttacattataattcagttcaaaatattttctatttttctttggggtttattatttgacccatggattattttgaaggtgtattttaagttttctaaatatttggcatttttctaaccttcttactgatttctaatttactccactgtggtcaaagtgcatacatgctctgtataattatggtattttgaaatgtattgaggcttattttatggcccagaacatgacccatcacagtgaatattccatgtgcatttgaaaagaatgtgcaggttttgattgtagtgttctctaaatgtcaattacatcaatgtggttgataatataattcagatattctgtatccttagtaatatttctgcttagttcttctaattttgattcagtaatcaaaattactgaatgaaggatgtttaaaatctccgattatgattgtttatttcctcctttagttttgttaatttttactttacgtatcttgaagctgtattactaggtacatacatatctgtaatcaatatgtcatactgataaattgatcatcttatgatgaaattttatctgcagtaatattccttgtcttgtcaatgtctctagtattgctagtaatatttctcatctcagagtctattttgtctgattattacagccgctccagctttcttaagatcagagtttgcaggctgagtgtggcgctcacacctgtaatcccagcactttgggaggccgaggtgggtggatcaagaggtcaggagatggagaccatcctggctaacaaggtgaaaccccgtctctactaaaaatacaaatattagcctggtgtgatggcgggcgcctgtagtcccagctactcgggaggctgaggcaggagaatggcgtgaacctgggaggtggagcttgcagtgagctgagactgtggcactgcactccagcctgggcaacagagcgagactccatctcaaaaaaataaataaataaaaataaaagatcagagtttgcacagtggatctctttttattctattactttcaacctatgtgtgcctttatttttaaggagggtttcttttagggaccatataatgggatcttgattgttatccaggctgatcatttctgccttttcattcaagaatttagtctatttacacttaatatattattaatatgtctagatttagcaaagcaattctgccatttgctttctatttgtgccatctgtttgtttgtttgtttctctgttctttatttcttgcctttatttagataatcaaatatgttaagtaggatttcatttgatttctctattagctttttagctatacctttttgtatatatatttttttggttagtggatgcttcagaggttacaatgtgcattgttaatttatcacaatttatagagttaacatgttactactttaggtaaaataaaagaaccttgaatgtataacttaatttgtccccatcctctgtgttacaactgtcatggagaacatctacatatgatataaaccccacaatggagtgttataaagtttttgttaaatagttttatgtatttaaaataaattaagagaagaaaaggaaaaatataaaatatataaaaatacggttttttataattacctgcgtatttatcattttaagtgatatttactcctaatagatccaaatttaccatctggtattaattcctttcattctgaagaacttccattagcatttctcatggtaggcagaaaattttatcaggttttgtttatgcaaaaaatgtctttattccaccttcagtttttaagaatagttttgctggagatagaattctgggctgatagggttttcccccccagcatattaaaaatgtcactccattgtcttctggttgccattgttattgatgagaagccagtcatcatctgtgcccttgttctccgaatataatatgtagtttttctctgactgcttcttttaacagtttaaccatgacatacctatcttggctttctttgtattctttttagggtttgttgagatttttggacctctaagttgatatccatcacccaatgtagaggtgtttggccatttttcaatatttttttctcttacattctctttttctcttctgggactctcgttacatatatattagacagtttgttctattcatgtttcttcatatattttctcttcattcttcagattgggtaaatgctttttatctattgttaagttcactaactctttccattatctttaaccagctgttgagtgcatccagttaagtttttgtttcagttattgctctagaatttctatttggttctccttttatactttgtttcttgattgagattcccatatgttcattcattatgtatataacttcctttaagttcttgaagttatttttagtagctgctttagtccttgaatgctatctgtatcatctgggttatcttgcgtttggttataattaactgcttttcttttttctttttatttgttactctttcttttgagtgtatgttacactttcctgtttcttttcatagctcatggtttttactgggtcctggacatcattaatgatgtattgtagaatctgtaggttcatctgagttcccctgaaggcaagtgacttggctagattcaaactctccctcctgcaacaggcagcagctgaaatcttcacttaatttttttatctttgcactgctggtttttccccaagacccctggtatctcccccacacctttgtggtgtagttgcttagccaaagattcaggtgtattttgtaggaagatttgagggctcaccccttctgtggctctctctcttccagaatctccacaccccagcattcagaactctgtcctctgacccttcaggataacgaggctgatgctttctggcacccaagcatttgtggactggggcatgcccacaggcaaaaagccacagactcattggtctgacctataagacaacacatggtaaatagtgtgttaaattaggggaacaggctgggcacggtggcttatgcctgtaatcccagcactttgggaggctgaggcaggcagatcacatgaggccaggagtttgagaccagcctgaccaacatggtgaagccccgtttctataaaaatacaaaaattagccaggcatgatggtgggtgcctgtaatctcgtctattcaggggactgaggtgggagaatcacttgaacccaggaggcagagccaagatcatgccattgcactccagcctgggtgacagagcaagacttcgtctcaaaaaacaataataataattaataaaaataaattaggggaacacattcatgtgtaaatgcctgtgatgtggaacaacttgctttctggaaggtgcattctggccatggtggacagaccacggtctcgccatttatccccaacactctcatggcctcttcttacttaaataaggtctggagtttggagcaaaattatttccacctgcggaacaaggaactggtcttagtcaagtcagcattctgactttatcactggtggactcctttcacaaagagttctagtcaaattatctcctagtatcactgatgctacccgcttggcttcagacgggaacagcatggtggatggtgtgcaaatgactgatttaaacatttaaaggaaactgtaaatacaagcagcttgtaacagaaaaattccaaaggtcagttctgtcaaagacagagagtgagttgaggactcaggaaatacactatgggaaatttacaatcttttgaaagagtagaaggtaggaggtgcgggctgtgtaaggtttagttaacgccccagccaatcaccgtgtggctctggggccatctagtggtgagaagtgagtcaggctcacacagaacagaaaaatccccaggcactggccgtggggctctgggtggcatcgaaggcgtttgggaggggacgggggcgggggccggggagcggtggtggtcggggaatagtccccaacaatacagatgggattaatccagcacactcgaattcaaacacacatatccctttctgctttccttaggtaaattaatttattgtaagtttgacttttcatttttaaaaagcttaaaatttttttcactcattataagagataaaacctctgggggtgatagagaaacgtaaaagttctagcaaatgtctattgtgttctgacgatgtcgtgggcaccgcgatgtatgtctgaggttcagtcctcaccacccccagcaggcaggagccatggagaccccacactgggagggtgacatgctcaaagctggtgccaggacgggggactggtgtgcctgatcacaaagccacctccctacctaagtgtgtgtacttaactatgtctcaaatgctcaacatagccgattgtttatttaaaagtgaagactgttcgacttttagcattttcatggaacaaatttgtatcatctgccacgatattaaatgagtggttttatatagaattgtaaaactacctatttgaaagatgtatgcctctgacagcaaagaaatatatgtttatactttcttgtgggcaaagatggctttgaacagaaggcagtttttacttactgccaaaattcgtgaggacttttatccagcccaggataaaatgtactgtttctttgctccctctgcaggtcaccttttctctccctagccagtggttctcacactgccctccaggggtcacttggcaatatctgaacacatttgtgattgccacagcttggggagggggcgctcctggcatggaatgggtggaggccaggggtgctgctcagcaccctgccgtgcccagaatgggcctccaacagcaaagaagtatccagctcaaatgtcaacggtgccacagtggggaaacccagccttagagtttctcccgttgtcgtttggggtgcagtagcttcccaaatggcagtcacccacccagagcttttgatttctgggtaaatgaggaaacaattgagcccttcaaaatagttcaacctgctcagacttgggcacagagccagtgtcccggccttctgttgaggaattcctgccattgtgcgctgacagagccctttttgggttttatatttggaaaactttctctggcccctctctccttctgtgggacagttgtgcagcctgtttccgcagctcctcacttaggcagtaccaccagggtctctgcctttcgactttgaagaatgtagctggttactccttccctcccttgaacttgttagttgcctcttcggatttcagtgcttgcagcccttgcccacccaatctctctccgcctttctttagacctgagcatgcagaattccgagggtggagcggattcgccagcgtccgtggctctgcgtccctcggcggcagccccgcctgtgccagcctccccgcaggtaacgcgcgcctctcagcaacaacagggtggccacagtgtggacgcgatctctatgggtttgaaagctgctcagatctgcaaagagaggaatctgtatttttctgaatggacttctcagtcccagtgctgctgctgttgaaataggcacaatttccttaactgtatttggctttttcaatatttgttaaaaagatcccatcaaggaaacaatgacatgaatggaaaagaaaccactctcccaaatctgacttgatctcttcttagctttcagtggaggttttcttgtacttggaaatgacccttttacacagaaatgctttattaagaattaagaagtaaggccgggtgcagtggctcacacaggtaatcccagcactttgggagactgagactggcagattacttgaggccaggagtttgagaccaacctaggcaacatagccagaccctttctctaaaaaaaaaaaaaaaaaattagccaagcgtggtgggctgcacctgtagtcccagttccttaggaggctgagatgggaggatcacctgagcctgggaggttgaggctgcagtaagccatgattgtgacactacactccagcctgggtgacagagaccttgtctttaagaaataaaaaataaaaaatttagccaggcatagtggtgcacgtcctgtggtcccagctactcaggaggctatggtggaaggattgcttgagcccagtggtttgaggctgcagtgagctgtaatcataccactgctctccaacctaagtgacaaaaaaaaaaaaaaaaaaaaaaaaaaaggcaaaaaggcaaaagatgagttagaatttttttttttttttggggggggacggagtctcgctctgtcgcccaggctggagtgcagtggcacgatctcccaggttcaagtgattctcctgtcttagcctcccgagtagctgggattacaggcgtgtactaccacgcccggctaatttttgtatttttagtagagacgaggtttcaccatgttggccaggctggtctcgaactcctgacctcaggtgatctgcccgcctcagcctcccaaagtgctgggattacaggcgtgagccaccacgcccagcctagatgagttagaattcttaagattttgttcaaaatagaatctagcacctgaatgaacatattctttaaaattcgcagagagagaattttcacattcaggctttctctgctcctggatttctaccgtggaatgaaataagccataaagaagacagaaatacaaagcgaatggcaccggccacatgaaacaggctggaggctcatcacagtgtgcagaggtccactgtggccgtgtgaccacctcgatctggaatctaaaagttaggagcacagcaaaaagaaatgattatggttttaaaacacacaattcagggccaggcatggtggcacatgcctgtaatcccagcactttgggaggccaaggtgggtggatcacctgaggtcaggagtttgagaccagtctgagtaacatggtgaaaccctgtgtctactaaatacaaaaaataataataataataaattagccgagcattgtggcacatgcttgtaatcccagctactcgggaagctgaggcaggagaatcgcttgaacccaggaggcagaggttatagtgagccgagatcgtgccatcgcacttcagcctgggcgacaagagcaaaaatccgtcccaaaaaacacaaaaaaacaaaaacaaaaaaacacaattccgcaaaaacaaaaaggcagacagtgaagcggtttatttgatgtagtgtgtatggtcagacatctttagcttttatttcttgcacatatggcagtggggagggcgtcttggaagcccatctgaggtgaggatcagacgccgtcgccctgccagcagttgtggcctaattgatatgtttccgtgcccacttgaaattgtccaagaggagtcagccctcaggtcttcctgccaagcccctctctcaggctctcccaggcctaggtggactctgccttcctctgcagcagccaccatggacaggtctcagtgccactcacggccaccatgtgtgtcccaggtttcatcactgtggtccctctctgaggacttgccaggaccctgtgaattctccaagcacacggcgcccagctcacctggaatcagaatgcccttgcgctggcatccttattagcaccatcttcatccttagctccactcctgcaacacaggggatggcgtgtcctcacccatcacccctcgtgatgtatatatggcagtcactgctacctgtgacattcagggttcatgccgggaaatcacagcactgcagccaatgactccgaaagccccagctctcaataaacacacaaaacactcctgttcctccctcgactcgagttcactttgacccttcccattttgatagctttgtgtggccaatcggtactcccagaaaaatagcaaagccacactgtgcagatttgacttaggaggctggagagcagtggggtcagagagcgagggacccagacacagggcacctggactcgagtattctgtagccagaggcagcacttgagccctctggcttcattaacctcatcagaaaatggaaacaagtccgggttatactgcagaagcgaggggcgccacagagtgctctcccacgcagtggtgcagatggctatccagagggccccagcagtcccctctgtactagggacgatcagtgtcaccttgctgcagactacagacccacagaggcaaagctgcctgggcgggtgaaggtgcatgtgcttccgtgtatgtgtgtgtgcatacgtgtgtgtgtgcccacaattcgtgcatatgtgtggtgcatgggctgagtgtatgtgcacacttgtgtatgtatgtgcattgtttgtgtgcctgcacgtacctgccgtgtgtctgcccaggtcggtgtgagtgtgcaagtctgaccatcaccccgccgtcgcctctgatcagtcctgcctatgttttaataaaaagcacatgaacagacaaacagcatcttacattctgtgtgtatcctcagcactgacctctgacaagtctaactggccttctctcccttcccttttagagggtgttggtccaggcagccagctccaatcccaaaggggcccagatgcagccgatctccctccccagagttcagcaggtaccccagcaggtaatgacaagcaccgcagcaccgtgcaaaccggggcgcagttagcactcagcaatccagaacaatctctgaaggatgcatccttttctgtggctgctgttccttgttgtaagcttcagtttcttagccaaaagacttttccagaagctgtgcaattttaaaaaaatcatttactgcagatagttttgcagaaagccaagaaagctggtgatctttcgttcattcagaaattcagcaagcatttggggaaccagtgagcaccccgcacctgctgggtggagctcaggtagaaatgcagacagaaacaaagggctctggactggaggaaccatctgctagtgagtgccataccctcagatgcgggcacaacagaggaaatgcttcttatgatttcaattatctaagaacaaagtttgaaagcacggctgaccagccaagtagcaacacagatcatcagcttggggacactctagaagcatggttagcaaactgtttccagaaaaggccaaattatacatttttgggggtttgtggtccaggcagtctctggaacaaccactcaattctgccattgtatcgcaaaagcagccataaatgatatgcaaccaaatgggtgtggctgtgtgccaataaaactttatttacaaaaacaggcagtgggccagatttggccctcagggccggagtttgccaactgtgccctgcagaatcctgaattaaagttaactcaggctcctccctaaaaggagccctgaggccctagagaatgcaccgctcttcaggagggtcctgcctagattggcagtctgttcacaggcatttgtcaggtgactgtgtccatgagaactaggaaggtttgcaggatcacaggaaggaaaaggctccagacaggcccagcggggacgcagggcctcaggccagtggctctgtcttagctgctgtctgtcaaggcactccccagagacaccaaggagaggagattccagaagcttccaccacttttctggtgctgggcctgccccagctctttctgtaacttctgcatttcacttggaccccagaattcgacatttgacttccacccctggggcatcacccaacagatgttaacccctggaacttgtgattctgggggtggtgcgttggacaagtgcataccatgctcagtggtccaaggaggggcaggtcagccccatcctgcagcttcaagcacaagaggaaggtcaccatgacaccatgacacccgaacaagcccacttctgtggccctccatcttctcaccccaaaattcagtggatgtagacagccactaagatgccctctggggtgagagtttgaagtcccatgtgcaaagcgtttggcttccactgctcggactagagtccctcggggcctgtcagccgaggctctgaactgatgtttcagagaggggagggcagggcagcgggggtgtgctggggtccccccattgccccatctctccaggcatgccgctccttcccactctgttcagaccatcacattctctcccctcctctctgccagggaaggggcaccagggccacccacggggggtgttggggccatgtagagtctaatctgctcagccccctgtgcactgcagcctgcacgccagcttgagctacagagggagaccctgtcgcaaaaaaacaaacaaacaaacaaaaaaaaaaaacagaaaccagggacagtcctgtgagccaaggctgggcctctgtccacaactctagtttccactgcactggaggagcgttgtcattctcctggtcccgcccccacgtatacagaggagccagggcgcacagacacgctagcagagctctggggatcagtcgcagctccctgaactgtgtgggcccgtttggaatatgtcgtctgtacattactgtctcctcagtgtctttctaggcgtgccgactgtgggcgggaacattgtcatttggtactaaatgttcataaaggcaatagaagacacgtctagcttgaataatctgcaggcaactcacgagggcgtgactggcggtaacgcagcgtatccgatgtttcaggtgcagccggtgcagcacgtgtatcctgcccaggtgcagtacgtggaagggggagacgccgtctacaccaatggagccatgtgcgtgcttctcccgcgggccacacccggaaccctctccctgactccagcctttgccacctggggaggcatcaagcaaattcctctcccttatgcttttggcgatgtgttcactaaatactgttaaaatgctattaggaaactgggcaatatctctacaaaaaattttaaaattagccagacatggtgacaagtgcctagagtccctcccaggtaatcaggaggccaaggtgggaggatcgcatgagcccaggagttggaggctgcagtgagctatgatcacgcctgactgatggagcaacaccctgtccaaaaaaaaaaggagcggggtgggagctgagggattaggacatcataaccctgtggagatttcagaaatcacagacttttgtactttttacttttagaaaagatagtcttggaaaaaaaaaaaaaaaggctaatcctaactcttcattctgaagtctcagtctttgagatccagaaaccatccacccctgtgtgttttcccctcgcctctgttaaactccagctttgtataatgttgatagaacttgattttccatgttgcaaggatgtctagagttttctgctctgtaactgtgtgatgcttggggtaggaaagtatgcatctcccgtgcagctcactttactttagacgtgagtcctttcgcctgcttgtctgtttccatttggcctggatggctcccctcacaagtgcaggggctgtacatgagaacctggctgtgacttcagggttgtgattggtggagttgtatgattctaaccccagccactgtggcggtgcacacccatcaccccagctactgtggcggtgcacacccatattctgaggctgaagcaggaggatcacttgagctcaggaggctgaggctgcagtgagctatgattttgccactgcactcaagtctgggctacagaaggagaccctgtctcaaaaaaacaaaacaaaaaaacccctggaaattgacattggggtaaaactgttaactagcccacaggccttattcagttctaccagtctgtatgcacgtgcttttgcgtgtgtgcttgcatgtggagtacatgtggctttgcatgttcatgtgtgtacccttgcatgtgcgtgcgtgtctatttctttgcatttttagcccatgtgtagatttgtgtaacaataccaccgtcaagatacagaactgctccatctccacacaggagctccctcatgtgacccatttatccacttacaattttaagttttatttgtatttattttttttaagagatagggtcttgctctgttgcccaggctaaagtgcaatggtgcagtcacagctcactgtaacctcaaagtcctgggctcaagcagtcctcccacctcagcctcctgagtagctgggactaccggcacgcaccaccacacctggctaaatcttttattttttgtagagatggttctctctatgttgcccaggctggtctcaaacttctgacctcaagcaattttcccaccttagcctcccaaagtgctgggattacaggcgtgagccaccacgcctggcctagaatttttaagtggtcactttttgataagtcagcctgtggtcctaaagattttgcaacatggtggctgtgaacttgcgctgcatttgagtgtcatatgccacgtccgaattgctccatatgtctggcctctctgggttgcagcttttacgtgatgtttggctggatatctgtgaactcagacaaggcatttaaatgggacagcgtcccatgcgtgacttctctctttctaacagacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacggtatgtaggaggctcttgggaccagcagggtaggccatgagtattctcgaagcagcggcagcagggatggtgagtaagaggcagccggaggcccggaggggctgtcgtctgctctgggcccaggcggccccacgatggagtcgggccagcctcagacgggccacgcaaccataggcaggcctgcagagttctttgaacttcagttggccattggtataaagaggaggacaagccatgcgtcatgggctgttgtgaaaagggaatgagtcaagcatctctccactggtggatgctgcagcctcctttgctcttattattgttatcgttgttactatcaagcttttagaggcgtggatcaatccatccatgagacacctggactgaatcaagcaggggaagtttccctgcagcctctgccgagttctcgctgccatgccccgatgcaaaataacgacttatctgcttttccagagtctctacatttaaaactcgattacccgtgtttacttttcatttattttccttcttaaattaacacaaagtaaaatcaactttttggtgtacagccttgtgagttttgacatgggtagatttgtgtataatcaggtcacagaacagtgcattgccctgaaaaccccctcgtggtatttcttggcagtcacaacctcccccatccccagcccttggcaactgctgatctgttccctattgctgtagtttcatctttactagcgtggtgtataaatggaatcgtacagattgtgaccttttcagacaggcttcttttactcattctggtgcctttgagattcagtcaagttgctgcatgaatccgagttgcttttttttgttactgagtaatattctattacactacagtttgtttattcattcactagttgagggccatttggatggtttccagtttggggtgattatgaataaagaagctctaagtttcacatgcaggcttttgtaaggacatatgttttctttcttttggatatatacctacaagtggaattgctgctggctcatacagaaagtgtatgtttaactttatcagaaaccaccagtttcccaagtggttgcaccattttgcattcccaccagcaacatacaagagttcctcttgctcctctccgtcagcagcatttgatgctgctggtgctcttggttttggccattctaatagatgtgtggtggtacctcattgtggttgcaacttgcattttctttatagctaatgatggtagcagcttttcatgtgagtgtagatgctctggtcaggtgtcacttcaagtcatttgcttcttttttaactaggttggttgttttcttatggttgagttttgagaattctttatgtattctggatacaagtctcctgtcagatatgtgacttgcaaatattttccccagtctttagtgtgtcttttcattctctaaaaagtgtcctttgcagagaaaaaaaaaattttaattttgatgaaatccaacttatcaatttttcttctgtggctcatgctttcaatgtcatgtctaagaactctttgcctatttgcacattatgaagattttctcctgttttctttgaaaagttttatagttttacttttgttttgggtttttttttttttttttttttttttctgagacggagtcttgctctgtgactcaggctggagtgcagtggcaccatcttggctcactgcaacctccacctcccgggttcaagcgattctcctgcctcagcctcccgagtagctggaattacaggtgtgtaccaccacacccggctagtttttgtgttttcagtacagacagggttttaccatgttggccaggctggtctcgaatgcctgacctcaagtgatctgctcacctcggcctcccaaagtgctgggattacaggcgtgagccaccgcgcctgaccatagttttacattttacatttagatctgcttcctatcaagttaacatttgtataatgtaaggtttaagttgaggttcatttttttttgcttatgaaacaatgtgttgttctagcctcatttgttaaaaagactaccctttctccattggattgctttaacacctttgtcaaaaatcagttggccatatgtgtgtgggtttatttcagagtgtcctattccatcccattggtctgtctgcctatccctttacaagtagcatagtcttaattactatagctttatagtaagtctaaaattgaagaggatggttcctcccactttattcttcagtattgcgttgactatttatataaactcaaagtttctgtataagtttagatcaatttatctatatctacaaagaaatgctactgagattttgactaatttgcactgaaccaacttggggagaattcccatctttactatgttaaggcttccaatccatgaacatggtacgttttctccatttgtttagatcttctttcatcagcattttgtaacttatacaaaattctgtacatgttttgttagatttatatcaaagtatttcatgtttggagagctattgtaaatggcattgtgggttttcttggcattgatctttaaatttctgtttccaactgttcatttctaggatttaaaaaatggttgatttttggctctttatcttgtatcctgtaatcttgctgaactcactttttttttttttttttctttttgagacagagtctctctctgtcgcccaggctggagtgcagtggcgcaatctgggctcactgcaagctccgcctcccaggttcacatcattctcctgcctcagcctcccgagtagctgggactacaggtgtctgccaccactcccggctaattttttgtatttttagtagagacggagtttcaccatgttaaccaggatggtctccatctcctgacctcgtgatctgcctgcctcggcctcccaaagtgctgggattacaggtgtgagccacccttcccagcctgaactcattttttggttctaggagcttcttgttgcctgcaaatataactgctttatttctttctttccaatatggacaaaaagaaatttcatttctttttcttgcctttttgcactggctagcacttgcagtgaaatgttgaacaggggtggcaagaatggacatccttgcctttttcccagtcttaagggaaaagccgtcagtctgtcactgctaagtatgtgatgttagctgtgggtttttcacagatgccctttttcaggttgaggaagttcccttctttttctagttttctggaagtctctatgataaatagatgttgaattctgtcaaacgtttttttacatatgtaagcatcagcatatttttgtcttcattggggtgttaatataatgaattgcattgattgactttcaattacacaataacttcttattttggtgtaaggctcatctcctgagatagaaggtggtggtttagccttgtctctgtgtttttgtttgtttgtttttggttctggtgtgttctggggtcaccctggcatcagagaggccccatgaatcttgctgtcctctctcttcctttgtccagagtgacccccaggccctggctttgaggacaggcgtagtgccccatgcctcctccctctcttctcgggaggagtcacttgctttctagaggctgtgaaattgtagggtagtgtctgctgcttctacccctagccacttagtgcctcggtgccattagcaccccaggccaggcagccccagcagaccagacatacttctcccgcctgggattggctgggtggaactaggtttagttgttatggaacagaaagctttcctcgcagactacagtaattgtcacgaatgtggcacatttgacttagcaaacggcatcaacttataacagtaaaatagactaggattgcaagtcacaaatttactgagaaacaatcatgttctctgtggattcagaattacctcattgcagcaaacatactgctcagaccctgggccaccaccctggagctgtggtttgttatgtgggttgctctggaagaactaaattattaaatcaattagaaatccgtgaataggctatgttttcacacacacacacacacacacacacacacacacacacaccccccaccaagctctgggggagtcatcatcttggatacgaatctgattcctggcttctgactgctctgctgttgtttattggcttgttgttggcataagaacatccaacaaggatgccacagaaattcgagactttccaagagccaagaacaaccatggccctgaaattgcaacagaaatacagctgctggacccaacattggatgtctaccagttcgttcatgtcagagttttgtttctcgggactttcgcttagtcctaaagacagagcacaaacactgaagcaagtcctcactggtagcctcgacgagtgattccagactcttggtgaccaattttctcgagtatttatttctggttaaaatgtcatccatattataaatcttaaaaattagttgcccaaatggtgagtttttgatacacacgttttctattgtgctttttttcactgcgtggagcagggaaactaaagtgggagttttattcttgtcctttctgcccaagtggaacctccttttttactgtttgggttgtgtccaggggaggctgaaggtcactcaagggggaacaagaaagagacccctccaccctgggagcagccctcagtgggcccttcctcctgcaagacccagaggccacatgaggccatgctgtgaaaacacacagcctctgagggtcacacggtgggccctgacgaagacaaaaagtctttatcttttttatcttttttaaaatttttctcatactttaatgcatcttttctcattttattagtttaaatctgactaatacagcagaagatcaaaaaagtctaatggattttaattgcagctgaagttaaaatgtcctactgtactttattagtttaacaagctaaatattctgcctttgacagctttctttttgcccaagaagggtgtcttatgatacccgatacataataccattaaaagagaaattttcggtaaattaaacaagagtctatctgagcaaagaacaactctccagtcaggcagccctcagaactagaaaaggttcagagagcaccccttcctggtggtccatggaggtggctcgcagaggcccatggcacctccacgcagtggcacagctcatgacagaatcaggagtcacacacatctcttcttctgtagcctggctcttcagtgaagatgtagaatgaaaagtcacctgggcacagtggctcatgcctgtaatactagcactttgggaagctaaggtgggaggatcacctgagcccgggagttcaagaccagcttaggcaacatagtgagaccccatctctacaaaaaacttaaaaattgggctggtatggtggctcatgcctgtaatcccagcactttgggaggctgaggcgggtggatcacaaggtcaagagatggagacaatcctggccaacatggtgaaaccccgtctctactaaaaatgcaaaaattagctaggtgtggtggtgcgcacctgtagtcccagctcatcgggaggctgaggcagcagaatcacttgaacccgggaggcggaggttgcagtgagccaagattgtgccactgcactccagcctggtaacagaatgagactccgtctcaaaaaaaaaaaaaaaaaaaattagcagtgtgtgtctgtagtcccagctactaaggaggctgaggtgggaggatcacctgagctgggggaggttgaggctgcagtgagccgtgatggtgccactgcactccagcctgggtgacagagcaagactctgtctctaaataaataaataaaaataaatcacttgggtactcctaccatctgccagaagcctgctcagcccctgcatagcagagcttttgtccaatgatcagagcgaattatttgccagccaacacacgtgatgataatcgctcttcccactgcctgcctttgacattcccacactcaagatactgtttgataaaggaatgtcaccaatggcacatctgctttttctctcactatgatatttatcaccacttttttttaaaacttcatagagttccctttgtggtgcagtttgaagttgtttgtttgttacatttgttgcagctgatgatccaatattgatacattattgttgactacagtcccgttcacattagggttcactcttggtggtatgcgttccatgggttctggcaagtgtgtgatcctatcttcactttcaaagctggttttatagggtttttttttttttttttttttttgcaaaggtgggaaaagtacccaggttcacacttacaagtaaccctttgaaagatatgtttgaagatttagtctcagatttgcctgtagtgacaagattaaagactgtcatacaaaaagcactatttttcacttattctgaagcatttcaattgatttaccagacaagtcatccttctttgtctgaagtgacataacctcacttgacaagctgttaagacaaccagggacaaattgatcattgatctaataatcgattagctactgatggatctcttgagtgttgacccatttcttattttcctgttttctttcatggcaccgtatgcaaaatgatcacagtatgtgatcccagattgggtcctggtccagaggaaggacattagtgagaaaatggatcatattctataacgtccgtggattagttaagagtgttgaagttaagagtgcgcagtggctctgtaagaatcggtcctgctgagtgtggtggctgatgcctgtcatcccagtggctctaagaatcggtcctgctgggcgcggtggctcacactggtcatcccagcactttgggaggtggaagcaagtgggactgcttcagcccaggagttcaagacaagcctgggcaacattgcgaaaccccatctctacaaaaaatacaaaaattccctggttgtggtggcacatgcctgtatgttcagctacttgggagactgaggtgggaggatggcctgagcccaggaggtcaaggctgtagtgagctgtgatcgtgccactgcactccagcctgggtgacagaaggagaccctgtctcaaaacaaagaaacaaacaacagaattggttcagaaagatagccacaaaatattaagtaacaaacacaagttgcagaactaaatagagactgagggaaaataattaaagcaagtgtgaatgtgatctcatgccccacaaaggacgtgcacagagatattggtgggggctccccctgccaagtgggagttgggaggaacagacaaagggattaaaatgccccatctccctcccccagcctctcagccctgctggcctcctctgcctggaccacagcgttgggcttttcccttctccaggcctaattctatgatttaccactctgccttcaaaattccagtcattctgcttttcccttttaaaaacaatctgcattcttgggccaggcgcagtagctcacgcctgtaatcccagcactttgggaggcaaaggcaggtggatcacaaggtcaggagatcgagaccatcctggccaacatggtgaaaccctgtctctactaaaatacaacaacaacaaaaaaattagctggacggggtggcacgcacctgtagtctcagctacccaggaggctgaggcaggggaatcgcttgaacctgggaggcagaggttgcagtgagccgagatcgcgccactgcactgcagtatggcgacaaagcaagactccatctcaaaaaataataataataataaaataaaaacaatctgcattctctataaagaccccaaagggttgttagcattttaacttgaattggctccttctatggtaacatgtctaagttctgttttagaacagagggtgaattaactacagcaggtttgggagtggccctctctgtctcgtgtctccatatttgggtttttggggaatgacctcctctccctccctacaccatggccacttctagctccagaatgagctatgatcatgccactgcactccagcctgggcagcagagagagaccccacctcttttttaaaaaagaatgcagaggcatcaaactgtcctagaagtcactgtatttttcatcaccacatgctcacattctaaaagatgtttttaagagaggagagaaagaggctgggtgcagtggctcacacctgcaaccccagcgctttgggaggccaaggcgggtggatcacttgaggtcaggagttcaagaccagcctggccaacatggtgaaaccccacctcgactaaaaatacaaaaatgagctgagcatggtggcgggcacctgtaatcccagctgctcgggaggctgaggcaggagaattgcttgaacctgggtggtgaaggttgcagtgagccaagatcgcaacactgcactccagcctgggcaacagagtgagactcgatctcaaaaaaaaaaaaaaaaaaaaaaaagggaaggagaagaaagaaaggaaatactagtttcatttaagaatgtccttgatgaagcagtaaaaattattaattttattaaatttcaactcttgagcacacatctctttactattgtgtgtgatgagatgggaagtccaccagagtacaatgaccacctccaagaaaagcctgtgtgtgcttgattgacgtgtgggcagaactagccatggttttcctaaaactccatttctgcttgaaagaatgacaaactatgattattcggactcaggtatttggcagacatgtttccaaaaatgaacaaagcctgacatattaagaaaaacagctggcaggtttttgtggccaatgataaaattcaagtttttaaacaaagaaatgaaaattttggagttgtgtctgccaaccaggaacctgacaacttctcaaagttagtgacttttctgatgaggttggtggtgatattaatgaatgtgatttcttgacactatgtaatgaaatgtggcaatgtctggaagatctgcaaactcagtaaactcatgtttttcaagtgaccagtatatgatgttacaaaaccatacccattagtaaaatactcattcaagttgcaagggagactaaaattactttttgaaattagttatatgtatattttttattgagatagaatgtatgtaacataaaattcaccattttgcagtggacagttcagtggcatttaatacattcacagtgtggtacaatcaccattatctagttccagaatatcgtcatcaccctgaaaggaaaccccatccccactagcagccactctccattgtcccttcttccatctcctgacagccactaatctgctttctgtctctagggatttgccaattctacatattttatgtaaaaggaattatataatatatagtcttttgcatgaggctcatccatgttgtagcctgtgtcagaaccttatttttttgtgtgtggctaaattattccattgtatggatggaccacattttgtttatccattcatctgctcattgacatgtgggtttttccgctttctggcactttgattaagtcgtttcactgccctctggcctccatggtttctgttgagaaatcagccattactcatattctggattctttgtttgtgacgccacttctctcctactgcttctaggattctctctttgtctttgcctttcaacagtttgattataatgtgtctttggtgtggatttctttgagtttatgccacttaaagtttgttgagtgtatagatttagtttagagtgtatagattcatgcctttcatcaaatttgggaagttttcagccattacttattcaaatagactttaccactttctccctctcctctctttctgggactcctattgtgtgtttgttggtaagcttggtggtgtcccacaagtttcttaggctcagctcatttttcttcattcttttttctttccgctcctcagactgggtaatctcaattgacccatcttcaagttccctgattctttcttctgcctgctcaaatctgctgttgaacctcccctagtgaagttttcattccagctattatactttcaactccagaaattttatttggttcctttttacaatttctgtctccttattgatattctactggtgaaacatcactctcatgtgtttttttgttgttttgttttgtttttgttttgatatggaatctcactctgtcacccaggttggagtgcagtggcgtgatctcagttcactacaaaccccgcctcccaggctcaacagttctcaggcctcagcctttcaagtagctggaattacagacgcccaccaccacgcctagctaatttttgtatttttagtagagacagggtttcaccatgttggccaggctggtccctgaactcctgactttaagtgatccacccaactcaccctcccaaagtgctgggattacaggtgtgagccaccacacccagcctgtcatggttttttatagtgctttgtacatgatttcctttagctctttaagtatattttatatagttgatttaaactctttgtttcataagtccagtggctcgattttctcagagatagtcctatttatttatttctacatatgggccatactttctttttttttttttgcgtgcctcataatttttgtggaaaactggatattttgaatagtttaacatggtgacgctgaatattggattcttctgttctccccagggtttgctgttgctgcttataggtgttgttgatcgtttgtttcatgacctttctgaactaattttgtaaaatctgcattttttttttttttttgagacagtctcactctgttggccaggctggagtgcaatggtgtgatcttggctcactgcaatctctgcttcccggattcaagcgatccttctgcctcagcctccccagaagctgggattacaggcatgtgccaccacacccacctaattttttttggtatttttagtagagacagggtttcaccatgttagccaggctggtcttgaactcctggcctcaagcaatccacatgcctcagcctcccgaagtgctgggattataggcgtgagccaccgtgcccggccaaaatctctattcagttaccttagtggtcagctagtgatctgacgaaaatttccttaaatgccaagtttcatcttttttttttttaattaagggttcacctgtttgccataatcttttaattcatttccagagttctgataaagtcgattctgacaatttttgcccattttttgactgcttttgtgaagggatgggttctagagttccttactctgccattgtcatggatgtcagctcaagattaatggattttaatgtaactgaggatgaaaagctcgttgatatggtttcagattccacattgcagctaacctttaagaaattaccagctgtcaagtgttgctatagtatcaagtaaaaatatccccagttatctgaaaaggctattaaaacagtgctccttttccaactatatatctgtgtgaggccaagttttttcaatgtacttcaactaaaacagtatacaataacagatggagatacagaagtagatgtgtagagttgtcttctgtaagtcacgcactctacagatttgtgaagatgcggaatcattccactcttcttttggttttgttgtttttttttttaatttggaaagtgtacctattcttcaagtgttaacctataatgggtttattattttttaatgaattaatacatctttttaaaaattatctattttgatttctaataagggaaataatacatttaacttttaaaaacaaaagcaggcagggtgtggtagcttatgcctgtaatcccagaactttgggaggccgaggtgggcggatcacttgaggccaggagttcaagaccagcttggccaacgtagagaaatcccgtctctgctaaaaaatacaaaaattagctgggtgtggtggcacatgcctataatcccagctactcaggaggctgaggcatgagaatcacttgagcctaggaggcagaggtggccctgagccgagatcacatcactgcactccagcctgggaaacagagtaagactctggctcaagaaaaagataagtaaataaagctctttttcaggggtgggtggtgaaatctcaaaattttgtaatagtgtattttttaatagaccaaatgattgagacccactatgttggagagacagtgttttcttctccttcccagtctgctgggcactggacaaggccccctgagattagggcagacttccagaggtcatgcactctgctctcccggcacccataggtgagcgatgtcccacagggaaggtgccacagggcagtactcacgtggctgcccaagctgcagatcagaatggccccaagacatgggggtggcatgtgtgttttttctatcatagaggtggcgattgccttctcatcgcctgcaccctgaggctgatgggtgggagaggtctcaccatcctactttcccctggtcctccagtgtaccttctgcacttcttaaaggtgaccctgacgtcctccttggcttgaagcaagggtagctaatgagagaaggcagaaccaccgtggtcggaggccgtgggagaagcagttaccctctcattcttgaactcagctccgctcgcctgctctctgaaatacacactcaacctgctctttgcagaagtgtcaagtctttggcctccttaagaaaggaagcatatacttcaagttcatctcctcccgcttcagtcctctggtcgtcagggtgggctgcagcagattttacgtcgctgttttccgtgtgcgagtctaggacaaaccaaatgcgtgcgaatgccttagtggccacgcacagctgtgtgcctcctccatcgcgtggacctgccgcccacctccctccccacctccatcaggtccttcaggatccaactcaaaagccccttcctccaggaagttctgctgttagctgcccaactctttcttccaaaactcttttctcttttccaaaaatcttcttcgcacagctcccactgggtaaacattcgccagacagtgtccagtggccctggatcctacggcctcctggtggcagggtctgagtctttggcctcgctgctattttcccaaagcctccagcagcggggagaccctgggatttgcgacaggacagcctggctggggagtcaaggctgccatctctccttgctttcattctggttccccatcgatgtggcgtggggaaaggagcaggtgactatgatgctggcttggctgacactggaatggatgcagtggctgcatattaatgctacggcgtgcacacacatatgccaggttaaagttcagtagcaagtttttacaacatgatttctgctgcttctgttggacgggctctcgggcttacctacgtgtgcgaagcaacactccctaccgcagctttcatgcacaatttaactcacccccgccctgcctgcgtggagcctcatttttattttgtaggagctcgaatcattatttggatattaataaaaacaaatcttggctgatgctaaccatctgatttcctttttttttttttccattttgttttgttttgtttctgcacacattttctttagcttgaaatggcgattgaaaacctccaaaaaagcgaaggaatcacatcacacaaaagcggtttactcaacagccatgtaagtgtgcgtctgacctggcaacctgtccctgctctgcttgtaacctgcatagacatttttaagacaaatgaaggcaaccaggtgcggtggctcacacctgtaatcccagcactttgggaggccaaggcgggtggatcacttgaagtcaggagtttgagaccagcctggccaacatggtgaaaccccgtctctattaaaatagaaaaattagctgggcatggtggtgggcgcctgtaatcccagctacttgggaggctgaggcaggagaatcgcttgaacccgggaggcagaggttgcagtgagccgagatcacgccactgcagtccagcctgggcaacagagtgagactccatctcaaaaaaaaaaaaaaaaaaagaagaagacaataaaatgacacctttaaagtgtcatttgtgaaaggtggttgaggggaagccaatctagaatcctacatccagcaaaaaatacccttcagcaatgaaggagaaatcaagacagattctttatttgtaaaaggtagataataacaacacctacctcctcgggttgtcatagggagtaaattatttaatgtacgtaaaatactttcaacaatacctggcaggtgataagcagtatagttatatatgaaaaataaaaacaatacaaaaatcagcaacagcaacaaaaaagagagaaaatgacataggatcgggaatgccttagactcttagctaattttcttgggatcctctcttggaaagaaacagtaatttgagaaaagcataaagcagctaattcatacagattttagcgtctaggatttttctcctccccttgtctcttgggagaagaccgtgatcacagtccccatgacaggaggttgggggcatctcagctctgcacagccctgtagcaggatgggactgggggacgtggcaggctccgtctttatttccagggacaacagagaaggaaagctctggccccctcagactcatcgctttcacttctccccaaacgctcttgattcggttttgcacatagctggaaatgtgttcggcatcttaacactgggacgggccatcgaagtcagaatgtccttctagtagttgctctctagcacttaaactgggctctgacattctcttgagaattcagacatcagagaagaagtccccttcagtggaccccagtcatcaccgtgatcccgtcctgactcccgtcctcaccgtgatcccgtcctgactcccgtcctcaccgtgatcccgtcctgactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcaccgtgatcccgtcctcactcccgtcctcactgtgattccatcctgacttctgtgctggccgatgtgtaaaatgaggcgttatcaaaaggcagtgagtgattctgggggcagaaagtgatgtaggacaggtccagaaacctgggttatgggttaggtacaggtgtggtcacctgctcaccgcagcccctgacgaggcctctgccctttgcctcagggggctggtcactagaagaaatggcagaaatatttccttctgccgattgtcttgaagcaaaaaagacaaaacaaaacaaacaccatgccagacccctgctcagtgccccgcccctctccaggctgggtaggacatggtcatcctgtcatctgtcactgctggatgacatcctccctgtagatgaactcagggagaagggagtcttccacacgtgcttggagagaggatctccccagcccccagtcttaaactcagagcacatacatgggaaaatgtgcagaataccattccccattcagcaaggatcaggccatcttcagcctgaacgcaaacccatgcgggtccagggtatcagccctgggcgagagggctgcgtgacccaggcaggatgggggtgcagagcctggacaggcagcaagtccacgggagagttaaaatgtctatgggaaaatgggctgggcacggtggctcacgcctgtaatcccagcagtttgggagaccaaggcgggtgtaccacttgaggtcaggagttccagaccagcctgaccaacatgacgaaaccccatctctaccaaaaatacaaatattagccgggcgtggtggcacatgcctgtagtcccagctactctggaggctgagacaggagaatcgcttgaacctgggagacggaggttgcagtgagctgagattgcgccactgcactccagcctgggagacagagcgagactccatctcaaaaaaaaaaaagaaaaaatgtctatgggaaaatgcatgagccgcttgtctctggctgctgggatccttcctgctttctaacacttcatccgaaaggcagactttctcaggtcgcttccccgatgaagattcgtattcccgagctgaaggtaaaatctctcgtttcttttactcactgatgattcgctgttgagttgtttccttctgtcatgagctgtgatcagtaagattccgggcttggtgactcgaagcaaaggaagtaaaataagatctttctaaaaagttcaccacacacacgggcagaataaacttagatcttgttttggcaaatgtgagagccagagaggaagagaggagttaaagcacgtgatctgctgatggacggggtgacgtgcccttgcaacgattgtccccagggctgcctgtggctgagactgaggtcgtggtgggcagcggccttctgcaggtcaggcgggggcacagccacagtgccacctcccctgccagcctgaccctgtggcagataagccaagtgtgtgggagcagctgggccctggagacccattttcccagtggcctcccagacctcccttctcagacagccccaggcaggtcgccccagcagcagggcctgtgcgcctcttccctgctgccagctggtgacgtcagaccaccgtctaccgtgtgcagggttctggccaggtcagtgccgaacatagggagtaaaaaaggaggaaaagtcactccagggagcttagcatttgagggcagaaggtggaagacgtgggaaacccacctagggaacccctcacagacatctctgagcggagctggccacgtgttccgcggagctggttccctcctctgcgctgtctcaggagggaaggtgtattcaggtgctgggagcctggtaaaacgagacagcattgtccagacccagccggtcaacaggagcttcccaggcctcccctctaggggcttggacccagggggtctgcagggcctggaggtctgcacattggaagaaccttccagccagctgatggtcagcctggcgtggaaactcccagggaggaggaggccccctagcagtgtccaaactggaaaagggcatgatatggcgccgtgaaaatggggattagctcttccagagggaaggggacggagccggggctggggatgaaacatgtcttcacccgaccgggtgtggcaggccaccgacttgagcagaagaggcggcctcagcccctgggggccaccgggctgccctcaggctaccagccgaccgggaccccgtagcaggttcaccgagtctctgtcaccatgaggtggcgctgtctgctaaagtaaacacatcacttgcacaccctgcgggagagagctgcgtgtggaagagtcgtatttgggttatgtgactttttgctttgaaatcaagaaacacacattgtcaaaggtcatttagccttcagctggtgacctgtgtagcctggcacgatggccgtgctgtcctgcaggccacagtggggttgctagagccggcagctcctcagaaggggcctctgtccagaagtgccgctgttttcccttggaattcctgcctgcctcggattagtgtcttagctcagtgcgtggcctccaccctcaacaacccctgcgcctcccacaacccctgcgcctcccgcccacggtcccatctgaggcaggggcagccaatcttccaggcgctcggcccccaaccccactgcgtcctcgcctccttgctcctctcatgcccacccccagatgctcttcaacctcaccttcaagaaagatccagaaccaggtggcaccccccacctcctccacttcgactacttcccgagccgccactgtccctgtggattctttcggccacctcctagccagccgtcagcacccacccctacccagcctccagccccttctcacagcagccaccagagtgatcctgctaaaacccaggtcagatcgccacactgctctgcttggaagcctccagggctccccttggccctccaagtagaaccgagtgttgtcaaaatggcccacaaggccctgcaggacccgctctctcccactcctcactgtgctccagccacacgggcctcctcgctattcctccaatgcaccaggctcggacctgccccagggcctttgcactgtggggccctctgcctgaagctctcttccccaggctccccctcacctcctctgagtcttcactcagtgggcactttctcagtgagccctgcctgacacccccaccccacctcaacttactataccgttgcagtcctccctccagtccctccgtggcggcgaccccatcccctttcccaggtgaatttctctgacggcactcggcatcagccctcattcggttcattttacttatttattgtgggtctctgccagacaagaacggacgcttccagggggcaggggtttttgtcttttattcgccgttgcatccccagcacctaaacaaggcctggcatagagccagctctcgtaaatatttgtggaatgggtgaaaaggtggatgttccaagtcggattatgtcaacacagggcacacctggacggttggaatagctgcccgagctgctagtgtatggcccggtgagactctaactcaccaccaggagccagtgtcaggcaaatttgcccccaggaatagaaacaagtatcttaggagacaaagggggccaggtaggtgggcatgatccctgccttcccaccggcaggtgaggatatctgtccacaggggctgtgcctgcaaagagcccagaaccacaggcctttgttggggggccggggagagggaggcgctggcatttcgggattttttttccttaaaaggaatgatttgatccatttcatcaagaagtgtgctgtcctgacagattgtggcaaatgtgggtacacatgtacatttccttggaaagcgttctgcttatttgtgtttgatattgacacagaaagaatgcaaatatcagcagacaaagcagactgcagaacatgcccaaaccagaaaggtgactccgtccagctgctgcctttcctggcatgaaggtacccgagccctcaagagcaggggaggtgggcgagtgtggttggagcggctggaccctcgtggtcggtttcacggaactgacctgtgatgcttgccgcagtctgacgtgccgccaggtgtgggctccagcaccgagggatgggaaggcccggtgcataagtggctcccagcctgctggtgaggcgtagaccctgaacagagtctgcaagccatacttcggttctaaccccattctcctcccagaagttcatcaacacagaagagggaggaaatagacgcgactgttccagccgcttcagtcttctctgtggtttcttgatgttgagcaagaaggacttgctgtcaagacaactatgcatccttttagtgtcaatgtcaacgtaattacccaagcaaaggattctactcttaaatagcctgggggttcgggggtaaacagcagaaggatcatctgttccaaaactttctttttatgtgtgagccagtatgtcctcctggtggatggagtcttatactctaacctctcaggactcctagtccagtgctccttccagctcaccgcccgcaaaatctggcctcacagttttagcctgaaaatccgcatcgtcatttggctccttgagatgtggtgtcactggccttggctcctgctgcctgtggaggacagtctaagaagtggcacctgtgcccccagcctcagaatgaccaagggaagcctctggcttcttcacccagacaccctctgttgctccccatctacctccttggacagtctttctctgctgccaggcttgagacatctccaggatcctgcagatgctcacatgggcaaacctggctccgtctccaccctcagggagagcatagtctgcggggaacaggcgataaatcaatcagcacacatgacaaatccggacggtgaagccactgggaagaaaagcttcagggcccacactgcagctcccgactgtcatcccaacacttctggaagctgaggcaggaggatcacttgagcccgggagttggaggctgcatgagccatgattgcaccactgcgctccagcctggggtggtgacaggatgagaccctatctctaaatatatatatatatatatatccctgtctctaaaaaaaaaaaaaagtatataaaagtatatacacacacacacacacacacacacacacacacatactcacacactaacttcaacatcaaggttgtggttcatagtattcatagcattaaatacagggaagactccggagctcttaagctcttaagggtccaagcactctgccagagccggactttggaggagaaaaaagcaacactgcctccattgtattggaaaaagtccagtccagaaagtcggaagatgaagggtgtgaatgacttgatggaaagtgaaaactctgatgtcccttttcccaaagaggcaagtgaggaagagatgaagtctccactccgggcccttctcagggtcctttgttttaactgccccttattcaaaggacaagagggcgggggtccctccctgtggttatgggcacagccaagcacatggcacccaatgctggacggatgaaattggcacctgctaacgatggcaactgctaacgatcacctgcactcatggcgggggggtgggggacactgcacttcacacagggccctgcaggcggcaggaggcagactttgtggtagcaagagggcgaggggtccctggtgctgaggaggaggtgataggctacttgagtgattcaggggcggccagggaaccggaatccaagctcagggattgtggcaggaaccactcctgtccctttggtaaggagggatgtttggccacgggacttacctgcaggagcagagctggaggggagcttgtggtcaggaggtctgaagccctcctggcttgccccagaggcaggacgtgaggttggacccacacttcgaggcttacgctttgctcctcttcatcctcaacacccacgtgggcagtgcccctgctgggtgactgactcttcccaccccttggaggttttgtcctcagctctttggttccaaagtaacacatctggtcccaatctctaccctgaactccagcccaagacttaacttcccccttcctaaaatggaactcagccccgcagctcacctgcaattcggcttaagagacctccgcgttcaggccccacacaccccttcacctgaacctttgacctgtttgtcctcctgtgaaacgttccagaacccagggcaggtcctcactccactgtggccctgggtcaacccctgttagggctggaggggccaggacaggctggatcgagtgggtcttagatgagataaaaggggttctgaggtgctggtcgctggtgcagggctcgtcagaaccaccccatagcactatttcataaaaaggagatgaaggccgggcgcggtggctcacgcctgtaatcccagcactttgggaggccaaggcgggtggatcacctgaggtcaggaattcgaggccaacatggcaaaatcccatctctactaaaaatacaaaaaacataagccagatgtggtggtgcatgcctataatgccagctactcaggaggctgaggcagaagaatcacttgaagcctggaagtggaggttgcagtgtgccaagattgcgccactgcacctccagcctgggtgacagagtgagactccatttcaataaataaataattaaagggagatgaatgctttcttcctccccagcttctaatgctgagttgggggggtggggatggggcaaacagacaggcaaacgtgacagtggggcgggggggtgccatgggtacgctgtggtgagtggacagatatttcccaggggacacgcctactttgtgtcttgtggggtgtgcggggcacagggacaagggcttcccaggccaagggctgtgcaggagcccaacatgcccggtgggggagggctgaggacccagcactgcccactctgaagggcccaggcagcaggagcccttcggagctctggaagcggggctcagcctagacaaagcagctgacagcctcgcacaaaggggaccaggtagagacagctggtttcccccgacgctcttgacatgggatctggactcgggcctcgcttctgtgcgtggaattcctgtctttctgcaaatcgcaggcatcagtgcaagccttttgtattcacatagcagacctctctggatcaggggacagacgatagcagagggagaggtggaaaccagaattaagccgcagtctttaaggcacctgggtgagggcatcagttggtgggcaggccacctttgcgtccatgcccagtgtggggactgagctcttcgtgtggacagttctcgcagcccttctaactggatgttcacctctcgaggcatagtccttggctcgggactcatttagcccatctttttgttttgtttcgttttttgaaagagacgaagtcttgccctgtcgcccaggctggagtacagtgtggcgcgaccctagctcactgcagcctcaacctcctgggctcaagcaatcctcccacctcagcctcccaagtagctatgtcctgccttttgacttagacacaaaaccgtgcatataagcatttgtgtattttactgaatttccatttgtacctccctcaataagggatctcagtacatgttagctcactgctcactacagaacacagggctgtggggcccccgagtcttcttcaatcttcctgttcagcaacagaatttctctccattcctgtatgttggggagcgatttggtgttaaagcctgtgtggtgtgtgggtatttcatttaagggactgaagacagaagctaatagttcctgatcacacccagatgtttacaaattaagtccaggaacctgaaaaccaggctaaacatgaaagaatcaataagcaaaagaaaatgagggattcattaatctgcttagagaactcaaatcagtgaccataaagatggatttctggccaggcacggtggctcacgcctgtaatcccagcactttgggaggctgaggcaggcggatcacctgaggtcagtagtttgagaccagcctgggcaacatggtgaaaccccgtctctactaaaaatacaaaaactagccagatgtggtgtcggacacctgtaatcccagctacctgggaggctgagggaggaaaattgcttgaacccaggagacagaggctgcagtgagccgagattgcgccactgtactccagactgggtgacagagcaagactccgcctcaaaaagaaagaaaagatggatttcctcatcccatttggtaacacagggaacgcaagtaattctcttaatgagtccacgttggcatgttagcgttcctcaggcttctgacaaacgcagacgtgtctttctttttacagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggtgggtagacgatccccagcccacctgttcttcctcttcctttcccaagaaatggagcttttgggaaaatgcgaggcttcctcctcctttccaggtggcctgattcgcagccacctctggagtgcttgcagttactttcaattggcggcagccttggctgtggccaggtgtagcccacggtgtcggctttagaagccggtgataggacgtggggatcactctggttttctctctccttttgaaatttcccaaacaatacttttctttttttgttttagagcagcctctgggccaggtgtggtggtgcacacctgaaatcccaacagtttgggaggccgaggcaagaggatcacttgagactaggagttcaagaccagcctgggcaacatagcaagacctcatctctacaaaaaaattaaaaattagccaggcatagtggtgcacacgtatttgcacacctgtaatttcacctatttgggagactgagaggggaggagcacttgagcccaggaggttgaggctgcggtgagccacgattgcaccactgcactccagcctgggtgacagagcaagaccctgtgtcaaacaaacaaacaaacaaaatgtagcctctggtttatccagcagagctggatttaccatttctcagtgttttgtttttgagacacagccttgctctgtcacccaggctggagtgcagtggcgtcatctcggctcactgcagcctccacctcctgggttcaaccaattctcctgcctcagcctcccaagtagctgggatttacgggcccccaccagcacgcctggctaatttttatatttttagtagagacagggtttcgacatggtggccaggctggtctcaaactcttggcctcaagtgatctgcctgcctcagcctcccaaagttctgggattacaggtgtgagtcactgtgcccggcctcttggtgtcttttgctgtacctggaccaatccaccccgccttctcttggcctatggcagccccgggacatcacaggccacagacttatcacaggcaattatgccaactctcctctaacagaaagaaacagcagcacctccaacccaaagctggtggcccagagagtgcagtaggctgctgcctgctgaggctgtgatcctgtggccagcgaggcttggcatctgcttttgtggggttggggctgactcacgtgctctcaaagccggtgtcctggctgtctataaacggcgtggcggtggatccacgaggaccagagtcccttattctctgacactttttcatccttcacagggaatgtccttagggaatgtggatgcgtagaggagggacagaagcgggaggaagccacagggaagcctggtctctggggacacagcccctgctcctggaggggcctcccctgcagagtatcccagctgctggcttcaggattaaggctgatttccccccgttttccctcctctgagcacctggctaaacatgtacctcatctagaaagggcccaggctgtctgctattgcaatgaaatttaaaaaggaaaagaagggccgggcatggttgctcacgcctgtaatcctagcacattgggaggccaaggcaggaggatcacttgaggtcaggagttcaaaatcagcctggccaacatggtgaatccccgtccctactaaaaatacaaaaaaattagccaggcatggtgtcacatacctgtaatcccagctaatcggggaggctgaggctggagaatttcttgaacctgggagagagggaggttgcagtgagccgagatcgcactactgcactccagcctgggcaacagagtgagactgtctcaaaaatataataataagagaaaaagaaagaaagaaaaagaaaggacccaggtgcttcctgcatgtccctgttgccagctctggagaaatggcatcctgtgagctgggtgtctccacagccatgtctgtgggttaatgcttccctcctgtaaggactctgtgagctgttttctgaactaaattgtttaaagccctctgatcatcattctcccgtaataaactaatgtaatggttcccaaacagtgccttattccaaaacgtgttactagatgattgaagggggtggggaagagttgttaataataatggtaataataatggagataagccatgtggagctcaacaaagctgacctggtgttctcagcacaggacttgtccgagcctttattatactagcctgtgagagaggactctctatgacaacggcattatgtacagaattccttgatcacattcctcacacagttcaggaaatgctgaaccagagaggccaaagtgaaaggtcaagatccgagtgtggtggcacacgtcagctactcagaggctgcagcaggaggatcacttctaccatccgagtgtgttggcacacgccagctgtcccagctactcagaggctgaggcaggaggatcacttgatcccaggaggtcaagtgatagtgacctcctggtagtgacctcctgatagtgagctgtgattgcacaactgcactccagcctgggtgacagagtgagaccctgtttctgaaaaaaaaaaaaaagagagaagaggccaggcgcagtggctcacgcctgtaatcccagcactttgggaggccaaggcaggaggatcacttgagcccaggagtttgagaccagcctggccaacatggcaaaaccccgtctccactaaaaatacaaaaataagctaggcattatggctcacgcctgtcatcccagctacttgggaggctgaggcaggagaatctcttaaacccgggaggcggagattgcagtgagccgagatggcactgctgtactccagcctgggcgacagaatgagattctgtctcaaaaaaaaaaaagaagaaagaaagaaaaagaatcccaacctgtcttgttgttcaggacatctgcaaagggagctgaccctgggatgtttggtttccaggggcaactcgaagtaccattactatgggattcgtctgaagccggactcaccactgaaccggctgcaggaggacacgcagtacatggccatgcggcagcagcccatgcaccagaagcccaggtgggtgccgggccgagctgggaggagctggctctcccctggagcatggaggggtgggtgtttctccaacacgaaacaaactcatcataactccccagtctccagcatcctgggaaagccaaggtatccccctctgctgagactgaggtgagtctagcaggagacacaggaggctgggatgcaacctcctccagctaacttttcagactttttttaaaaccgtttaaaactgtttttaacagacttcattttttagagccattctaggttcacagcaaaattgagtagaaagtacagagagttgttctacacccccagccccgctccccaccgcctctcccaccattcacctcccccacacagcggtgcattgctcatgacccgtgaccctccgcggagccagcatcaccccccagagtccacagtcaacatcagggctcactcttggtgttgtacattcgacagtttggacaaacctataatgacatgtgtcccccatcacagtgtcacgcagagtcctttcacagtcctacacatcctccatgttctgcctacccagctttccctccccaccccagtctgcagcaacctctaatccttctgccatccccacagtttccccgttccccagtgtcatatagttggaatcacagacctttaatttttaaagcttaggaagtaaagagagagaggacactgcaaataacccaagaagccaggagaaagaagcagatgtgctcaagtcacgacttcttcttcacctttggatccagtggctggaaagccctggttattttctggaagatcctcttctccatccatcacaaactttctcatcttctaaggcaggagccagcaaacctttcctgtaaagagccagagagcaaatatcttagccttgcaggccagacagtctctgtcatgactgttcaatttggctacatcctgaaagcagccacagacagcatgaggatgatgggcatggctgtgtgccagtaaaactttatttataaaaacaaacagcagaattggccctcaggccatagtttgctggcccctggtttagggcccattcaaatatcactgcctcccagtgtgcctccacaagtgccccccctgagggcaggggccacattgcaatagccccacgtggcacctttacacctggtgctggaccctctgcacagagccacccgtgtatgtgtgtggctcaaaaacccattccagctgctctgcgtaacccattgactcctgaccacacagccactcccaggagttggaggttccaggagagagtttccagagcattccttctgtacctcgttgtctgcagacatggactctggagctcactgctgttgttcaatttgggcccctggcagacagctgtgaacctgtgctccaggcagtgtgtcattttaggagcagcgacacacatttcagggggacaggctgatgccatttgcatttggaagccacagcctgagcctgtgtctgtgtgatgcccacggcctgccctgagccaggtggtttacacacacctcgccagcatggtctcccgcctccctgtaggcctggccccgcttcgtatttgaggagggaggtccgctggagatgctccagctcaagccggctccctccctgcccccaccacaccacacaccgggccctgaggagtccagcgcctggaaagtgctgagtgtttctcagcactgcctgcacaggctggccaccaccatctggctcaaaatgaaagtctcagaacttctaagattgcaccaataataagatgtttgtgattcacgcaaagaatctcccttttattttattttattttattttattttaattaatttatttattttttttgagaccgagtttcgcttttgtcgcccaggctggagtgcaatggcgtgaactcggctcactgcaacctctgcctcccaggttcaagtgattctcctgcctcagcctcctgagtcgctgggattaaaggcatgcgccaccacgcccagctaattttgtatttttagtagagacggggttactccatgttggtcaggctggtctcgaactcccgacctcagatgatccacctgcctcggcctcccaaagcactgggattacaggcgtgagcccctgcgcccggccaagaatttcacttttttttctaagagagaaatgttagggggaaaatatatatctattttctcaagtgtccattaacaaactgtggttcatccatatgatggaatattattcagccttaaaaaggaggaaattccaacacaggctacaactcggtggaccttgaggacataacgctcagtgagagagaccagttgcaaaaggacaaatcctgtgtgaccccactcctaggaggtccctagagtcgtcagattcacagagacgggaagtcagatcaggggtgccaggggctggggacagggatggggagtgagcgttttatggagacagagcttcagtgtgggaagatgatcaagttctggagatgacgacggtgagggttgcacaaccagtgaatgtgcttaatgctgctgagctgtgcactcaagatggttccgatggtagcttttgtgttatgtgtatttgaccgcaacttgtaaacatcacacacacatgcctgactgaatcctgcccagccccccagtctttgggcccacccgcagcagggctgctgggcctcatgatggtatgcgtgttcctggcctaggtaccggccagcccagaagacggacagcctcggggacagcggctcccacagcggcctgcacagcactccggaacagaccatggccgtgcagagccagcaccaccagcagtacataggtgagaggcccggtcaggcccgggggcggggctcccatctgctcgccacactcctgggtttcaacaccagcagaaccagtggtgtctaagcgtctgcttccgacagttttcttacgagacaccttttcggacaaatagaaagttttcgataaaccttctttctgacatccctgagactttagaataatcagcacatgccaaaaaaattaatatataaaatgaccatcagaaaaatgagaaaataaaatcaaatgaccatcagaaagaacactagaggacaggcggctcatgcccgtgatcccaacaccttgggaggccaaggcgggaggatcacttgagctcaggagttcaagaccagcctaggcaacatactaaaaacttaaaaaattagccaggcatagtagcaagctcctgtggtcccacctactcaggaggctgaggcaggaggatcacttgagcccagaagttcgaggctgcagtgagccatgatcacgccactactctccaacctgggtgacagagcgagactctgcctttaaaattaaagaaaaaaaaaaagaaagaacgctagatattctctactcagggtgcaccaggatttgcctgctatctgggctttcttccttcttgcctggagcttttggggtgcttctggttccccaacatgaggcagtcttggcctcttccctgggggctgctcaggggacagcgttcttccccagctggcttagtggtggtgccatctctgccccgggaaggccctaactcagagcctgccatgagggagggcaggggggtggggggcggccaaggaaggctcactggcatgtcatgattcaggtgggctctgtacacactcagtggcttccatgtcgtttatgatcttttttgagcccaaacagaaccctcctgggttgagtcttcggcagagattgaggtggggtcaggcccatctccaggaggtcactgcagggacaccgtggctggccttctccccgagatgtgctgccctgagctggctctgtgggtacttgctgtgtgccagggcctgggctcagggctttctctgtgtctgcatatttaatgttcctgggaggtgacaatatcctctccattttctacctgagaaaactgatgcttagaaattccctgactgtactgggcacggtggctcacgcctgccatcccagcactttgagaagccaaggcaggcagatcacttgaggttgggagtttgagaccaacttggccaacatggcgaaaccccatctctaccaaaaaaaatacaaacttagccaggcgtggtggcacgtgcctgtaatcccaaatactcaagaggctgagacaggagaatcacttgaacccaggaggaggaggttgcagtaagccaagatcgtgccactgcactccagcctgggtgacagagcgagactccatctcaaaaaaaaaaaaaaaaaaaatggccgggcacggtggctcacgcctgtaatcccagcattctgggaggccgaggtgggcagatcacctgaggtcaggagttcgagaccagcctggccaaaacaaggcgaaatcctgtctctactaaaaaatgcaaaaattagctggcatcgtggcgcccacctgtaatcccagttactcgggcggttgaagcagaagaatcgcttgatcccaggagctggaggttgcagtgaaccgagatcgtgccactgcactccagcctgggcaacagagcaaggccctgtctccaaaaaaaaaaaaaagaaaaagaaaaagaaagaaaaaacaaattccctgactgcatggggtggggcagaacatctgtttctgggcccccatccaccgtggccttccagttgtccacggtgtcctaagagcctcgccatttctgatgttcccgtgttcctcccccagatgtctcccacgtcttccccgagttcccagcgcccgacctgggcagcttcctgctgcaggacggcgtcacactgcacgacgtcaaggccctgcagctggtgtacagacggcactgcgaggtgaccgccccagcccaggcaggcagctcctgcgtgtccctcccgggaaccgccagcgctcaggccaggcgtccccgggtgacgctgaggagctggagccccgagccccccaacaagcatcctctctgaagcagcagcccctccgcatccatgtccatcgcctgctcctctcctctctgtggcctcccttgggattccagggcaccccgctgtagcccggatcacggctgctcacttgacgtgtgctgagtgcacgtgatgggcgcacgcacccgtctgtctcaccggtcccttcattcctaggcaactgtagatgtggtgatgaacctccagttccactacatcgagaagctgtggctctccttctggaactctaaggcctcctccagcgacggccccacctctcttcctgccaggtgactgccacaccctggctgggttcacagccaccccagacttaaccccctgctgacgtccacaggtaacccacaaacgaaagcctcagctctccaagaatcagggttcagacccctctgcctccatccctgtaatttttagacttggtagagttgacttgaaattcacattgccatccgcccctttgcagggtcagactgtttgaatagggaggattttagaggtgaccatgatgcaatcccaagtagaagtgaccccaacccatagctgcagtgagacgcagtatgacagtatgaccactggcaggggagggacagcgtggacagtgagggacagggggaaacacggaggcgccgggagcaacatggagggaggggacccatcgaggctcagggatggggagcaaaaccccagccccactgttgggcaaaagtcccgcagcccggctctctgctcgctcccgtggctgagtgagcccacctgggccaggccacagctcacctgtcccccctccctccacagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaagtgacccacggccccgcccggcgctgctccatcctctcttcctgcctcctctgtcctttcttacatgtacgtcttcagccacctcagaccatcgctttcacagaaaacccaaaagtggccgggcgcggtggctcatgccagtgatccccacactatgggaggctgaggcagacaaatcgctgagcccaggagtttgagaccagcctgggcagcatagtgagaccctgtctctaaaaaaaaaaaaaaaaatttatctggggccaggcaaggttgctcacgtctgtaatcccagcactttgggaggctgaggcgggcagatcatttgaggtcaggagtttgagaccagtgtgaccaacatgctgaaaaccatctctactaaaaatacaaagatttagccgggcatggtggcacacgcctgtagtcccagctactagggaggccgagccaggagaatagctttaacccaggaggaagaggttgcagtgagccgagatcacaccactgcactcagcttgactctgtctcaaaaaaaaaaaaaaaaaaaaaatgagctgggcatggtggtgtgtgcctgtagccctagctactctggaggctgaagcagaaggatcacttgagcccaggagtttgagaccagcctgggcaacatagtgagaccccatttctaaaaaaaatacaaaaattagctggtgtggtgttgcatgcctgcagtccagcgacccaggaggctgaggcaggaggatcacctgagcccaagaggtcgaggctgcagtaagctatgatcgcaccactgcactccagcctgggcaacagagcaagaccctgtctcaaaaaaaatccctaagtgagagccgctgtgggccgtagaatgtgtcccctctggcatgcgttatttgtccttgtctctgactcgaggggaaggtcacagtggctctggtgagctctacctgctgtcaggacacagccaagagtagctgggctgggctcggtgctttctagaaggttcactgggggcatgcaggccggcctctgggagtagcctgtgtgcagccctggagccgtcactgtgcgggaggccttggcccagggccatgtggggttgctgcgcaccctggtcttgcagacgaccaccagccaccttcctccagcctcccttaagccccactgtgacacatcctgagtgccacccctgtaggaggggcagggacataaactcagaagaagaagctgggacatggccctggactcctgcagcctgttagggtagaggctgacctttaacccccagccagaccccacttcccagcaccgtgggattccaggagacatttacaccccagcgccccaccctgtgatttcccacaggacttggtggggtggggagagagtgacaggcacagtgaggaaggaagctaggcccacggcagagatcactcgtgcccttggagacctcccagggcctccagctcctgaggcaatgacagcacccaccacgagggagccctcgggccaggcccgtgccaagctccccaaaaccctgggggtcgtcaaggaagctgggcacagaggcctctcttcataaatcacagcatcaggaccacaggccatgccccgcagtccatccacaaacatccgggcccatggaccgtgcccctcaggccatccacaaatatgcatgcccgttagtaccaggcagctctccgtcctgttgagtaaactctatgctccctttgctggaagatgggaaacagcaaaagtattgcatttctcatttggcctggccttgcctgtctgcctgaaaactgttcagggcaatgcctcgtctgagtttctatgttatggtgggagtttggggtatctttccttttgcattttaaaatatttttctggttttttttaagacagagttttgctcttgtcactcaggctggattgcaggaggctcactgcagtctttgcctcctgggttcaagtgattctcctgcctcagcctcccaaatagctgggactacaggcacccaccgccacgtccagatcatttttgtatttttagtagagatagggtttcaccatgttggccaggctggtctcgaactccggacctcaggtgatccgcccacctcggcctcccaaagtgctgggactacaggcgtcagccaccacacctggcctttttctgtttttgttttttggttttttttttttttaacagtctgatcatttgcttcttattctaacccactttaaaataaattaggaagttggtagaatgtatttacgtgtgtgtgtgtgtttgtgtcaaggcctctttcccttggcactgttgatatctggggctggatcgttgtctggggtggggccctcctgggcactgtggggtgctgaggagcatccctagcctccacccactccatgcctgaggcaccctgcagtcatgaccaccattaacgtccccagacattgcccagtgtcccctggggcagaatcgcccctgtgagacccgcataggcagtgggtggtgaccagcagcgctgggccatgcctggttcttcccgtttctaagtgtcctcggttccccgtcgcctgtgtggctcgttcttcatggtggtcattttcatcgcacttgggccagctcttacactgaatgctgatttccagggtccagtcactgcctttctccctggtaatatcatggtctgtatcccccaggtaccttgacacaggccatccgtaactttgccaagagcttggaaggctggttgacaaatgccatgagtgacttcccacaacaggtcatccagaccaaggtgcgtccggggtggggcctgggctccccaacgatggctgggaggggctccagtccaggacagcatgaggaccactgtgtcccagagagcgctggcttcttccctgtgtcatgagagtaaccgatcccttcaggaagccctgagcacactgccggtgacgcgtcagtgctggcaggaaggggaacaacagaagatgtcatttgatgtcacatctttgggtcaattcagaacagattgcgtgtttctgtgctcatcttattcgggaaatttaatctccttgctgtgacccttattgctgcaatcttggccacaaatcagtcgaatttgaaatgtagaaccttggccgacttgtggaaaagagagtgattacccaccgttctcacaagcatttcttttttttttttttttttttttttttttttgagacagagtctcactctgtcgcccaggctggagtgcaatggtgttatctcagctcactgcaacgtctgcctcccgggttcaagcgattctcctgcctcagcctcccgaatagctgggattacaggtgcccgccaccacacctggctaatttttttgtatttttagtagagacagggtttcgccatgttggccaggctggtctcgaactcctgacctcaggcgatccacctgccttggcctcccaaagtaccgggattacaggcgtgagccacctcacccagccatcatgagcatttcctgaagggctcttgggtgagaggaggcagctgcagggcacccgcctgctcttcggaattgatctgttaggcagtgatgcaagcattgatcaggtcattgttaaaaagtcacattcagggccggtgcagtggctcacacctgtaatcccagcactttgggagacagagactggaggatcatttgatgccacgagtttgagaccagcctgggcaacaacaagcaagaccccatctcttaaaaaaaataagattcccaggccacacccactaaaagtctgatcctgtagcactcaggagtctgtggtctcaacagcccctccagagaaccacagggactctagaagtgggcatggcgacagttgtgaattctaactcagcagcacgcaggcctcagttagcgacgtgtgtgatgtgccggcgaggtctcctcttcactgattctcacacactgggtccttaagaatagcaggaggttccctcttccctgcccaggttgctgtttcctgctccctcctccctgtgttgtccctgagcccacacacccctgcaaggagcgcagcggaacaggctctccctgcgaacccctgctcaccacgagccctggcttacaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggtgacttcctccacaccgtccccagggcccgggcttcccgccctccagcaaaaccagcaaacccaccaagtggagcccgtggcacaacctggcccctgccccgagcctggccacggttctgttgcatgacacgggtcccaggccaaagcccacccacagcccccagctctctccactccatcatctctcagggccctctggcgtccaggcgctgtggccaacacttctgctcattttcctcacaaaggcccccagcttccaggatcgtggcaccacgttgacctccctgtggccattttcctggctctgtcccctgggcttggcaaagtgtcggcccacagcagcttccgagctatgcttatttcaggccctgcgtctatccattaaataaataaacgcacacacatacatttagaagtgacccctttgaaacaaagctaaacaaagacctcatatagcatgagctttgatccagaaagacctgggtatgagtccccggaagccgggtacgatccccctcagctctctattctgcccctgtgacgggagacacaggacttggcttgcagctgtcaaggtcaagggcgagaaggctcaagcacagcacgatgtcccgccctgagcatggctaggtccagggagggctgccgtggctgggggtccacattgctgacactggcctctgccctgcccacaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacaggttagtcccaccagacctccgagagaattctggcgggtggggggctctgagagaaacttctagagggtagggggctcggctggtgagctcagagcaaaacagggctcagcagagttgcagcagtgtctgaacccgcaaaaaacaactacctggctgggggcctcactcatgaccagcggctcccaggggcaggcccagaaggccaccgtggcctaaatactaagttgcaagttctgcagacagaaatcatcactgagggctgggcatggtggctcatacttataatcccaccactttgggaggccaaggcaggaggatggcttgagaccagaaatttgagacgaccctggggaaaatatcaggacctctacaaaaagtaaaaaaacttagctggacgtggtggcatgtgcctgtggtcccagatacttgtgaggctgaggtggaaggatccttgagcccaggcggtccaggctgcagtgagccaagattgcaccactgtaccctagcctgagtgacagagcaagaccccatctctaaggggggaacaaagctatctcagaactgaagggcacaaggaggctcctggtgaaatatcgaaacaccaagtttgagaaacaaccataaaagcttccagagagaaagaaacaggctggggatgggagcagcattagacttccgaacaatgtgcagaaacccagaaggcagtagagcgatgtcctgagagctctgaagggaaatcatttccaagctacagacctaacctgtgcagaccagggcaggggagccaaggcttccagagggattgtccccaggaaaggcaccaagatgcctcctgcagttctgtcaaggagttttagtctccctgagtacatggaaaatgtgcatttttaaaaaaagagccagttattaccccaggaaaaaacaaagctgttctgtggctgacaggccccacgtgacccagcgcatggatgagctatggccacagggccaaattgttatccccacctgtattattagtccattctcatgctgctgatacagacatacccaacactgggtaatttataaagaaaaataggttgaatggactcacagttccacctggctggggaggcctcacaagcatggcggaaggccaaggaagagcaaaggcacatcttccatggcggcaggcaagagagcatgtgcaggggaactcgcctttataaaaccatcacatctcatgagacttattcactctcaagagaacagcacaggaaacatctgtctccatgattcaattacctcccaccaggtccctcccacaacacatggggatcattacaattcaaggtgagatttgggtggggacacagagccaaaccatatcactgccccagcccattgtgcaaataaagttttattggaacctcagccacatgcattaattcacagatcagctacagctgtcaatgcaaacaaaacagtttgactgttggctacaaagctgaaaatatttactatctggcaagcgtgaaaacgagtttgcctggccgggcgcagtggctcatgcctgtaatccccacactttgggaggctgaggcaggtggatcacttggggtcagaagttcaagaccagactggccaacatggcgaaaccccatctctactaaaaatataaaaattagtcaggcgtggtggtgggcacctgaaatcccagctacttgggaggctgcagcaggagaatcacttgaatccgggaggcagaggttgcaatgagccaagaccgtgctatttcactccagcctgggcaacaggagccaaactccatctcaagaaaaaaaaaaaaaataagaacaagtttgctgacccctcagctggccagccagcacccctgttctcagctgtctccttacacactcccctggccacgctgcctcagggcctttgcacctgccccccttgcctggaacatctttcccccagacagccacacagagaaacccatcatccgcagagaaatccctcacccccagcctctgtaaataagacggcccattctttcccactttgcatgccccatgccctgcctttctcctggcattgaccgtcacctgtcatctgttcacttgtctgttgtctgtctcctgcatgatcaggcacgctacccgagtgccgggacctcacttctgtttaaatgctggctcagtgaatgaatgagaggaaccacacgcctaatagactatgcggctctgccatggacctagcacaccactgccacataacagaaacaccagtgtagccagaaattacaataaagccacactgggataatgagggaggaagagcaagggaagagacagtgtagggatgccgatgccagtctccatggacagagggaaggttgcaagcggaagaattgagaagagcagagtgagcgcaggactgaggtgcctgccagccagagaagagcacagctcagagctggaggggatcggggtcacgtctgcaaggtgggggtgctcttcacaagggagaccgagacactgttccacttcattctcttgtttgcttgttttttgagacagagtctcgctctgtcaccaggctggagtgcaatggtgcgatctcggctcactgcaacctccccttcccgggttcaagcacttctcgtgcctcagcctcctgaatagctgggattacaggtgcccaccaccaggcctggctgatttttgtatttttagtagagacggggttttgccatgttggccgggctgctctcaaactcctgacctcaggtgatccacctgcctcagcctcccaaagtgctgcgattccagtcatgagccaccacgcctggtctgacttcattcttatgcacgtgcagtgcagtcataaaaaataaaaattaggtttacgggatttatttctgtagcacccactagaaaatggtagcatgtggactgaggccttggctggtcatccccaagctctggctgggcctcccttggtggtggtcggccgatgctcctactctctgggagctgcgagcccatttgggaacccagagataccggggtgaccgcaggcgatgttctggaaatactttggactgaagcatcgcaccagacaccggggctgtggggaagctggttgcagagtgccagcacctcatctgcgtgggggaggcctttggggaaagggggcttggaagccaacctgggtgggcccggaggaacaggagggggctgggggctttgcagctatgcttgacacttaaggatagacagctttggtggtcttcatagtgcggctgtctttgcctttctcaagcctgtgtcttctttttatcgctcgataccgattagacgtaacagagtttatgaaagtatacttcgagccggggcagttgggcattgggggccgcctggcttgtaggccaaagtttttaatcaggtgccactgtatataagtcctttaggtcttataggaggactgagacattgttccacttcattctttttttttgagatggagtgttgctctgtcacccaggctagagtgcagcgacatgatctcggctcactgcagcctccgcctcccaggttcaagcaattttcctgccttagcctcccgagtagctgggattacaggcatgtgccaccatgcctcactaatttttgtattcttagtagagatggcgtttcaccatgttggccaggctggtctagaactcctgaccccaagtgatctgcccgccttggcctcccaaagtgctgggattacaggtgtgagcgaccgtgcctagccccctttggtcttatactgatcctttaggtcaggggccgcctctcccagaaagaaccaggtagtatttgcagccatcctaggaaagacaacataggaacgggcatgacgcgtgccagtgaaactgtctgtggacaccaaaatgtgaatttcatgtaatttccacgtgccaccgaatataattattcttttgactttttccaaccatttcaaaatgtaaagcattgtcagcacacaggctgagggctggacgcggactggatctgggctgaagtctctgaaacccctgctttcgctgacagagactaaagcaccctggctttttgtcttgtttttaggtgcctgaaaccacaggctgaggaatggcgggaggtggcaaggatacggggaaggtggggaaaggcgcctcctgctggggagacaggcaccagctgccagcctgtgctctgattcggagtccgaaatgtcactagaaagactcaccagctaagatcccatctagcgcctgcgctagcaccagccacagttgtttcccgcagcctgtcgctttggggctgactgcccatctccctctcctgttccccaggtggtctctggaactgagcgcgcaggccggccccacctgtccgtcacgtgggcccagggtctcggcagcccgtcagcccccgcgtaggcctgcacgtcttaggatcactcagcctctgggttccccagggaacgtagagcagggggtgtgttgctgccatgaagtctggcctggggcccgggttccatgctcccctgagggtccccagcctctgtccgcttgtccccagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagaggtgaggaccctcctgggtgggacggccggggcttggccgggcctgtggggagagggcggtgtgctctgagcagcccagagagaggacactcgcaggtcccactgctctgccgcccggacagagctgcagctcgataaagaacaagccacagaaacgggcccacccgtgccaggacacagcagtgtctcaaaacatcaaaaccacaagttttatcagcactgggaaggatttggggctctgtccaagttcacagtccccatcgcaccgctggctctggaaggaggttgtccttgggcgtcccgccacgcaggggaggcctcggacacaccacccagagttttctgtttattgtggtaacacacacatagggagagatttccacgtgaaagcgcacaatcaagtggcgcttagcacatccacaacgtgcagctggcacctctgtccagttccagaacattccgtcaccccaaaaggaaaccccgtccccaggagcagtcattcccaagctcctcctgcagcacagcacccacgcagccccctcctgcctctgtggatcggcctgtcctggacacttcatagaaatgggatcacacactgtgtggccttttgtgtccggcgtctgtcacggaacgtgacatccgcgctgcggcccgggtcaaagcctggttcctctcctggctgagttgtgttccggtgcgtggctggccgcgctgtgctgaccgctcgtccctccgtgctgcacggtcgctccctctctgtggccgtcgtgaacggggctgcgtgggcgtgtgtgggcgggtgtttgtgcacgcgctccctctctgtggccgtcgtgaacggggctgcgtgggcgtgtgtgggcgggtgtttgtgtgcactcctgtgttcagttcttcggggtccacaccttggagtggacttgctgggctgcgtgggatggcctccaggaagaaacgagatgatgcttgatgaatggcggggtccctgcactcttactacccagaagccacagcactctaagagtcggtggccagggccccgcaacgtgtacagaaactgtggaagccgcctgttctctgcacattggcgtgaacgccgggctttggggcagccaaggagtggttttcctgctgtgtacagacttcagggagcaaagataatttggcccacggctcttccatgccaccttaaaacccggagcagccgcacccaggggactttgggagccagctgctgtcccctcgctgccccgagtagtcagcaccctccacccccagcagctcccagaggcggcctggacagggcacagggacccacccagacacctggcagcatcagagccacatttcagggcaggccccagctgcttcactgtgaatggaggacgtggctcaaggcaaggttgggccggcatcccccgagcccccaaacagcaactgccgcccctctgcaggcgcccctgactccaggtttctctttcagttcaacgatctcgcctctctgtcgctgacgctgctcgacaaaggtaggtgcgtctgcggctttcccaccacgaccctcccaggagggtggtactcctggccgtggcctgtctgccccatctcatgatgaacaggtggaaatgcgggcagccccttggggggtgagggccctgggatctgtcatccggacagtgggtgatgcctgggcagcaggtgacactgcagactggctcggctggggctcagactgccgctggcctctgggtagccgctgcccagggacctcagcaccaggcccagactaggcagcccctggtctcctgcgcccacgcccagcaggagagtgggacaggcaggccagagggacccccgggccccgtctctgtcccatgcgggtgggaggaccccagaggccccagccctgtggggagcaggccccaggcccgtcggcgctgggaaagggaggcacagggcagaggctctttcgcctggcccgagctgggggcacctctgggtaacggcaggtggggaggacaggtcagcctggagcagaggccgaggtggggtccacaggctgccatgtatcctcggtgccctgcctggcgtgccggagcagttctcggaacgtgcacttccttctctccctctcgtgccctcctgatgatggacactgaccctacccctccctccgcagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaggctctggcctgtctttccgatccacgaggaggaacagaggtggcagcgaagccacaagcctctcaggcctggtctcatttttcatagcagtaaacacactgagcgtgcccatttttggactcactgtccacactctaggccctgtccccccgccgtgggacaccagcctgccgggcctgccccactcaagacccagaggggaaaccacagaggtgccccctgcacttgcctgcgggctccctggggatgttctagtgccttccggaaggagcctgggccccttacttccttagcaaggcctatcctgagccagtgatggcgcagaaaccgttctttgtccaggatggtcaatggctcctgtttacactttgggtttttttctgttgtttgtttgtttttttaagagacggtctcattctatcacctcggctggcgtgcagtggcactatcatagctcactacaccctcaacctcttgagctcaggtgatcctcccacctcagcctccccaagtaggtgggactataggcgt

SEQ ID NO: 13607 - DNA, 15756 bp, Human
gcgtcaccgacggacagcaccggttccgaatgggagagccgataacgcttaacccccagctcactctcaccaatcgctataaagattgtccggatgtgatttaatgagcagtttatctaaccaattgtcatggatctgatatccggcccttaaagcggaatttctccacccactcttaactgtccgggactacattacccagaatgcagcgggagcagacaagggccacaaagcattaaataaactacctttcccagtatccccaaggacggacttcctcttcttgacccagggatgtggctcccagccagagctgaggcttttggtaaacacacgcatctgttcaggcctgacctgttttcctaatcttcctggtccacagagaggcctaaagctggcctcaggttaaagtttgaccctaggatgacctatgaccccaggctgagaccccagccttaggctaagccttttattccagagtgaggcaattggagccccacccccagattccaggctagaccggactccgggctgaactctgaccccaggtgaactccctctctgcaagttgagtcctaacttcagcctgaaactctgacaccccctcgtcccccacaccacacactgaggcttaatctctggtttaggccaccgatctggactagccctgactccagattggacctgaccccttaccgggttgctaatccttctggttaagcctctggcctctatcccctatccccacggtggtgctgacctggactgaaccccaattccagtttgagtctctgagcagaggtgaactcagaactttgctaggctgagcccccatttgagactagccacagaactcactgggttcaattgcccaactgcaatcagacattttctagctcagaagccaccagcaggtggggccaggtctcagcagagacatcagtcccagtgtgggctcccaaggctctcctcctgggctcagctgtatctctctgttctgggagcctgggtgctctgtgtaaggggaacgtatacccaagggcccccctgcaagacgcccagccttgtctgaggctgcagagaaagcgccaaagcccggagagaatgggagtgggaatccccagtgcctcctctcctctttcattccagcacctcaaagggatttacaaggtgtgaacagacttttatgggagaggtgacagacttcccttctccagggcccagatggcccagatgtctgggggaggggcggagtcggaatctcaggggcagtactgagaatgaaaccaggttaaactggaaaatgggcagatgcaggcgcgaactggaaggcagctggggaaaggcctgggcctggcgccccaaggacggcctgtcttcagtttcccagcggagactctgggggagggaaggcaggatgcggtgcgggagttaatggacctggccttggcgaaggcgcgtcctgggttggatcgaaaccctctcatccgccctgtggccggagggaccagaccattagtgggacgaacctagacgcctggagccgggccggctcgcaagaacggggtgacctcaggttgcccctgcaatggggttgaggaaggacttcttgagtttggggttttagtgtcttggccctttaaggaataattgcggggaaaggggaaaaggagatgggaagaaccgtttggagcggggaaggaagatgagaggacgagagggaccccggggatttggaaaaaatgggtgggggttctttaaggggtcggtccagcggcgtcgagtggcaacgttgctttaaaagggggcggagcgtccgttgggccccgcccccgaatcgcagtgcttgggctccgcgcgggtgggggcgtggcagagcgtgcaggggggcggggaagagtctggggtgggcggggccgggcggggcggggcggggccaggcgcaccgccctcggctgagtctccccggggagggcggcgggcggcgggcggcggggaccgggtgcggtggtggctgcggcggcggcggcgggagcagcatggattggggcactgagctgtgggtaagtccaatcggcccgcctctaagttcccctttgctggggtccaggcaccccccttttgtccccaatgtatcttagagggggctccgcgcctttcccttccaccgacccctgggtccccgccctccaccctccgctctctctcgaagtttatctgggagtctcagcacgctcaggggcgaagggcgactttgccggaccggagtggggaaactgaggcacagggttgcgaatgaggcgggcagaaggaatcctggggccaggccggggcggctgagagaggtcacctattttgggcgccctggccgggcaggcggcttatcttacggcccctgggtccctgcccgtcgtccgcctgtccggctaggaggggggaggggaccctctggtcaccctcatccccacccacgtgggacctagaagtcctgaccgccctttccctcgcctttaatcaacacctaggggctggggacgctcatggaggggaagggggatgctaagctcggcctgatccccctccctggcttccccctgctcaccccaggcccagggcgggaccgccccctggtcgcctataacctcagccctggaagccccagaaatttccccctatcctagccggacctctgacccctccccttgctgggggcggtggaatccctgagttcttagtgcagcgggggtaaccagactgccaccccctcctccaattctgcgatttcttttggatgtgtagtggggtcagtggggtaaattgagtcacccatcgggggatccctggaagcagggagattcagggaacctggtgcctgccccctggccactcaggggcccccagtctgccaggaaccctgcccctctggccttgactcacgccgggccggccggattttccggaatccggggggattaggggagcccgagctgggggagtggccctgtccccttccacgcccctcttggcggtcctatgtcggagacctccatctcccggccggggtggctggggcctgggcgctgttctccggcccttcccgggaaggggagggggttcccgccagtttcctgcctccccccgcgccacgccggggcggcgccgggaagccactccttctaggagcgcagagccttggccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggtgagaccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaagtaaggttggagaggggctgcagggctagatttgtggggaaaggcggtgcttgggtctcacttcccctccctcagctgggacaccccaccgctcctctcacttccccttctagaggtgagagcatggatgcaagatgcgggattatctggcttggaatcctgagtccactactatgtagagaaattgacttgggcttgtgactcaggttttctgccactattttccttaactgttaaatacagaggccccagcagttacaaaaccagtaactttgggcagatgacttaaagttttgcgcctctgttttcctcatctgtgaaatggaatgatgacgattcctccagctttgtagggctttcatgaacacgagctgagtgaatgtgtttaaacagtgtgcagtccatatcaaacgccgtaaggagcatttgacttggaattgagtccccaattccaaaatccaaaaaagccctggaaatcaagttgttttggtcacttgtttggcagcaatctctgacctgaactttttgttaattgtagttgttttgttttgtttttgacagagtttcactctgtcccccaggctggagtgcagtggcgccatctcagctcactgcaacttccgcctcccaggttcaagcgattctcctgcctcagcctccctagtagctgggattacagtcacctgccaccatgcccagctaatttttatatttttagtagagacagggtttcaccatgttagccaggctggtaattgtagttttgacttttatcccacttagtgtgaatgttaacacctctcattgtaaaattaaaaaaaaaaaatagggttgggcacagtggctcacacctgtaatcccacacattgggagggtgcgcaggtggatcacttgaggtcaggagttcgagagcagcctggtcaacatggtgaaaccttgtctcttctaaaaatacaaaaattagccaggcgttgtggtgcgcgcctgtaatcccagctactcaggaggctgaggcatgagaatcgcttgaacccgggaggcggaggttgcagtgagccaagatcgcaccactgcactccagcctgggcgacagagtgagactctgtctccaaaacaaatagatacggtgtttgattacaaaatgatgtccccaaccccactaagatgatgcagaaaagatggtataagctttgtacaccatctttaaaaactggaaaattctgtgttccaatatacattcgaggtccagtgcggtggctcacacctgtactcccagcactttgggagggtgaggcgggaagatgcggagttcggggggattggagtttgagacctcatctggaaaaaaaaaattagccaggtgtggtggcgtgtgcctgtggtcccagctatttgggagcctgaggtgggaggatcacttgagcccaggagtttgaggctgcagtgagacgcaatcatgccgctgcactgcagcctgggtgacagcaagaccctgtctcaaaaaaaaaaaaaaaaaatctactcaagggttggggttaaggaatatggaccagaatttgtcatcgcttcaaggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcgggggggcggtgcggggtctgggacaagcttggggagtccgagtgggacgtgatcggaacctggcagtaccttccacctctgcattcttcaggccaagcagcaagcccaccttcggagtcacatggccgaagaaagcaaaaacgaatatgcggctcaactgcagcgcttcaaccgagaccaagcccacttctatttttcacagatgccccagatattcgatgtgagtgctcccagttctcagacctaccttcccgaaagcctccaaatgttagccaactcctacgcattcatcaaaaccccagctgcaatgtcccagtccctagattgaaagggaatcagaaacctatagtaacagtgagctgtgcttttagtcagctgttcttcctgctgggcatgccttttacttgtttgtttatttacttctatagagagatggggcctggctctgtcacccgggcaggagtgcagtggcataatcacagctcactgcagcctggaacccctgtgctcaagtgacctttctttctttttgaaattcctacttattcttctaagctccacctctaacaacccctctgaaaggtctcgaatttcccctctcctgtttcaatctagcgctccactctctgtcccatccgtggccctgggagtatcagggctggttctgctttttcttcaaatccctgttcccttgtctcctcctttgagaagcctttgctgaccccctaggcacgcgtccccctctgagatccccctggccctgtgtctcttccccaaccacagtgggctggagtctctcttcccgactctgtcttcccctccagactggcttggggctggggccagcgtggagcgcgatcatatttgcagagtgaatcactgtgcttctagtccctctgttagcacccctgagccacccttgtccctgtccttacagaagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgtgggtgcctggtctgggtccactgggctacgggaagggcagagggaggtccccataggctaggcactcgactgctcatccactgtccccctcccccaggactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtcccgggcaggaattttcctcttggctgccagcccggactggagggaaggaaggcggccgattggcctgggagtcccccgaggcgaaggcgggggcagggtggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcttaaacttctgatgcccctaacccctctcattttcctgccttccactccctctcggcttgtggttttatttttgtttatttatttttgtcctctgtggcctcttacctgtctgagaccttgattcctgcatgcgtcttctagactgtcagcccagaaagctaagtggacagagagacatgggcctccctgcctcctggacccatgcttgctcccggacataacattccagagacctaggagataccgggggagtgagagttctggctttcgggcttacagttcaacatcctccccgccaccttccagatttttttgtgtcgctcctgcatgcgttttctctgtgtggttgtgcatcttgagttgtggttttcttaccgttttttttctttctccattttgtttttcctttttcctttttttgcgtccatccgtccatccgtgcgtccatccctccgtccattcgtcctcactctctacatcctcctatgcccccccaccccttcaacctatccccctccccggcccccgccggtagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtggggtaagtgaggcctcggggcaggaggaggtggtggccctagcctgcccagcggcgggtggcgggaccctgggctcgcttcctgccgctggctgggcccctcttccctggttgcccaacccagacctgctttgctctgtgcatggcttcgctgtcaagaaccatggctggggaagggagtgaaatatctcagacgggtgcagagtctggcaggctagactccttgatcccaaattcagccctctacccaccttgcagacagtggtgaccgaggattttagccacttgcccccagagcagcagcgaaaacggcttcaacagcagttggaagaacgcagtcgtgaacttcagaaggaggttgaccagaggtaaggtggtggggtagggaaggacaggcaaggaacatgataaaatagtaaatgaacttcacttatttgtttattattttattttatttattttattatattttattttgtgacagggtcttagtctgtcgtccaggctggagtgcagtgctgtgatcttagctcactgcaatcgccacatcccaggttcaagcaattcttgtgcctcagcctgccgattagctaggaccacaggcatgcaccagctaatttttatatttttagtagaggcggggtttccccatattagccaggctgtcttgaactcctggcctcagttgatctgcctgcctcagcctcccatagtgctgggattataggcatgagccactgcccgggtctgtaaatgaatgacatttaaatggtactcaaagatctccccaataatcccaaggccccgacggttttacaggtgattcctaccacacttagttacttcttggccaggtgcagtggcctgtgcctgcaatcccagcattttgggaggttgaggcaggaggatcatctgagcctaggagtttgagacctgcctgggcaacagagtgagaccccatttctagcaaaaataaaaaaattagctgggtgtggtggtttgtgtctgtagtcccagccacttgggaggctgaggtgggaggatggcttaagcctgggaaatggagactacagtgagctgtgactgcaccacttgcacttcagcctgggtgtcagagtgagaccctgtctcaaaaagaaaaaaagaaacagttacttcttgtcttatacaagtcattccagcaaacagaaaaagtgtgaaagctgtcaacctctttaggctgaagaatcctgattcccaaatctgtggccaagaattcaataagataaaattaagggctcattttaccttatttatgatcatagaggcaaaatcctagccaagcaaatccagtgtttaaaaaataatacatcactttgggaggccaaggagggcagatcacgtgaggtcaggagttcgagaccagcctgaccaacatggtgaaaccccgtctctactaaaaatacaaaaactagctgggcattgtggcacgcgcctgtaattccagctactcgggaggctgaggtgggagaatcgcttgaacctgggaggcggaggttgcagtgagtcaagactgcaccactgcactccagcctgggtaacacagcgagtctctacctcaaataataataataataataatacattagccgagcacagtggctcatgcctataagcccagcactttgggaggctgggtagaaggatcactcacttgagcctaggagttcaaggccagcctgggcaacgtagtaaaaccccatctcttagaagaagaagaagaaaaacccaagtaaatttttttaaaaactaaaaaaaaaaaatccaccattggttgggttttatcccaataatgcaaagatagttcaatatcaaaaaatgtatccatctagttcaccacattaattggctaaaagaaaagcagcatatggttatctatttaatagctcaaacacttaaaatattgacaataaaaaaatctggcagattaaaaaaaaaatctttactcactctttccaggcaacaaaatcctcttcccagttctgttacataataggaatgatgtttgccacttgcaaacaggcagccaaattatattttgccatttgcatgtaacctcttggacagaatggcttttattggtgtaaagttccattcagaactctctagttcctgagtttctacggtggaggggttaagggtgcatgttctagagtcacgacaaactggacttgatttccagcttcatctcaggacttgggcagcctgttttaccttttaattcctcagtttcttcatctgtaaagtggatcaggtattagaactggaatgaagttggcagggtgcagtggtttatgcctgtaatccaagcactttgggaggccgaggcaggcagatggcttgagaccgagtttgagaccagcttggccaacatatggaaatcctgtctctactaaaaatataaaaattagccaggcgtggtggcgtgtgcctgtagtcccagctactccagaggctgaggcacgagaatcacttgatcccgggaggcacaggttgctgtgagccgagattgcgccactgcattccagcctgggcgacagagtgagactgtgtctcaaaaaaagataaaaaataactggaaggaagttgagctcagatctggtcttttccaaaggtccattatagtcgtgactacctgtatatatagacataggggagacagggatgagaaactgatgataatgataacagtatttattagtcacttactgcattctaggcactattcgaaacagtgtacatggatttattcgaattttcaaggtttcctgagagattgtatgcagacttaagatctgtcttgtttagtgttatatttatctttatttattttttcccctgcccccccttctttttttattttttaaaaattattttgattttttactagagacaaagtctcacaccattgcccaggctggtcttgaactcctggcctcaagtgatccttccacctcagcctcccaaaataatgctgggattacagatgtgagccaccacggccagcccagtgttatatttctgatgcttggaataggacctgtatgcagtaggtactcaatatgtatatgagtaatagtgaggacttactaggtatcaggcattgtattaatcctcacagtgacccacatgagatattaggatcattatctccatttccaaaataagcaaacagcagtgggggttcaatgatttaagccaagctcacacagctaggaaatattcaaactgagattcgaacccaggcagtcgggcactagtatttgcatccttaaccattgtcctgccttgctatttgctccttgatgcaaaacccctgttttttgcttgttaaatcacatggagcccggtgctgtggctcatgcctgtaatcccagcactttgggaggctgagccaggaggatcccttgaactcagcctgggcaacatagccagaccccatctctactaaaaatttttgaaaaatcaggcgagtgtggtgatgcgggtctatagtcccagttactcaggaggctgaggcaggagtatcacttgagcccgggaggttaaggttgcagtgagccatgattgcaccactgcacaccagcctggggaaagagtcagaatgagaccctgactcaaacaaaacaaaacaacagcaacaaaaaaactcacacggaagtatgttttcctgtctatcctgtctcccttgtcatagggaagccctaaagaaaatgaaggatgtctatgagaagacacctcagatgggggaccccgccagcttggagccccagatcgctgaaaccctgagcaacattgaacggctgaaattggaagtgcagaagtatgaggtcaggaaagaccctggggaggggcgggagccagcgggcctggctgagtcactgctgggtggggtggggggtcggggacaggggaggtgttcggagcggggggtctccagctgttttccatcacagccttggctgtgcgtgggtgatctcagggaacctctgggtccaaagtgggctgaccccggagctctgccctggaacgattttcctgtcccctcctcccaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagaggtgaggggtgacgtcagagtgggtctgttcccagggtcccaggagggcctgtctttatctgccgaattatccccaaacagctctgaagagcctccctcagaagagagccaggacacccccatttacacggagtttgatgaggatttcgaggaggaacccacatcccccataggtcactgtgtggccatctaccactttgaaggtgagaacggccagagtgggcttggcggggtatgggaggcagtgtctctggctaggttcagtttaaattcgcctaaagcagggctgggcgggtggctcaggcttgtaatcccagcactttgggaagctgaggcaggcagatcacttgaggtcaagaattccataccagcctggcgaacacggtgaaaccccatctctactgaaagtacaaaaattagccaggtgtggtggcgcacgcctgtgatcccagctactcgggaggctgaggcaggagaatcccttgaacctggaggcagaggttgcagggagccaagatccgtgccactgcactccagcctgggcgagagcgaggctctgtctcaaaaataaaaaataaaaataataaattttgcctaaagcagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaagttcctagagtcggtgtcttattagaggatttaaatactgggactggaagtatctaacaccacgtttcttacaggccacacagggaatgaggaaggggaggtgatcttgggcacaccttgggtcaaccctgcccctttctggaagttggcctatgtcattgtcagtgggtgtctgcttgtgactcaggtagggagaaggataccaagtttcttttttttttctttttgagacagtctcacccagttgcccaggctggagtgcagtggcgtacgtgatctcagctcactgcagactccatctcccgagttcaagcaattctgcctcagcctcccaagtagctgggattacaggcacacaccatcatgcccagctaatttttgtattttttgtagagacagggttttgccatgttggccaggctggtcttgaactcctgacctcaagtgatccatctgcctcggcctcctaaagtgctgggattatggcgtgagccaccgcacctggccaggacacccaagtttcatcccttctgaatgcactgcagcttctgagaatgggtagcacttattgaagacctactgtgtgccaggcattctccacctggggtctcattcctggccacaattcttagaaagtacacagcctcaacttttacattttttaaaagttttttatttttcagtttttgtagagatgaggtctcaccatgttgccctggctggtcttgaactcctggcctcaagccttccttccgcctcggcctcccaaagtgctgagattacaggcctgagctgctgtatggctatgattttgttaaaggccgacacagaggtgaagtcaactgctagaaatcacggcttttaagaggtggagtcacatttgaactctggcctctgatgccagatctgcaggtcacatgttcaccatggtccaggtgaccctgactgcggtccccacctcttctgtgaggcacagggcaggattccacctgaggcgcgaggagcctgggacgactcctttggtctcttctggggttcgcaaaaacctgggggtcccgggtgtgaagaagggtgtctgcgctctcagcggtcaggctccaggcgctgcgacaggacgccgaggacgcgctggaacttctcaaagcgttcagcgcgcggagctcccgcgccccggctaccccagagcagcctccgcacgaagccggtggtcagggcctccctcagctccgggttaggccggaatcctggaagcaaggtcaggtgggctgggggcggggcccaggcgcccgcctcgcccctcccaacctcccggcaccttcctttccccagaggactttgacccaacaggggcccgggagggacctgccccacctgcgggatgactaggcggggtcagaggggagggggcttccagctctctgcaggaatgggggtggggtgcctgaggggctctaccgcagtgcaatggggtggcctgttccaggtgccagatcctggaggtcccgccttaggggctgtgcctggacgtggggctgccccgaggacgggatcccaggttgtcggggaaggtggggggatcttgccgggtgggctgccctaggataggacggaggagtcgttttggagggagcagggcgttcttggggatcgagatccctgggggacgggatcgtcttaggtgggaagggggagtggggacccgcggaggtggctctgggggcaggacagcccgttttgaggtggacggccctgttcctatcaataccgctggatgcagcgtttgcttggggtgagaaccttcctggagtggagccgtcccagtttgggtggggctccgggaggcgtggcgagaggctcccctcctgggacaggctgggtttgggggatccggttagaacctgcagggtgctctgaagtctgcagtccagcgcagagggaacgctcacctcgcaggcgctgggctgccaccttgcg

SEQ ID NO: 13608 - DNA, 69062 bp, Human
  misc_feature (1)...(69062): n = A,T,C or G
ctgatttgtgaattgaaaagattacttgaaatttggaatgtccctggaaatctaggacttctggttattcaggccaggcgcggtggctcacgcttataatcctggcactttgggaggccgaggcgggtggatcacctaaggtcaggagtttgagaccagcctggccaacgtggtgaaatgccatctctactaaaaatacaaaaattagctgggcgtggtggcgggcgcctgtaatcccagttacttgggaggctgagacaggagaatcgcttaaacctaggaggtgttcagtcggttgtagtgggccaagatcacgccattgcactccagcctgggcaataagagcgaaactctttcccccaccacccccccccaaaaaaaagaaaagaaaatggatcgggattttttttttaaacggcatttactaaacagctaagtaccttctatgagcaaggcactgtacaagagctgttggggataccaaaataatacaatctacgatctactaaagttacaagccggacagtatggtgactggatgttcagaaaagaaaccagatgacattattatggtacaccaaaaaagccccccaaaaaccgtactcaactgtcacattcttatggaatacaatttttacagattgtatacaatttgcatgtgaaattctgcttactttttgactaggtatgccactaatgggtatgtttaataaagatattttatacttcagatgtacagaccaggtccggttaattttagccaacaatgtattgttgaaaaagacgctgatattttactgcggcaaaccaccattaacataaattttaaccacagtttgagtattttattaggaataagccttgaaacttgaataggactagtattcctaacaatttaccgtttcataataaaggctgtctcactcttaagtggaaaacgtattatgtcctacttttataaactttggttgaactaaataaaacagcaacatgtacccaacgtttttagactgttttattcagtaccataaacattcactaaactatacagagctaaaatcatgcaaaagattgcaaaacaaactgccttgggaaatttccagtctaagctaaatggaccaagtataggattgaattttaagaagttggtgggaagattccagctcttgtactcacaggtaaggtcctaggattctatttgttgaagtgtctgcagaccctctccctacagcaggggcgtggagcaaatgtgcattcaggaagtgcttattagtccccccaaaacctttttcgtgacgacagacggatggaggcctcagacgactccggcagtaggaccctgaaccaaatgcctgagctgcgctcgaaaggctcgtctcgcaggagctggcgagtggcacgggcttcggtggccgggctcggggctcggggctcggggcccggggccggggggggggggggtccgtgcccagggcactctgtggctcgattcatgtccccgccctcccacctgagcacactgggcagagagcctgcggcatcgggccagtcgcgcctcctcgtccgccctgggcaggtcgctgggccccaggccgctttctacagctcctttaataaaatggacagcaggggtcctaaccagacgtgggcatcaagacaaaggaggcggccagacgcgcttgagggcctgctcgctagctcccgcccccccattccgcggtcacccggggacagaggccaggccggactgggtggagttgggactcatacgtctgcgtcccaggaaggcgccgggcgagccccagctagacgtgacgggcggggccgaacacggcagcggaccagaggcccgcggcgcaccggcgtggggcggggcaagcggagcctcccgggatgccgcgcggcagccggcttccggctgtgggtggtgcgggggacagcggcggccggaagctggctgagccggcctttggtaacgccacctgcacttccgggggcgtcgagcctggcggtagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcggtaaagacccaggggagttggcttaggccggcgcctggagcgctcgtttgagggaagagcaggggagctgggtctatcaggtgtttgggggcggggtattggcgatggtggcgcgtccctaagttttcagtgtagaagggggtgtggctctcggagtttggggaaagaataaaggagatgggcctgtctctgagtgggaaagggctactggacgggctccatgtagtgactgagcgcctgagaggggtttgctccctagctttgtgttcggggagggtgttgggaaagcggtaaggagtagggtggctggatcttgtttggagagggagatgtggtcagggttcttgccttagtaaggaacaaatctagtgttgtgtgttcctaccagagccagaaaggaagggcccaaagctccagaattcttcctggtcctcgaaggagggaactagaatttctgctgtaggaggtacttatgcagtaatctcgttgggaggcggagactggagttggagtcttaagagttgtgtttttgcgaacatcctaagcacgttcttggttatttcaattgtagcttattggaggtgcttgggagatggggggaggcggaaacctggtaagccaactcgtgatgctgccactatgaatgctttccttgcacttttaaacaaagaaattatcaagagtgacgagtttgatgaatttagaggctagaaagtagagggttcctatttcattagattttccagagagattggattttaaggatggagatgcattaagggatctgaactttggtggaagtaagtttgcgtgaacttttagtgtattttaaaatccttttatctttcaaaaattgacgtgtaagatactttaattagtaataaagtgtgaaataatgttttcccagtgtgtgaaattgtaggcttgcatggttgtactggttcccaaatttcaccatgataccatgtgtagtattttttttctttatatttagtggacagaaattgtaatggattgatatggatactaaaggtgttgagagtgttatcacttgaacagctgtcttatgattctttccgattgaaatggattacaagtgactaatgaaaggcaagggatcttgttaggaagtgctgagaagtggtaagtcagtacaaattgaaggacattttgaggtaggattgtggttaggatggagggatagggtaagggtcttcattttaaggataaatgttagtaaaaagaataaatatgtattttgagatattaaaattatatttgcaccaccctgacacaactgtttcacttatgttattaatctgttgttcgtaggtaaaaataagcatgagtcccaaggaagcatacagtttaaagagaaacattactttctagatcaattcataacatttgcagatcgtaaggttttttagaccattttttttttccaagacagagtcttgctctgttgcccaggctggagtgcagtggcgcgatctcagctcactgcaacctccgcctcccggggttcaagcagttcacctgccttagcctcctgagtagctgggattacaggcatgtgccaccacgcccagctaatttttgtattcctagtagagacggggtttcaccatgttggccaggctggtctagaactcttgacctcgtgatccgcccacctgggcctccctaagtgctgggattacaggcatgaaccaccgctcctggcccatgtgtttgttttttatttgcaaaatgcagaccacctgtgccagaagaatgcatagacttttcttttttcttttcttttctttttctttctttttttttttttttgaggcagtgttttgctcttgttgcccaggctggagtgcaatggcgtcatctcagctcaccacaacctccgcctcccgggttcaagcaattctcctgcctcagcctcccaagtagctgggattacaggcatgtgccaccacgtccggctaattttttgtatttttagtagagatggggtttctccatgttattcaggctggtctcgaactcctgacctcaggtgatcagcacacctcggcctcccaaagtgctgggattaaaggcttgagccaccaggcccggcctctttttttttttttaaacgaaatatttgaaggacacacaagtattatacgtggcattggaaatacaaagatcagacgatatccatcttcaaatggttatagcatagggaaatagacattcatttaggacacttctaaaacagcatagaggagagtgctagagtacgttatagcaagtgttatcaccaaatgaatcttagagatcaagtctagttttcaaataaaggaggaggaaaatgagtctcaggaagatgctgtcagttgtcaatgatgaacataggccttgtgggtatttttcttttgaagaatgactttttttttcagtttgtttgacagcttacaatataatttgttacttaaccttaccattagattgagttggtcaagactagcaaatagtttcatagttgaaaaacatgctttattatttattttttatgtttattgtcctacaaatactactatattgcagtactcaatatcgattaggcatatgacaacatttttctgaaaggcaaaaaatacctaataaaatgaagcctggtttttagagtcctctatgggtcaccaaaaatgatttcaattgaactgttatgaattgcataatttaggaaagttatgagtcatatgagcttagtcatgatgatatcttgttgaagttgcagctggggtgtataagtctcactttgatttcaaaatcgttttccctttgtgttacttttaataaaagaggatgtagtgggtgggaggaaaaaatataggtcacagatgagggatgagaaagtttgtatctgaaacatgtattttcaaatttaccttgaggttattggcatggggattctccatattgcagtgctgatttcattattgacagcaccattttactcagtattttgacatctggctttctcttttgatgttaattttgcttactggctgcattcctttgaaacctaaatgcttaactgccctaactgctccaagggagatttaatgtaactctgctttatattagtctaagagataaaccatatttcaagagtagaatggagaggaattaagcagataattgtgatggggaaactggagagatccttttgactttcacaggatttcctagaacattaaatataggtttcctccaaggccaattgtggttgatttttggatccttcaccattttctatttgtgagataataagtgtatacagctggaagtgtaatgtgaagaaagtctgaaaaagattgataggaaaggaggacaggaatgggcttcattgaggtaacggaagtgaaatgaaaggcttttcatatatgggttgagcatccctaatctgaaatgctccaaaatttgaaactttttgaatgctggcatgacagcacacattacccctaacacacgattttttcactgttagtggtatattttttactgtgtagtacttatgtgtgaataggtataacaaaacgattacttattgtagcatgtaaaatcagtcaggaatgatggtgatgccagacaaccacagattatttatgtgggtggccgagacagtgacacctttgctttcgaatgcttcgttgtacacaaactttttttcatgcaaaaaaagttacttaaaaatattgtttaggccaggcgcggtggctcatgcctgtaatcccagcactttgggaggccgagctgggtggatcacgaggtcaggagatcgagaccatcctggctaacatggtgaaaccctgtctgtactaaaaatacaaaaaattagccaggtgtggtagcaggcgcctgtagtcccagctactcgggaggctgaggcaggagaatggtgtgaacctgggaggtggagcttgcagtgagccgagatcgcgccactgcactccagcctgggcgacagagcaagactccatctcaaagtaagtgaataaatgaaacataaatgaattttatatttagacttgggtcccatccccaagatacctcattatgtatatgcaaatatttcaaaatttaaaaaattctgatgaatgaaacacttctggtctcaagcattttggataagggatgctcaatctgtatctctttatttactcctaaaatcagccaaggaaatgggcatctctccgttcccccccttccttttttttttttctttgttgttacatgagttgtactggtttcacttcatttgacagtgttctgctaatgactagacgtgtatctctgacctggacttgttctctggagttcatattcagctgcccatttggcacttcaaatataacatgtccaaaattagttaccttttttttttttttgagacagagtctcactgtcacccaggctggagcgcagtggcgcaatcttggcttactgcaacctccacttcccaggttcaagtgattctcgtgcctcagcctcacgaatagctgggattacaggtgtcccccaccacgcctggctaattttttttttttttttttttgtatttttagtagagatggggtttcatcatattggacaggcctgtgttgaactcctgacctctggtgatccacctgcctcagcctcccaaagtgctgggattacagacgtgaaccactgccccagccagttacctattcttttgattacaagaatgagtagctggacacagtggcttacacctatagtcccagcactttgggaggctgaggccggcggatgacttgaggccaggagttcaagaccagcttgaccaacatggtgaaacctgtctctactaaaaatacaaaaattagccaggcgtggtggtgcgtgcctgtaatcccagctacnnnnnnnnnnnnnnnnnnnncctaacctgaaacttgcatcctggttactggtcttgctggagagtcttggctcaggttacgtcccaggtctgttgaggagctcttgatagggaattagttgaagcagctcatactctatcctcctttactggtataaatccataaaattgtttagttcccaggctctggggtccctggcctagcagagagcactgctccctttttctcattccttagtcccaacaacccgcacctgacacttactacacgtggcctgcttccctgtcctgtgtgttttggggggtgctgaagaggaaggctcctgtgtcttcagcacaaacacaataaacacttcacagcagtactggctttatgttttccatttctgatatcagaagtaggagcatgacattgatagtgtcattttgggggaacttttcgtacttcatgcagcagagcagtgaagagtgagctgagtgccttggggttctgcagtacactctcaagtagtattttaggaaaatgcaatttgctgaaaaaataaaagaaattaatgtaaaaaatccacaagctgggcgcggtggctcacgactgtcatctcagcattttggaaagctaagggggaaggatcacttgagcccaggagtttgagaccaggctgggcaacatggcaagaccttgtctctacaaaaaaatagaaacaaaaattagccaggtgcggtggcatgtgcctgtggtcccagccacccggaggattgctcatgcccaggaggttgaggctgcagtgagtggtgattgtgccctgcactctagcctgagcaacagagcgagaccctgtctcaaaaacaaaacaaaacaaaaacccacacgtttccagaaccttctcatataacactttatttacattgttcttaaatacgtgtgggacggttatatacataccactatacttatgtgtatatatgttgatatacacacaaaattatatacataatttttgtttgtttgtttttgagatggagtctcactctatcacctaggctggagtgcagtggcgtgatctcagctcactcactgcaacctctgccacccgggttcaagcgattctcctgcctcaggcttctgagtagctgggattacaggtgcctgccaccgcgcctggctaatttttgtatttttagtagagactgggttttaccatgttggccaggctggtcttgaactcccacccttgtgatccacccacctcggcctcccaaagtgctgggattacaggtgtgagccactgtgacctgccatatacataattttttaaagtttcacgattagttttagcttaaaaatgtcagctctgggcttaatgaagaaaatatggatatactttatgtcaatgcattaaagtgaatggccataaaagcttatcccagagacaaaacaattcagatataagagaagtgggagagtggaaggtttatctaatcttctgtaggcaactccacagctacaaccagaaggccattttgttacaggcctgaaagccccgttttctttttattcttctttgaaacctttagaaggaacaaagtattggctactttttaccgctgatgtcagtgttaagaatcttgtgataacatagatttactctccctgctgaaaatcactatgtggctcatcagtaacacaactagacatgatgacttaatgcaaaggaagtcctatgtaaatgagcaatgaaattgcaactgtgtataaggaacaaaatagaatatgaaactccagaatcttttgttttcatttctgtttctcccaaggctctatcattcaaaactccagaatctttcagcatgcaattgtctcctgatatcagcccctctcttgttttgttttcttttttttttttttaatcacagtgagccacaacctaggagtcttttagtggtttctacttggtttgctctgcagcctaccagcagatttcctacattccggtcttgttcccctctagcccattctccacactgcagtcataatgaaatttctttcttttttgggggggatggagtctcactctgtcacccaggttggagtgcagtggcatgatctcggctcactgccacctttgcctcctgggttcaagcgattctcatgcctcagcctcccaagtagctgagattatacgcacctgctaccacgcccagctaatcttgtatttttagcagagacagggttttgccacgttggccaggctggtctctaactcctgacctcaagtgatcgcccaccttggctttctctctctttttttttttttggattttgagacaggatctggcctcgttgcctaggctggagtgcagtggcacgatatcagctcactgcaacctctgcctcctgagctcaagccatcctcccacctcagcctcctgagcagctgggactgcaggtgtacaccaccacgcctggctaatttttgtattttattttatttatttttttggtagagacggggttttgctgtgttgcccaagcttgtcttgaactcctggggctcaagcgatctacccatcttggcctcccaaggtgctgggatgacaggcatgagccaccacagctggcctataatgaaatttccaacttacagctattgccattatccaaagcccagaatccctgatttccttccatagcccttcatggcctgaccagtgcctgactctccagcctcacacttcatattctctctgtactgctctgcactgtagcctcattgagttgctttcacgtctttaagtgttgtgttctattttttgtggaattcagcatatgttatgcccttgacctaaggcctctcctttcttttccttctctggggtgctgcctcatccttctggtcttcaaaaccgtttccctgggaaaacatctttgactcagcaggcagggatcatgcccctgctgtgtctgtgcataactttctgtggctacttctgtcttggtctgtgatgtactttataataattttggtctttcctccagtgtcacaatactggaagtctgtttctttttctctgtgttgtatccttagtgcctgaaaggtaggaggttctcaataaatatttgttaaataatcaagtaaatggagtctggtggaaaagagaaaaaataagtgtagaatgtgtgtgcaagaaaggaggggtagggggatgaaaaagataacaaaagcacataacaaaacaacaaaaagcaaaaacaacaaaaaatgcagatgacaaaaaagataacaaaatgatgactgctgtggcaacttgtagaaagtaaggaaggtgctctcattctagagagaagtaggcagccattgtagttttttaaagagagaatatgggctgggctctgtggcccacgcctgtaatcccagcactttgggaggccgaagtgggtggatcacgaggtcaagagatcaagaccatcctggccaacacagtgaaaccccttctctactaaaaatacaaaaattagctggataggtggtgtgcacctgtagtcccagctacttgggaggctgagacaggagaatcgcttgaacccaggaggcggaggttgcagtgagctgagatcacgccactgcattccagcctggcgacagagtgagactccatttcaaaaaaaaaaaaaaaagaatatggccagacactgagctgagatagacagtgcggcagtgtctggtattaactgtaataaactctactgtcagaagcaggtggtttatacttaagtttattgagagaattggatatggataagagataaactcttgggaaatggggagaaatataaattctgttgtaaagcctgtaaaaaattgagattactagtggttagaattttggaagtgaagtgcagtgaaatattgagtacctgagaggttacttgttagtgaaaacacaatagcagtagtacgtagctacagtttggctccaaaggaagaactgtttttactatagtttgtaatggcttcagaatcttcaatttgagatatccagttattaaaagagaatcaattgcagttgaaatgcattagttaagtattttaaagtgctttagcaagctacatttaaaaagtgcttattatagaaaatatacccaaaataaccaatgatgttactgtcttgtgcttattttttctagacctatttttatacatagttaagattatacaatatgaatatttctgaaatctatatttaacattataacatatgtatttttccatgttctttctttttttttttttttgagactgggtctcatcctgtcacccaggctggagtgcagtggtgctatcttggcttactgcagccttgacctcctgggctcaagtgatcctcccgcctgaaccttctgagtagctgagactacaagcacatgccaccatgcctggctaattttatttttactttttggagagatgagggtctcactattttgcccaggctggtctcgaactccttgggtcaagcaattctctcaccttgacctcccaaagtgctgggattacaggagcgagccaccgccctcagccccatgttcttaaaaaccttttgtgaacgacatttaaaatagttgcagattttttcccctgtctttggaagtgttacaacatccaaccatttcacagttactaatttaccatcattctggtttttgtccttgaaaataaggcaaggctgaataatgaacatctttgtggctaaagtttttttctttactttgagttgttaccttcctttagcttagttcagtggttttttctttttcttttttgagatggagtcttgccttgttgcccaggctggagagtagtggtgtgatctcggctcactgcaacctccgcctcccaggttcaagcagttctcttgcctcagcctaccgagtagctgggattataggcgtctgctgccatgcccagctaattttttgtatttttagtagagacagggttttgccatgttggccaggctggtcttgaactcctgacctcaggtgatccacccgcctctgcctctccaagtgctgggattacaagtgtgagccaccatgcccagccagttcagtgattttcatatttgagtgtgtcagccttgcctggaagccttgttaaacacagactattggatcccactgggcggatttctgtttgagcaggtctgaggggagacctgagcatttgcatttttaacaaattcccagttgatgatgatgctgctggtttgggaactacactttgagaactactgggctatattattgacaatgaaactataatgttgaggttaagttcctaagtcagtaggagtgattatgatcttgaatgaaactgagttcatgtaccaacctgtatcagggaaattgaagaactaaaggaccatattgcatttcagcactgagaattcgtgcagtttgtgaacatgtgagtgctgatatgtgcaaggtttttgctgagtattgtgaggcaaggatgttgtaatgaataaaaaatagccctttttggctttttttttcttcttttgagatggagtcttgctctgtcgccaggctggagtgcagtgatgtgatctcagctcactgcaacttccgcctcccaggttcaagcgattcttctgcctcagcctcatgagtagctgggactacaggtgcccgccaccacgcctggctaattttttgtattttggtagagactgggtttcaccatgtttgccaggatggtctccatctcctgaccttgtgatccccctgccttggcctcccaaagtgctgggattacaggcgtgagccaccgtgcccagcccggccttttttcccccgcctagagatggagtcttgctctgtcgcccaggctagagtgtagtggtgcaatctcagctccctgcaacatctgcctcctgggttcaagcgattctcctgcctcaaactagctgggattacaggcatgcaccaccatgcccggctaattttgtatttttagtagagacagggtttcaccatgttaatcaggctggtctggaactcctggcttcaggtgatccttggcctcccaaagtgctgggattacaggtgtgagccaccatgcatggcctcatttgggaaacttttgatatcagaatcttaggtttttcattagagattgtcagatttccatattcctctggaaggtaaaggcctaattgctagcattctggaagccagttagggtaggagggtaggagggtagggtattgggtagaggataaagaaggggtttgggaaaggtggggggtgtctcttggcagttgtatggttaaattgagtttttgttttatttagtgatatgtgttttttgggtacatgtgatattttgatacctgtgtataatatgtagtgatcaaatcagggtgattgggatacccatcatttgaaacatcttttctgtgttaggaatattacaagtcttctagctgttttgaagtatacaataaattgttaactataatttctgtactgtactatcaaatattagaacttactaatcaaactgtatttttgtaacactaaccactttctgttcatctccaccactcccacttcccttctcagcctctggtaaccaccattctgctgtctacctccacgagatccacttttttagcttccacacatgagtaagagtctttcttttaaaactggttttgtgagcatatttaacatcagtagcaataaacttgtattttaagctcctgttgctgtattttgaggaccttctaagtccattggaaggattttgaataccatagtgtctgcagtgatagttgttgaaagaaagggaaggcatcagtgcaaatatttttagacagtttttaaagagactcaagtcacccaatttgtcttctaaaaatcctgattttggaagaggcagtggagtttctgttgataaaaaatgatttatagtttgtgcttggcacttcctaatggattacatcaggaaagatttattgtctggcactctcattttaacgatactacaattgattattaggtttagatgctaataccttttttacctttatttcagagaagcttgattctttgctctcagactacgatattctctctttatctaatatccagcagcattcggtaagaaaaagagatctacagacttcaacacatgtagaaacactactaactttttcagctttgaaaaggtaatttgaattattcatggaataatgttggggcactgggggcttggtttggcaaaaacaaaaaagtaagggtatctactgaaatcttgggaaattacattttaaagatttgtaattaatttccagtataatgcttattctaaaattcatactggggctgggtgcagtggctcacgcctataatccgagcactttggggggccaagacatgtggattgcttgagctcaggagtttgcccaagctcagcctgggcaacatggcaaaaccccgtctctactaaaagtacaaaaattaggcatggtgacacgtgcctgtaatcccagctacttgggaggctgaggcaggagaatcacttgaaccagggaggtggaggctgcactagccgagatggtgccactgcactccagactgggcaacagagtgagactctgtctcaaaaaataaataaataaaataaataaagttcatactgatgagtatttttaaaaaagtaaatagatattgcagaggtgttaatgatggtaacgatgtttagaaaattctaacataatttaaattaattgaatgcttataaaaccttttgtttttggtgctactttataaccatcaatcatgtgctaaatattatctttatatatgaagagataaagattttgttcaggaccccacagcctggtggtgagctgggtctagattttactgttctatttatttatttagctaactagttacttagtttccaggattctttaacctgcttcatatttatttatttttaaaaacagggtcttgccatgttgccaaggctgatcttgaacttctgggctcaggtggtctttccatcttggcctcccaaagtgctgggattacaggtgtgagccaccatgcctggcccaaatttaatattctttctacattgagttcctcttacttcttagcataaattgatggatatgttctatttcagtagtaattttaataccacgtattgttttgcacattgaaatgttaaataattgcaggcctctttttaaagtctttaggaagctttattcagtatcaaaaaacagacacatggagaattgactgaattattctttatttatttatttttttgagagtcttgctctgtcgtccaggctggagtgcagttgtgtgatcttggctcactgcaacctctgcctcctgggttcaagcgattcttgtgcctcagcctctcaagtagctgggactacaggtgcacagcaccacgcctgggtgatttttgttatttttagtagagacagagtttcaccatgttggccaggctggtcttgaactcctcacctcaagtgatccacgatctcggcctcccaaagtgctgggattacagacaggggccactgcatctggccatctttattctttatataggacaagccttctcaactatgttaaaaaataaaaggaatatgtgcgtctggtttaaaaaacaagccatggaggatatgcaaagtttttacttctaactcagttagacttctcagacccagagaggtttcctttgtaaacttccaattttttgttttgttttgttttttgttttttgagacagagtttttgctcttgtcgcccagactggagtgcaatggcacgatcttagctcactgaagcctccacctctcgggttcaagcagttctcctgcctcagcttcccgagtagctgggattacaggagcccactgccatgctcagctaatttttgtatttttagtagagatgaggtttcaccatgttggccaggatggtcttgaactcctgacctcaggtgatccacctgcctcaggctcccaatgtgatgggattacaggtgtgagccaccgtgcccgacccaaaatattttaatgcatgttttttgcctataggtctctgtgtgtgtataggtgatatagatagcatatttacctcattttaaacagctgcataaatattcctattgcatagaattgtaacaacatactgactaatacactacagatggatattgtttaaccaaagtgatttttttaatacaacaaacagtgctctagtgagtatctttgtaaatgtgtaccttgatgaggtgtttttataggatatattcctggaaggagaattactgggtcaaggatatgtatactatgtttattgatattgctctttcctcccaaagagatttgacaaatttattcttccagcagcaatatatgagtttacctgtttcctgttatctttgccaatagtaggtttatcagcctttaactgtcacccctctaaagggcatggcattttatagttgttttgattttcattttgtgtgacattgagcatctttttatatatttgtaagtaatttgttttatatttctgtaaactgcctttttatctcttttgactatttttctattgaatttgtctttctaactactgaattgtagcagtgcttagtatattaaggagattggttcattgtcatgtggttattttaggcaaatttttaatgcaaattaatttttcctagctattgcaattatccttaggttattttttaatgacttctttttattcgattttatgtcagaatattatagtattggttattagctttcaacttacaccaaatttgagcagattggtaatattaatagctacagttaatcaggtacttattttctgtaatttactggcattttacataagttatctctaaaagtgattccttttttgaaggaacaaaaaaaaaaaaattaaggcttagacagcttagtaacttgcccaagattactcagctagtaaatgacagatacaagatttgaacaaaggttggactccaaaacttgtgttatttctgctatactggtggagagtttggtgaagaagtggatatagtagcaagaaataagtaggagcgaaggaagagtgaggaaactataaaatgaaaagaactcaaagtttagctttttgggtttctttggatttgaagtggcctgtagaatccgtattctagaggcaaaaacttccatagccttacatatttctctttcaagtttcgtagatgacattgattccctaagaaaatattaaatcgtagccacttgttatcttttctctgtgtaagaaagcagggaagtatgtaatttattttacaaagtttccatactaaatatttaatgggaaatttatctaacagtctatggaattttataccaggtgttttaaaataggttatttcctttaatccccaaaaccgttcagttattaggtgatattatttccatttgtagataaatacttaggattcaaagattgaggccaaggtcggacagtgagtaaatgaaagtaggacttaagccaagtttgtcagactccaaagcccataccctttcttttctatcatattgcgtcattaaagtttaaaacaagaacaaaaacaaagatagctgaagtaatcagtttgtatcagggctgaattaactctatgaaacccctcattacttgatggtaaatgagaagattccgtttttcgatagcagtggaaggcaaagtaatttaaaccaagatcattgcattaaatttggatgtaactattagaggttgaaaaagcatagaaacactgagaggttgtatgaagagttgaagtaacttaagaaaaaaagaaacttgtttaaaatttgccttacaagtttcatttcctttttgttataaatcaagaaattatcagctaggcgtggtgactcacacatgtaatcccagcactttgggaggccgagctggatggatcatgaggtcatgaggtcaggagatcgagaccatcctggctaacacggtgaaaccccgtctctactaaaaatacaaaaaattagccaggcgtggtagcaggcgcctgtagtcccagctatttgggaggctgaggcaggggaatggcgtgaacccaggaggtggagcttgcagttagccgagattgcgccactgcactccagcctgggcgacagagtgagactccgtctcaaaaaaaaaaaaaaatcaagaaattatcttatttttaaataacgaaaaagctgcggagtatatactgttttgatacttttttgatgttgcctgaatttttttggaaaaagttaaatgtttctcctaaaagtgaaatatatcagattacttgagaaggtctagaactgataaagaaatgaaagtgatatacctgactaaatggaccattaaaaatggttagggtaataatgttaattcaaactggttagctggtctttagttactgtaaattcttaagtcaaaagtcagaaagataaaacgttaaagaaatctgtaagaaaatgacttcacataattttgggaggataaagtaaaagaaattttgacattctgttggacgttttataactcaaaagctaatattggaaaatcaaaaaacatgaattttataatcgcttggtctttatctttagaaaagattcttaatgtagcaaatgaaaaatgcaattccactgatttctttctgaaaagaacattaagtaatgttgcaactcttagctttaaaacaaaataataagacatttataataagtatgcttttgaaagttctcagcataactggagggaaaaatcataactgagaatgtgtgggaagatatgttttaggatagcagaagaaaatgttccaaggatttacgaaataatgttctattgtcttttccctttgaccattaaaaaaccacaagcaaactaaaattaccttgttatgctcaaaaagttaaaaatatttgttgccatggagatagtcccagtctagatttctttccggtagtttaaagacttttgcaatcccatggggaagtaatatattttcagtacaacagctgacaaaatttgtttctgtgggtgagatgaataatatacctttctttgtctttggtgttcatggacacattgaaagactataaataatacttgagaaagtcttgctcaccactcctagttttcatgtaaggatggaaagtcatagaaaacaaaaagaatagtaagccaattaaagaactggactgaaactcaacaaaaagaatagtaagcccactaaagaactgaagtgtataccccctcccctctcctcccctcccttcccctcccctcccttcccctcccttccccttcccttcccctctcttccccctccccttcccctctcctccccctctcctcccctctcctccccctctcctcccctcccctcccctcccctcccctcttttcctgtcttctggtgccaatggagtctatattctaatgtctgtcttagataccttgtatttattttcctaactgtaattgtgggttacttttttgcaagatatgttgttttgaggaggaaaaaaagcacgagtactttttttttttcttattttgagcgggagtctcgcgctgtcaaccaggctggcgatctcggctcacagcaggctccgcctcccgggttcactccattctcctgcctcagcctcccaagtagctgggactataggcacccgccaccatgcctggctaatttttgtatttttagtagagatggggtttcgctgtgttagccaggatggtctcgatctcctgacctcgtgatccgcccagctcaacctcccaaagtgctgggattacaggcgtgagccactacgcacggccgcatgagtacttttaaatatagaaagcagcatttattaattttgcacagcaataagaattttctcatagtccacccagcttgatagagacagcatagtacagggttttgaaataaaccaggtttatttcccagtttcaccatttactagctgtgtaactttgagtaggttgattagcttccaagcctcaatttgtacttgtgtgaagtggggataatagatgcatagtacctaacaccaagtaggtgttcaataaatggtatataataggattagtttttgataataatttttttagataatcaggattccaacttaactacgcagtcatgtgtgtttccttattcttcagtgttttccaggagagatgaatgtataagttctttgaatatctttaccctagtgtgagtttattgtgatctgctgtttttatagctaaataaattagttcatttgtcgttacaggagatatattgctctaagtacctaataagactttagttgtaacttgcatagtgttttattaatgtcaatgcttctggctttttaagaaagtttaattatgtgaaaatgagacttaaaatttgtgtgcttagagtaaaatatgaatgcatttttcttcaggcattttaaattatacctgacatcaagtactgaacgtttttcacaaaatttcaaggtcgtggtggtggatggtaaaaacgaaagcgagtacactgtaaaatggcaggacttcttcactggacacgtggttggttagtatggagcttgttggtttgcccctgtgtctggtgtattaggtctccaaatctaacttgattgcatattcttttctggtgcaggatagtggggacggggtgtcatagaagtgctattctttgacttttctttgaggtatataagtttagaggcaggaacattctaatagaaggaaatgagtattatctaaatgtcatactagctggctggtttaatgattaaaattaaattcttcttaagtgataggaatttaacctttcttttcctcagtgactgtaagctttctttatgatattttaaacagggaagcttggagataaaatacttggtgatcctattacgtatgtatttgagaaaatttatcaaacaagcaattgcagtttactttttgacctttttctgcaatgagaaaaaaaaatgtcattgaaatccacaaatagtatagttcctaggcctgtacattctaaatcatgctttctgtctctcttagttcttcctttacctagaagtagataaaattattccagaagaaaatcttagcagttttgtttgttttgggaaagggataggtttcaagtgactaaacttgaggctaccccttaggagttgagattatctagcttctttctggagcctttgtttcttgttttgcagagctctcacagtactaggcaaattccaccctgaaggatttaatttttattgagagtaatgcatagtttcttatttgatgtaagtatttttaaataataattttttttttctcttaaggtgagcctgactctagggttctagcccacataagagatgatgatgttataatcagaatcaacacagatggggccgaatataacatagaggtaaatttatatgtgaattttttttcagtagcttatatctctgattttcaaaaagctgctcagttctgcaaaggtgaaaagtaattatacttatttctttcctcttcgtatttgaagttttttactaggaaagtagactttttaaaaaaggataatctctaagaagctgtgttatgatacaccctgtatttctaagtaccataattgagagagttacatgtgggatggataataggaagagaaaactttctttccctcctgactcattttttaattctttctcaaataataaatgtaaacatcctcagaaatgaaaagtgaagtattatttttcaatttctctgtttttctgctagacacactggaaatgctagatcaatgaaaggtggtagttcatagtctgagaagttaaagaggaagctaggaaagtcaggctgtggtcactcttccattgaaagagtagcaatagaaatcaagaccacagtggctgcattggttaagacacatatctatctgtcagatattagtctacaaaacaaaacgtttcctcataattgtgaattgaagttgattctgtgtttcctgaaaaatgagaagactctgggtggtggtggtgatatcactaaaatagatcacctgtgggaaaactgagtaagattggtcaaaatgaaatgttcaggtgtatttgagtgcttaataggggtaaaacagtctgctggagctatatatactatatgttttaattatatccaatctacatgactgttagtcctttgactgtccattattgtgaaaaagaaacctatggccttgcagtatgttatagtttgttaatgtttaagctatttaatgtcaatgttttgaggagtctggcctaccagaaagagtcagaaatttagtagaaagtaaaggaactaatattataaatgcattcattctagaataggcaaagcatcactggaatgtcttaaatttgcctgttctttcaaatcaatttattttttaagaatacctttattttaaaatatatgctcattgcaaaattcggaaaatagattatctgtacttggacagataactactattgacattttgacagacatccttccaaatttttttttctatgtgtaaatacacaaataaatatagttatacccactattttttcctgcaaaactaggaccatacaatatgtacagtttgtcttcacacatttttcgtttaacaatatgattatgaaccttttcgtgttaatatagatctaaattagggttttttttgtttgtttgtttgttttttgagacggagtcttgctctgtcacccaggctagagtgcaatggcgtgatcttggctcactataacctctgcctccccggttcaggcgattctcctgccttagcctcccaagtagctgggactgcaggtgtgcgccatgatgtccggctaattttttttcttttttttgagatggagtatcactctgtcactcaggctagagtgcactggcgtggtctcggctcactgcaacctctggctcctgggttcaggcggttctcccgccttagacccttgagtagctcagactacaggcacatgctacctcacctggctaatttttgtatttttagtagagacggggtttcaccatgttggccaggatggtctcgatctcctgacctcatgatctgccagcctcggcctctgaaaagtgctgggattataggcgtgagccactgtgcctggcctcaactgttttgtttctaacttttgaaataaaaggtattgtagtgaacagccttgggcacaccttttggtgcatgtgtttagttggaatagtctggatgataggtaatagtctgggaagttaaatgaagaaactgtaggaagctctgtctaggctgtgcgagggcttcagataaactcccatagctgagtagcttaacacaagcaaagttttttcttactctcctgtggcttgatgtgggttaggtggttctcctctactttgtggctttgacttttggacacatgtcctctgtagttctcacagaaagaaaacagagctagagaattatacaggatattaagggccaggcttggaaatggccttccgttcaatacattctagaacactttatctctgacctgctacaaaggagaatggaaaagatagtcgtaatttgagctcagaaagagaaaatagtgtggtaaatgcacagcattgtttttgctgcagtgcatatgtctgcttatttccttagaataatttattcttttttgtttttttgagactgagtctcactctgttaccaggctggagtgcagtggcgtgatctcggctcactgcagactctgcctcctgggttcaagccattctcctgcctcagcctcccgagtagctgggattacaggtgcgcaccaccacacccagctaatttttgtatttttggtagagacagggtttcacaatgttggccaggatggtctcgatctcctgacctcatgatctgccagcctcggcctctgaaagtgctgagattaaaggcgtgagccactgtgcctggccagcttattaattcttaagccaaaatatgtgtctttaggatccaagttaaatttgctcagattacatttttttttttttaagatggcatctcgccctgtcacccagactggagtgcaatggcgcgatctcggctcaccacatcctctgcctcccaggttaaagcgattctcctgcctcagtcccttgagtagctggaattacaggcgtgtgccaccatgccccgttaatttttgtagttttagtagagatggggtttcactgtgttggccaggctggtcttgaactcctgacctcgtgatctgcccatcttggcctcccaaagtgctgagattataggcatgagccaccacgcccagctagattactcatttttttcaaatacttccttttggaaaaataggaattctgtttccatccatacctttgtttcactaagtacaaaaatgagtataactaatatttcattgtaagatatttacttagccaggcacagtggctcacacttgtaatcagcactttgggaggctgaggcgggtggactgcttgagcccaggaatttgagaccagcccaggcaatatagggagaccttatctctactcctccacaaaaaaaaaaaaaaaaaaaaattagctgggcatggtggcacatgcctgtggtctcagctacttagaatgctgaagcagtaggatcagttgaattcggaaggcggagactgcagtgagctgagattgtactgctgcactccagcctgggtgacagagcgagaccctatctcacacatacacacacacaaagatgtttacttacaagtatactcatcagataccttgagggacttttgcatgaaattaataatgtttattgaaaaaatgatttactacttacaggggtgattttcatactctttataattcttttgatacttttatagttcataagtgtggtgattggctgttcacacacacatatgagatgtaccaccctagaaccttgttacaatgttagcacattaccagtctgacatgaaaaaaaataattctttacacttaccttgatgcaaaaacattgtctatctgcactaatatcttaggaatataagtgagcaggaaaaaatatatatcttatttttaacacatcatcattaaatattttgtttatgacagtcttacttggtcactcaggctgaagtgcagtggtgccatcatagctcactgcagccttgacctcctgggctcaaacaatccctcttttctgcctcctgagtagctgggactacaggtgcatgccaccatgcccaactaatttgttaaatttttgtagagtgtatcagatttttgatgaggtctcactgtgttgcccaggctgatctcaaatgtctgactgtaagcaatcctcttgcttggcctcccaaagtgctgggattacaggtgtgagccactgtgcgcagccgttaaatattttaaaccgtcactgactttaccatagcttactatttatataaataatcctgggttaaacttgcatagtgagataatatttcccccaacttttatttatttatttgagatggagtcttgctctgtcgcccaggctggagtgcagtggcgcaatctcggctcactgcagtctccgcctcccaggttcaagcatttctcctgcctcagcctcccaagtagctgggattacaggcacacgccactgtgcccggctagtttttatatttttggtagagacagggttttgccacgttggccaggctggtcttgaactcctggtctcaggtgatccacccgcgtcggcctcccaaggtgctgggattacaggcatgagccactgcatccggcctaatttttgtatttttagtagagacggggtttcaccatgttagtgaggctggtcttgaacttctgaccttgtgatctgcccacctcggcctcccaaagtgctgggatgacagacgtgagccaccatgcttggcctcccccagcttctagttttaaaaatgttcagctggtgcagtggctcatgcctgtcatcccagcactttgggaagctgaggtgggtggatcacttcaggccaggagttcgaggccagcctggccaacatggtgaaacctcgtctctactaaaaatacaaaaattagccaggcttggtggcttgcgcccgtaatcccaactgctcgggaggcctaggtgggagaatcgcttgaacctgggagacagaggttgcagtgagctgagatcgctccactgtactccaatgtgggtgacagggtgaaactctgtctcagaaaaaaataaaaaagaaaatgtgcaaatctacagaaagattaaaaagtaccctgtagttacagaaagatttttttaaaaaataccctgtagcccttaaacaatttctaacataatgtcctgttagctttctctctttttttcgtgaatcatatgaaaatcatttgcaaacatcatgacccttcacccctaaatacttctgtatgcatccttaggaataaaggcactcttttctatagctgtaataaaagtaacatacctgagaaaatgacaagaattctacaatattatctaataatcatgccatagtcaaaatctctagtcatcctcaaaatctcctttgtagattttttttggttttccagtccaggatccaatccagttttctgccttttagtcaattactcatcaaattattttttccagcaacttactagtaataatggtaatagccttagcttttattaataacaaccacttttcttttgaaatgttaatataaaactagatttattacctacataatcttcataatcttcaagttaggtattatcactactttacctaatgagggaggttatgctcagggtacttgtccaaggcacatagtgaggtatggttgaggtttgaactcagatatatctgatcccaaagccagctgtctttttctgtgctggactgactatactaggaaacaatcaatgtgaacttagaaatgtttgacccaaaagaaaaaaaatttcactcctattcataggctaaatgaactttactaaatatggaagattcctgtagcccggaagttgggttagttaacttttgagatctctgccaaccctgaaattctgtaacccttgtttcttacatctgcctcatacatggattaccaaagatgtatatgcatataatatttaacagttttattgagataaaattcacatactatattattcacccacttaatgtatacaattttgtagttttgtgtgtgtgtgtgtgtgtgtgtgtatttttgagatggagtctcactctgtcacccaggctggagtgcagtggcacgatcactgcaacctctgcctcctgggttcaagtgattctgtggcctcagcctgttgagtagctgggattacaggcgcccaccaccatgcccggctgatttttgtgtttcagtagagatggggtttcaccgtgttggtcaggctgttctcgaactcctggactcaagttatctgcccaccatggcctccccaaagtgctgagattacaggcgtgagccatcgcgcccggcagttttcgtatattgatggagttgtgcaaacaccacctcattcaattttagaacatttttatcacctgaaaaagaaacgctgtatcctttagccatacttcccccttcctccctaactcccccagctctaggcaaccagggatctactgtctatttagatttgtctgtttgggtcatctcatataaatggaattacataacatgtcttttgtgtgtggcttcaatttttttatttttttgagatggagtcttgctctgtcacccaggctggagtgcagtggcatgatctcagctcactgcaacttttgcctcctgggttcaactgattctcttgcctcagcctcccgggtagctgggattacaggctcctgccaccatgcctgactaatttttgtattttttactagagtcggggtttcactatgttggccaggctgttctcaaactcctgacctcaagtgatccacctgcctcggcctcccgaagtgctgggattaaagacatgagccaccacgcccagcctgtgtgtggcttctttcacttagaataatgtttccaaggttcatctgtgttgtagcatgtatctgtatcttatttatttttattgctgaatagtattccattgtatggataaactgcattttgtttattcattgattagttgttgatggacatttgggttgtttccactttttagctatatttacattactgcttgtgttttcatttctcttggttatatactaggagcagaattgctgggtcatatggtacttctacttttaacctttgaggacctgccagactgttttctaaagtggttttaccattttacattctcatcagcatatgtgagggttctggatttctctacatcctcaccagtatttgtctttgatcatagtcatcctagtgggtatacaggggtgtctcattgtgggggtttttttccccattggggttttgatttgcatttccctgatggagataaatatattttttgtgtgtccccccacaaactgcctggttctgatgagaccagtgttcttacagagaataactttgctttgaaacaaaacaaacaaacagccttttgacttgggtaacctttggagtatgttaattgtgatttactctggccttgtaacattgtaagtggagattttgtttaaaaactgcgttcgctgaaacaagtaataaggttcagacctattgttacaagttctgagttttctttcatataaatatgtttgttcttttgtgtggataaaacctaacgtggcaaaaaggtgtcaaacacctaagtattaaggaaactaaaatgaaaatgctgcatgaacagaaaccttgtccaattttcattactatagcaccatcacctataacagtgccagtgtacagtagatattacataatatttttgaatgaatgagtggaaaatgatatgcatttttctcttctgcatcctctgaaagatttcacaacgtgcaaagtatgtaaggctttatttatatacagataaaataatcagagtttataatctatgtatttactttcctgcatagaaactccatatgattaaaaattgagattatttattttaataacatgactaatcagtttacttaacctagaaatgaatgttatctaagaacaagcaaagaatgttagaagaatttagtgtttaggaattattattgttttccatctcagtcgtatatattttctgttttagccactttggagatttgttaatgataccaaagacaaaagaatgttagtttataaatctgaagatatcaagaatgtttcacgtttgcagtctccaaaagtgtgtggttatttaaaagtggataatgaagagttgctcccaaaagggttagtagacagagaaccacctgaaggtaagacttaaagagtgtatttcaaataagaaacaaacatactacaattgacttcagtaggggtggttgttatttgttaaaaaataacatgattgtcaagtaactatagtatttggcatgaaaataagaggtttgttccagaaattttcatcttcttttgtttataatgtaagagttgaaaactctggaaaataatgggaacaacagagattagactttaaaaaagattagggaaaagggaaatggagtgatctgagggaaaatattcctgcagatatttagaaatgataaaataatatggtggaaagacaatctttagagtttataagaaattaattggtagtaggagggacctatatatatactgcttagaatacaagaaggttatatccatcttgggacaatccatttagggtcatttaaaaaacgtaaccatcttggaattttactgcccaaaacacctctggttaggttttttgttttgttttgttttgttttgttttctttgcagcgcgatctcggctcactgcaacctttgacttccaggttcaggtgattctcctgcctcagactcctgagtagctggattataggcatgtgccaccaggcctggctaatttttgtatttttagtggagatggggtttcaccatgttggtcaggctgttctcaaactcctggcctcaagtgatctgcccacctcagcctcccaaagtgttgggattacaggcgtgcaccaacatgcccggccaaagacggttatgttattaaaattatatattagcattttaatatataaataaagaaattcttaatttatttcacaagaaagttgtcctattaaactaattttcaatgtgaatatcttgacatttttactgttacattggttaattcataaacttcttgttgtagaatatgactgacagcttcatagcccagcattaggtgactgttttactctgttgagcactatttatttatttatttatttagagatgaagtctcacttttgtcgccctggcttgagtgcaatggcacaatcttggctcactgcaacctccgcaccctgggttgaagtgattctcctgcctcagccttacaagtagctgggattacaggcgggtgccaccatatctggctaatttttgtatttttaatagagatggggtttcatcatgttggccaggctggtctcgaactcccgtcctcaggtgattcacccaccttggcctcgcaaagtgctgggattacaggcctgagccaacatgcccggccttactctgttgagcactttttaaagtttctgtattggaaaaattaaagaggcacttgtccttggttttgaattctacagtgttttaactttatgttacttttcacttttctgtcttcctccaaattattttttgttgttgttcagaatcctttagtgatattaagctcacataatgtttgtttcaaaaatatgttagatttaaagtgttaccataaaactccttgttttggtgaattttgatttaatagtgcatacaaattcatattagagcttgttcatcgagtgaaaagaagagctgacccagatcccatgaagaacacgtgtaaattattggtggtagcagatcatcgcttctacagatacatgggcagaggggaagagagtacaactacaaattacttagtaagtatttgatattgcatcgagtaattgaaaaaaaaatttgggtgggtacattccatgaaacttaatgcaaccagatctgttccagatactctgttatttccctaaaatatttgagggatattctctgaggtttttatgttactgtatggaaattatagtttcaaatttgtgacaacccattttacccttgaactaatattttctgcatgttagaatttatgcatatagggtttgggagaggttataatgtagtccttcctccttgatataagtgagttctttaaaaacatcactgctatcatggtagtgaacctgtggtgtcacatgtgaatgtaaaaatatgtatttgcatgaacccatgtttttcttttgcttatatgtatatttcagagaggaaggcgagttttgtttgtcatgttaaagacctaatcattggacttcacttgaaataggtgggactttcatggtcataactagttctagggcacagaagtgaaggaaagatgtaagaagtgatgatactggatttttaagtatgaactattatgatttttgaagtctggggaatcatttttcattgacattttttgctagtgtgacttcattcgtcatgattacttggcactgaccaaaatgttgttactgagggaataatggagaatgcagctattcatgaagcaagaagaagctggtgcagtaaagatgtctttctcattgccttgcttttcccatgctgtccattttattcataccctcccaacttctttcccttcccttccatgtcaaatggatttttttttttttttttcaacacagagtctcactgtgtcgcccaggctggagtgcagtggcacaatctcagctcactgcaacccccacctcctgggttcaagcaattctcctgcctcagcatcacaagtagctggaattacaggcgtgaaccacagcactcggccccatatcaagtgaatttattatgaggctagtaagagtcactgtgattcttgttcctaaataagagagatttttactttaaaaagcttctctcttaatctgggttttatattaaggggctcctcttattttacttctttgttcattgcactataaatatgaatataatgagagatctagtcttaaaaattgtatttttttacaacttcttaggcataacttgtttcacagttgctggaacaaacctcatcaacccagtttttgaacagtagaatattctctttgagaaaaagataggtaattagcattttgttctttctcatgtcattttccttggaaactatactgccttccttctccagttttcccaaatcagagaacaaaagaaggagggttgctgaaatgaaccttgttctttctggctgtcttcttacccattcctcagtgctgaactttttggggtgagagtgggggaatagggttggcagttgtctgccacggccccttacttgtttctggggaagacattcgaggtactcaccaagagatagagtgaagatggaattctttttagaagggaacacagttgacccaggaacagtgcgggggtgtggttagaagcactgaccttcttccctctgcagtcgaaaatcctcacgtgactttttttttttaaggctctgtcgcccaggccggagtgcagtggtgaaatcatagcttgctgcagcctctattgcccgggccaaagcaatcttcccacctcagcctcctctagctgggacaacaggtgttcacccttcctggctaagttttttgatttttagtagagatggagaatttcccaggatggtctcaaacttctaagcttaagcaatcctcctgcctcagcctcccaaggtgctgggattacaggcatgagccactatgcccggccactgtataactttgattctccaaaaatttaactactaatagtctactgttgaccagaagccttaccaataaaataagttgattaacacatttttaaaatatgtattattactgtgttcttacaatcaagtaagctagagaaaggaaaatgttatgatgaaaatcataaaaaaaaaaaaaagcccggcatggtggtgtgtgcctgtagtcttctgttactcaggaggctgaggtgagaggattgcttgagtccagaaattcaggctgtagtgagctatgatcgtgccgctgtactgcacccctggtgacagagcaagaccttgtctcttgaaaaaaaaaaaagaaaatcataaggaagagaaaaatacatttactattcactaagtggaagtggatcatcataatggtcttcatgttgagtaggctgaggaggaagaggaagagttgatcatattgtctctggtgacagaggctcaaggaaatccatatgtaagtggacacttgaagttcaaatctgttgttcaagggtcaactgtatttcaggtatactgattgacttttaaatttaatttttattattggctgaaacggtagttttaaaaaagcctgttacttgtcattttggttccatgtgcaattgagtacctgaaatttaggttaaactataccattgttttattctggtaacagcactttaagtttggggccaaaggttgggaatactctgatacagtaacatctcaatgctagtttttgcgaaagtagaaacttttgcaatggcctctaaactgagattttttctttccccatagattttatattgcattgccaggagaggtaaagagttacataatgtcttttttcttttttaaatacacacagatagagctaattgacagagttgatgacatctatcggaacacttcatgggataatgcaggttttaaaggctatggaatacagatagagcaggtatttatcaatagatatggcttatattacttaagttttgtaatgtaaatatttgtcacttgtattcaaaacctaaaaacttgtccttaacaataattgtaaataagttttctcagatgccaatgattttttatgatgaattgtgcagtatttttgatgttaattagttctagattgtgaagttttctgtccttagtctcgctttaggtagaaagccttttatgctgctgtgctttgttccttctttgaattcatggcctttatattctctgtagttttcttcccccctccgattatgcttaagtctttagttaaaactctggcatgcaccattgaatccttagtcagaaaatttactaaaaaatactgtgtacctttgcaaggctgtatttatatatacagaacctttaggttctttcctctcagatatctccttctgatttcttgtaatctgttaacagagtgtgtctagtaatgttatattaatgtcatcttaataatagctcatattaaaagttatttcaaattgctaggactaattaaaaaggcttctgacatagggtattgctttgggcagagagacattttgatatgtaaattatataaattgttatctctatttttttccaagctttttgtagtaaaccatatttttataagttatatagtatagaatttagaggttgaaaaaatttttaaaaatcattcaccatgtttataaatgttaaactttgatattacttgtataaaactaagagaattatttttcccttttcattctctttcactgttacgcattttctttttaagttattatttgaataggtaacatgtacacagtacaaaagccagtgaaaagtaagtctctgcagcctgtttattgtcaaaccagttcctttccccaaagacattcatgtcactagtttcatatgtatctttctagagatgtcgtatgcaggtatagtgtatgtatatgtctgtatttgacacaacggtgctatgcagtacacttttacaccttgctttttcatttcacagtatgttggagagtacttcatgttcatgcatgtaaagctgcttcacttgttttattataaatagctgcatcatgtttgagtttcagggaacctgtaaattttctttttgctttaggcatttggaaccagttgaagaaacaggaataatataggagattaaaacattaacttctttacatctgatgaaggatggattggagggtgtggtttagatgtgtatcatggtgggcttctaagtagttctatcccagatttgaccttgaccagccaccatcaaaactgcagagtccaccccagtaaacttaccacacagtggcagaggagaccagaatgggccttctctgcaggcaggcaggcaggcaggcaggcagagagactcacagaaactctgagctgagcatggtttccttctttatctcacacttactaatgggagcctttgttacttttttttttcttctttgcaggtttaatatgaatttgtctgaaatgcctgtataaggagaagactctattcttagccttttattcctttgatgcacaaagagatgtatattttattattctttcctgagttgtcgactgtagtcgtaataaatattttaggctcctgtaacccaagttcttattttttcaaaataaacatggaggatatgaaaatttaagagtacatttataatattataaataattcattgacatatgttttccataccatatgcttctctgtttgtttcaaacattgaatattggtactgaagaatttatgaattttggttttaaaatgttttttttctagaacgattctttttttgaacagataaaataatgcagtattcagagccttctgacttattttggaagtgttctaagtatatgatctctttaagtatagattcgcattctcaagtctccacaagaggtaaaacctggtgaaaagcactacaacatggcaaaaagttacccaaatgaagaaaaggatgcttgggatgtgaagatgttgctagaggtaggtcttagaatcctggatatggtgctaacaccactttgtcatttctgatatgtggattgtatgtgttttaatgaaggagcatgttagaaaagatggacacccagaagcagtctcctccagctgatccagcagtaaccccatcccgtgtagcagcatagacaacaaataacaaaaactctatgaaaaagaaaaacgctataaagcaatgctttttttttttttttttttttttttttttttttgagacggagtctcgctcttgtcgcccaggctggagtgcaatggcgggatcttggctcaccgcaacctccatctcccaggttcaagagattctcctgcctcagcctcccaagtagctaggattataggcatgcaccaccacggccggctaatttttgtatttttagtagagacagggtttctccatgttggtcaggctggtcttgaactcccgacctcagatgatccgtctgcctcggcctcccaaagtgctgggattacaagtgtgagccaccatgcccggccaaagcagtgcgtcttaaccttaatatctttgaggatctaatgagacaatcagtggatcttctctagaaaataacatggatacccaatatatagagtttttgcacactgtttcattagttctgcacacttagttcagctctctctgaagcttatcaatttatcttttagggcagtaattatcaaacaggttatgaacatgtattggagagtagaaatatagcttggagatctgaaagttctctacaggaatttaaaatttttgtgtttttattctggcgattaatctaaagatggctaacttaatcattttatgtcatttggagtcttgccgtataacagggtgctgccatgtgattccagtgtcttgagtttgtgtgtgctattactttggtgtagaatgactttatatgaagcgatagtttttatcttttaatgtgttggcaagtttattagtttcttgttgttgctttaattatcacaagtggagcagcttagaacaacacttatttatcccatagtttgcatgggctagtccaggtatggtgtggctcatctggattcttgtttagggtctcatgaggctgaaatcaagttttcaaagcttcaatagaattaaaggatattataactattcatccagatggagaagcataatgtgcagcacctgtgtggtactcattcataccttgtctaatttgatctgctgagcaccctgagaggttggttgagacagcatccttgtgaggaggctcagcaagtgttactgtttattccagctgacatgacaaagcagcataggctgggggacttaaacaacagaagtttgggttttcacagttctggaagctggaagtccaaaatcaaggggtcagcagggttgatttcttctgaggccaaggtacttgtggtgtagatgctgtcttctccctgtgttctcacatggtccttccctcagtgtgtgtgtatattctgatctccttatcaggacaccagccatattggattaaggcccacccatatgacctcagtgtaccttaattacctccttaagggccctgtttccagatagagtcacattctggggtactgttgagggttaggacttcaacatttgaattgtggggtggcacaattcagccagtagcaggaagattaaatgacttgtctgattagtcatacaactggtgatggcagaggttgaattgagcacagatctcctgactcctagaacagctgaaccactgcgcctgtctgcttttctgtgagcctccagacagcccatggcaggggaggaaccaaagagaaaaatgacttatgttgacagatggtcctctccagttttcttccctaagcctcctagaatattcttagaagcctcatccttttaccacggaactatcagaatccccatgtaaccacacttcattcctcatatagggctctctggcctctcatttaaagcattttaaacattgagggttttggctaggcatggtggttcatgcctgtaatcccagcactttgggaggctgaggatgaggcagtggattgtttgagcccaggagttcaaggctagcttgggcaacatgttgtacaaaaaatacaaaaattagccgggcatggtgaggcacgcctttggtaccagcttcttgggaggctgaggtgggaggttcacttgagcctgggaggtcgaggctgcagtgagctgtgattgcgtcactgcattccagcctaggtgacacagcgagaccctgtctcaagcaaaataaatcaaacccccccccaaattaaggtttttttaaacttggagacgctggacggttatggtagaggtttttaaagtaatgtatgaagcccttttaaattaagaaaaaaaaaatcctctcaaacctgcagtgttgatttaaatggatgtaaaatctttattttagtaacataaaactgggtatgtatgcttttctataagtgtatatttatataaatgacaatatattatgaagctcaaaaaagtttaagattaaaatttctataaaaccaattgaatccttgaaatacttgagagggatctgttttggcctggagtgctgcaatccccttatcgaattggagcatctctagtcctgggctgtatgtcttcagaacagccctcggaggagcagtgagttagttctgaagagctggagcaagctcccgaactattcccttttgtgtcccttgtcagatgacagtgtgtgcctctcacctgtgcaggtggagaagcactttagggaaagagcaaagcactgcacgaggttgtgattgctggtgctgagctgcatgccatcatagttctgttctggaatgtttagttgatttagattacatcttttagtctgatgtaattgttaatctaagaatgcttttttttttttttttttttttggtctttcaaagcaatttagctttgatatagctgaggaagcatctaaagtttgcttggcacaccttttcacataccaagattttgatatgggaactcttggattagcttatgttggctctcccagagcaaacagccatggaggtgtttgtccaaagggtaagtttttccatttcttgtgtgaatatgctgctgggattattaagatgattggattatattataattctgtatttaataagcaatttatctctgtttccttttgactttagcttattatagcccagttgggaagaaaaatatctatttgaatagtggtttgacgagcacaaagaattatggtaaaaccatccttacaaaggtatgttcttttatttctaaaagaatagtgttagagtttattgtagtagaacctcagttatatatttatgtaggtatttttttaaaaaatgtaatatatactgttttttaaatttctgcctaaataaaatttatgtatttttgtgggatatatgaaaattaaagcataaagaagaaaataaaaatggcctgtcagccttcttttgaaacatgtgaggaccactgcttttctcgaaccctctgtcctggacccctctgacctgcagcaactcttagagctccctgtctcctagtcctgcagtgcagctgtcattcaaggcatcccacaccctcttattttcagaaccccatggtctccctctttctcagtgccatcattttggtgtagtgtatcttgcaggagcttcctaagaaaacgtagatgacctgcatattgttgggatttcatatatctgaaaatgtctttattccactcttaagcctgattgataattttggctgagtatattcttagttctcatgttctctatggtcttctgtgcatgttgcttctaaagaatctgaagtcattttgagttcttatctttgtttgtcacctgtttttttctctggaatatcttaagatcttgtttttctccagctatgtctgttaaaatgtgtttgactacaaataacagaaaattaaataagcagtggtttaaataaggggtttatttgtctcagtcaacaagaagttcagggatagcattttctgggtggtacagcaactcagaggtaccctcagtggctcaagaacaagcaggaagtctttgtcctcatggatgtcacctcatggttttaagatggttctcttctgtgttggagaaaggaggagaaagagaacatggctagcctagtctggcccttctaaaaagcttctctggaggccccatcctggcttttgtttatatgttactggacagcactgggtcccgtggctgcccttagcctcaacggaatgtggaaagctggctattttagctgagtatattgctgtcctgggcaaaattagggctcattaagtaaggaagaaggggagagagatgttggtaggacatattagtatctgatatactgatttttaatttttatttaatttttattttttttgagacagagtcttgctctgtggcccagtctggagggcagtggcaccatcttggctcactgtaacctctgccttctgggttcaagcagttctcctgcttcagcctcctgagtagttgggattacaagcacctgtcaccacgcctggctaatttttgtatttttgttttagagacagggtttcaccatgttggccaggctggtctcatgaacccctgacctcaagtgatccactcaccttggcttcctaaagggctggttggtatactgattttttgactatgatgttatacttggtgtagggtatgggaaaacatttgcaaaagacacatctgagaaaagactgctatctgaaatatacaaagaggccgggcatggtggctcattcctataatcttcggcactttgggaggccgaggcaggagaatcacttgagcccaggagtttgaaactaacctgggcaagatggtcagaccctgtctctacaaaattaaaaataaataaataaataaaaatttccatatgtataaagaactgttaaaattcaacaataagaaaatgaacaacctaatttaaaaacagacaaaagagcagaacagatacctccaaagatatacagatagcagagaagcatatgaaaagatgctcagcgtcatatgtcattaggaaattgcaaattaacaatgaagctggttgtaggggtacatgcctgtagtcccagttgcttgggaggctgaggtgggaggattgctcgagcccaggagtttgagacccatcctgggcaacattagtgagatcctatttctataaaaaactttaagaaacccaacaacaatgtgctattactagtagcttattagaatggctaaaatcccaaacactggcaacacaattccaacaaggctatggagcaacaggaactctcattaattgctagtgggaatgcaaaaatggaacagccactttggaaggcagttggcagtttcttttctttttcttttttcttttttttttttttttggagacggagtttcactcttgtcacccaggctggagtgcaatggcgccatctcggctcactgcaacctctgcctcccaggtttaagcaattctgcctcagtctcctgagtagctgggattacaggtgcccgctgccactcccagctaatttttgtatttttagtagagatggggtttcaccatgttgtccaggctggtctcgaactcctgacctcaggtgatccgcctgcttcagcctcccaaagtgctgggattacgggtgtgagccactacgcccagccataagaatgtttatggcagcttaattcataattgataaaacttggaagcaaccaagatatcctttagttggtaaatggataaactggcacatccataaaatgagaaaaaaataaaaagctattaagccatgaaaagacatagaggaaccttaaaagcatactactaagtaaaataagccagtctgaaaggctacatactatatgattccaaatatatgacattctagaaaagacaaaaccatgcagactataaaatgatcagtgattgctagatgctgggggagggagggatgaataggtggagagcagggtaattactctgtatgatacttcaacagtcagtataagacattatgcatttgttgaaacacatagaatatacagcacaaagagtggaccctaacataaactgtggactttgggtgatttaaaaacaggtggtggcaggagcctatagtcccagctacgcgggaggatcacttgaggccaagagttagaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctggagtgcagtggcgtgatctccgctcactgcaacctccgcctcccagattcaagcaattctcctgcctctttctcctgagcagctgggattacaggcatgcgccatcacgaccagctaattttgtatttttagtagagatggggtttcttcatgttggtcaggctggctctcaggtgatccgtctgcctcggcctcccaaactgctggattacaggcgtgagccaccgtgcttggccttaatttctaaatttatttttttcttatggtactttgttttaggggaaaaaatctctcaaactgtgttttccctctattctcacatcacaaccatcatcatcaacacagaagacttgtgtgaccagaccaaacgtgtggggatttccccctacatatcaagcagtagacatcagctaggtgtcctccaattcaattcaaacactctccacccggaaatagtatcagatctcacagtttgagggcccagtcccacaagactgactgttccctcctccccaccagttacaagtctgagcctccagaacttctgaccaactggcttcaagttggggtttccacattctcctctttgggtctgattaatttgcttaagtggctcacagaactcagggaaaagcttaacttagtttatgggtttattacataggatattttaaaggatacaaagaagctgggtgcggtggctcacgcctgtaatcccagcactttgggaggccgaggtgggtagatacctgaggtcaggagtttgagaccagcctgaccaacatggtgaaacctcgtctctactaaaaatacaaaaattagccaggtgtggtggtgcatgcctataatctcagccactcgggaggctgaggcaggagaagtgcttgaacctgggaggcagagattgcagtgagctgagattgcgccactgtactggtcaacagagggagtctttgtctcaaaaaataaaaaaaaaagaaaggatacaaagaaatagccaaatgaagggatacatagggcgaggtctggaagggtcccgagtacaggagcttctgtccccatggagttgggatgtacctccctcctggcacacgaatgagttttgcaccttcctgtcaacctccatgtattcaaaatgctctctggaagctctctgaatcctgttttttgagattttatggaggcttcattacataagcacgaatgacaactgtgtagaaatgtgattggacaaaatgggtatgttctcatactaaccgactgagtggggaagcccaccaaggcctgtccagattctccttgacctctctgtgcagcattcctccctccacagtaaagggcaggaccctctctagaatgagaatgagaatgaggatctctggacccacaatcagattagagtcttgccttggatcaggtaaaaggaggacaggagaaggtcagagagagagattctgtttcctgaggattgctcctgagccctaaagcaccccaacattataacagaagaccgtaaccagggctacggagggttgtaagccaggagccatggacagaaacatacatgtgtgtacagtagctcacgcttttacttttttggagtcacaacttcttaatggcttgatttcatgacatattttctttggtcttccagaactttcctcttaaaaaaacacagcaaaaaaacaaaatttgatttgaaatttttgagatttttttttaagagtcattagcaaatccactaatgaattttccccaagcagttaggagatatttctcttcattacacctttgggatttgagtgcttttgctaaaaatttaagttttttttcccactacggttttaatatgaacatgtggaaagacttcttgtatagaaaaatgacttgcaaaatattattttttcaggttctatggagtgatttcccccccttaggaaaaaagaactcaggaattttaagtttatatgtatatatatttattttattttattttatttatttattttaagacagactctcactcttttgcccaggctgggggttcagtggcctatctcggctcacagcaacctccgcctcctgggttcaagcaattcttctggctcagcctcccaaatagctgcgattacaggcgcccaccacaatgcctggctaggttttatatttttagtagagacagggtttcaccatgttggccagtctggtctggaactcctgacctcaagtgatccagctgccttggcctcccaaagtgctggaattccaggcgtgagccactgtgcctggcctttaagtttgatattttattcagataaatatggaaaaaaaattttagctttattggcaaaatttattattcatatagaaatcatctgataatctgatagattaagtacagccctgcaactggattctaataaaccaagtcctctaggtcattaagattgttattggacatgaattcagtcattgagaaaataaaacattgttttgttgttcctcagttgtggtttttgttttttttttaagatagagtttcactcttgttgcctaggctggagtgcaatggcatgatctcagctcactgcaacctccgcctcctgggttcaagtgattttcctgtctcagcctcccgagtagccgggattacaggcgtgcgccaccacacccagctaattttttgtatttttagtagagatggggttttactatgttggccaggctggtctcgaactcctgacctcaggcgatcaacccaccttggcctcccaaagtgctgggattacaggtgtgagccactgcgcctatccgtactgttttttttaccccttgctttttttttcctttctgctgagatgctttaggttttaacagacatgtgattgggccgaggggcatgtgaggaggctggacaattaactacagttagcttattgcatttatcagcaccagattgtgtgtggttgaaatggccaaggtttgatgttttgttatgaatgttccagtatatcttataaattacattttcttaaattgatttgttactacttacaataatgtttgatagtattaaataaaatcctacttattctgttaaattcatataattggtagaagaatcatagtccggttattactcttttttgagacaaagtcttactctgtcacccaggctggagtgcagtggtgtgatcatagatcactgtagcctcagcctcctgggttcaggtgatactctcacctcagcctcccaagtagctgggaccacaggtgtgcaccaccatgcctggctaatttttttttttttttttttgagacgaagtctcgccctgtctcccaggctggagtgcaatggcgtgatctcagctcactgcaacctccgccccctgggttcaagcagttctcctgcctcagcctcccgagtagttgagattacaggcgcgtgcctccatgcccagctaatttttgtatttttagtagagacagggtttcaccatgttggccaggctggtctcgaactcctgacctcgtgatccacctgcctcagcctcccaaagtgctgggattacaggcgtgagccaccatgcctagcccacctggttaatattttttattatttttgtagagatagggtctccctgtgttacccaggctggcctcaaactcctagagtaaagtaatcctcccatctcagcctcctaaagtgctggtattataagcatgcagttcttattctcttgttgatctgattataaggctctatttaagacagcataggcccaactggcagaagtaggtgatggctggatattgagaaataatgttttctttgcatgatccttaaggaagctgacctggttacaactcatgaattgggacataattttggagcagaacatgatccggatggtctagcagaatgtgccccgaatgaggaccagggagggaaatatgtcatgtatcccatagctgtgagtggcgatcacgagaacaataaggtatgtgtgtgtcgagaattttttatgtggtttggaaagaggctgtgtataatgatcataatgagagctcagaaacgtattccattcctaggcgtttccctagggatggatgtgcaaattacaaagtaccttgaaacgtggttgtgtgttttggggtgaagcacggttcatctaaatctggttaaaactatcatttggactttgttgtcaagcttaatggtgtagatttgagctctaggaaaaattactaataataatggctttttttggagttctggatttcagggtctggtgggctcaggctttatgttaaaaatttgtcatttcatttacaagttgtcattcattttaactctacaatttacatgtacagtttacacgtttttattaacttttgcagttaaacacatagtttgcctgactacaagcctcatgggagaaaggcccttccttgtctgtcttattcatagctctatcttattcatagctctatctccagtgcctagtaggagtatctggcatgtaacaaatatttgttgaataattaatggaatcatttactattgggggtttctgatagagaatactagttgatttgtgatactgtaaaacactttcagagactttaagagtgccgtgactaactcttagagtctgaactaaaagttgtgttaataaatatctggttctttcattttatttgaagttaaacagcataaagcagtgtgaggaaaacaatagttgcactgctgagttaaagagggtcggtggggagagcttaaaggagtctgattctaatcacaaaagattgtgaagtatttgtcctgactcctattttgagcttggctgtgggctaatgtgcaagccttccctggacacagagggcaagattacttctgcttttccctggctctgacaccctgctttctgaaatttctgcctcctgttctttttgtgatctttgattgttgcatctcatttttttttggctttttatgtatattttctgcatctcattttctttggctgttatgtgtaaacagttcctctgttactttgcatgttatgttttatttttcctctgcttgacaacttgtgccagagaaacatttttctacccctttttgtctactcttccaacctgtcaaactgttgaattttccttctcttttcatagtctctgcatttctaatcatgttcactatagttcagtgctgcccaatagaactttctgctgcggggcgggggatgttttgtgtctgctctgcccagtatagtagccactagcccagtggagcaattgaaatgtggctagaaactgaggaactgaattgtaaattctattttatttaaatttttaataatgtttgcctgtgatgggagacgggaatgggcattaactgtaaaaggacatgagtgagattactggaaggatggaaatgtcctaaaattgacttatagcaatggtttcaacacttggtaaagttattagaaatcactgagttatatacttgaaatggatcaattttgtgatatgtgaaatatgtcttaataaagttgttaataagccaacaaacaaaaacagcagtgtgggagcagaggaaaagtagcgcggatgtagaggagctgtgaagtcataagttgattattgttgaagctggtgaggggcacgggggcattcatgataccatcctgtctacttcatagatgcttgaatatttctgtaatagaaactgtaaaatatgtgactaggaacaaaatttaagtagccacatatggttggtggctaccatattgcatactgtttctctaagtaataggtcatatgcttcttggttatgaggatagtgtcagaacttgggagcaaaatgttttactttgcagactgcctgggtggacatgcatgctgctgactcttcctgctgccagttctggggctcttcaaaacagccctgtaagaacttgccagtgaggcatggtggctcacacctgtaatcccagcactttgagaggccgaggtgggcagatcacttgagcctaggagttcaggatcagcctggacaacatgtgaaactccatctctacagaaaatacaaaaattagctgggcatagaagcacatgcttgtagtcccagctactcaggaggctaaggtaggaggaacccggggagttcaaggcggcagtgagccaaggttgtgctactacactccagcctggatgacagagtgagactttatctcaaaaaaaggaaaaagaaaaaaaagaacttgctaatgagaatggggcctgggaagaactttttttttctggagctgccagtctgtatcaatgaagaacaatttatttattttgtcctgagcacatcatatttagtctgtgtttttctagtttggttgcccaagtaggagtccccttgtaagaagataatgtgcatcttctatgttttatttatttattattatttattatgattttttgagtggagtctcactctgtcgcccaggctggagtgcagtggtgtgatctctgctcactgcaacctccacctcccaggttcaagcgattctcctgccttagcctcctgagtagctggggttacaggtgcatgccaccacacctggccaatttttgtagttttagtaggatggggtttcaccatgttggccaggttggtcaactgactggtcaacaaactcctgacctcaggtgatccacctgcctcgacctctcaaagtgctgggattacaggcatgagctgctgtgcccagcctatgttttaaatgaattccttaataaaaatatttttaactgatgaaaagggcttacaggacaaaaataaagtagttccttgacctagaaagacagaacccatcaccctctactaggcaagcctatgaagagcagtttgccacaggtggacttctctgtggacagatgacattagtgaaaaggaatgtaggacctttgagattgtaacttcttaggaaggtttgctgaacggaagaggaagtcttatgacaaggatgcaaacagaagctgccagatcttcagggatgtgtaggcagaaagccagagttgcgggttggtccttttatcgttagtgctctccagctgcttgggagttgtaactctgacaaatcagtgaagaggtcttcttatctgttcactgtgaattttaactccattttaacctgataaaatggaacccagagatacatgatgttgatgaataaacccaccaaaatgacaactgcctgaggccccgattagaataaccagaccccttagacatctgtactgtaacgacagatttgggccgggcgcggtggctcacgcctgtaatcccagcactttggagaccgaggtgggcagatcatgaggtcaagagatcgagaccatcctggtcaacatggtgaaaccctgtttctacaaaaaatacaaaaattagctgggcgtggtggcatgcacctgtagtcctagctactcaggaggctgaggcagaagaatcacttgaacccgggaggcggaggttacaataagccaagattgtgcctctgtagtccagcctggtgacagagcaagactccatctaaaaaaaaaaaaaaaaaaaaaaaaaaacagatttgaagatgttttttaaaaagccagttagtatttctgtgtaagatgaggtctttgctatctttctgaaagtagctcctttggtgtctgatttggtggttacaggcacctttggagggtctcatacacttggctctcaggggcttcatgattgttgtctggggtgaaagtgaagccattttggcatctgcagagcactttggagaccccgacctaagaagtaactatgctcagttttccctaagcctcttctttttttgataacttcaggaggtctggaaaatgaccgcagttttagagctcctgataaaaccctcagccttaaaagggagttatcctagtggttctgtactccagggtgggaaggtagtgtagagactttttgagacactggtcttgctggttgatgaaaatgtttaggtaacaattggggatttaatttatataaaatgtactattatgcctattactaagctcaaatatttaaacaactttaaacttggatcatccatataagtagccaaagaaggagaagaaaccccttctcctgcatttctgaattgttttgtctgggacaacattaacctacagaggttcttaattcttgtcactgcatgagtggcatgcctgaggtgaggagatttcaagtctgatggagctacgagctctctgttgtgctattctgcttgtccttaagtgggctttgactgggatgtttggtctcagtatttgtatagcttgcttaccttcgtaagaagaattatagatccttaaccaagttcacatcagccatttagcattctatggagggaggttcccagttccatatcagtggcctttggaggagactgtggtggccttgccataactccagggtggctctgatggtggttttacattaagagtttgtctctagagaagacacaaacattgcatgggaatacatttttatgatattattttgggtccttattgccttttttctctcaagatgttttcaaactgcagtaaacaatcaatctataagaccattgaaagtaaggcccaggagtgttttcaagaacgcagcaataaagtttgtgggaactcgagggtggatgaaggagaagagtgtgatcctggcatcatgtatctgaacaacgacacctgctgcaacagcgactgcacgttgaaggaaggtgtccagtgcaggtgaggagtctctccacagggattttgggaagttggtataacaagatgtccaaaataagagaagactgaacttgcaggggctttagaatcaactgaaaggggtgtgagtgtgtttgtttacatctacctcttttgcccttcacagcaagaaattgctttctgggcctggcacggtggctcactcctgtcatcccagcactctgggaggctgaggtgggagaaatgcttgagaacagcctgggcaacatagtgagacactatctcttaaaaaacaaaaaacaaataagaaaagaagaagctttctggaaagcagtgtgacattatgtaacaaaatccttgaccttgcatgctccttggtttagcagtcctatagttaaaagaatcttttttttttttttttttcctgagacagagtcttgctctgtcgccaggctggagtgcagtggcgcgatcttggcttactgcaatctttgtctcccgggttcaagtgattcccctgccttagcctcctgagtagtgggactacaggcacgcaccaccatgcccggctaattttttgtattagtagagacgaggtttcactacggtggccaggatggtctccaactcctgaccttgtgatccatccaccttggcctcccaaagtgctgggattacaggtgtgaggcaccgtgcctggcaaaataatcttttttatttaatttaatttatttatttattttgagacggcgtctcgctctgttgccaggctggagtgcagtggcgcgatctcagcgcactgcaatctccgcctcccaggttcaagcgattcccctgcctcagcctccccaataactgggactacaggtacgcaccatcacgcctggctgattttttgtattttagtagagacggagttttagcatgttggccaggatggtctcgatctcctgacttcatgatctgcccaccttggcctcccaaagtgctgggattacagaggggagccaccgtgcctggcctttattttctttttgagacagggtctcagtctgttgcccaagatggagtgcagtggcatgatcatggctcactgcagcctcaacctcccaggctcaatcagtccttccacctcagcctcccggatagacaggactacaggtgtgtgccacctggctaattttttttgtattttttatagagatggggttttgccatgttgcccaagcttgttgtaaagtcctgggctcaagtgatccacccttctaagcctcctaaagtgtggagattctaggtatgaggcaccatgcctggcccaaataatcttttatttcttttttttttttttttgagacggagtcttgctctgtcgcccaggctggagtgcagtggcgtgatcttggctcactgcaacctccgcctcctgggttcaagccattcccctgcctcagcctccccagtagctgggattacagtgtgcaccaccacgcccagctaatttttgtgtttttagtagagatggggtttcaccatgttggccaggctggtctcgaactcctgacttcgtgatctgcctgcctcagcctcccaaagtgttgggattacaggcgtgagccactgctcctggctgcccaaagaatcttttgggcaacagagataagatttaacaagggtataagatttaacaaggtttttttatggctacatcctaatagcaaaattttggaaacaatcaaaatgacagtcttgggatatgaatgttatcatgattctatatactggaatagtgtggaggaagtaggttacaagttagaaagttacccaggttttcattttttatatacactgatagaccagtgcctggcttagaagtaaaagggttaaacttcagttttctggtgaataattgagatttaactggatacagtgcatattaacgctgtaaatactgatggggagtagagttctggctgccgagtgtcttagctatggattgccttgtggccccaccttgtcttttttttttttccttgtctttttttttttttttgagagagtctcgccctgttgaccaggctggagtgcagtggcgcgatcttggctcaccgcaacctctgccttccaggttcaagctattctcctgccttagcctcccgagtagctgggattacaggcatgtagcaccatgcccggctaattttttgtatctttagtagagacggagtttcaccatgttggccaggctggtctcaaacccctaacctcgtggtccacctgcctcatcttttttttttttttttttttttttgagacagaatttctctcttgttgcctaggctggagtgcagtggtgcgatctcggctcactgcaacctctgtctccggggtccaggcgattctcctgcctcagccttctaagtagctgggattacaggagcgcaccaccacgcccagctaatttttgtatttttagtagagatggggtttcaccatgttggccaggctcatctcgaactctcctgacctcaggtgatccacccacctcggcctcccaaagtgttgggttgggattataggtgtgagccacctcgcccagcccatcttgtcttttttaaattaatgcgttaaatgaatgaaaaccaagggcaccaagatgtttcacaggtgattgctgtgttcccattcttttctcctatagtgtggcatttatgtgacctcacgcacattaggaagggacaaagtgtgtgcaggtagctctagcagcggagatgtctgatgatgtaggagtgggtgacggagccaggaggtcttccccggtgatcttcaggtcactgtaacgtaactgtagcgtttgatttgatatggggccataatttgaattgctctgttcctgtctgctgttcttctccagtgacaggaacagtccttgctgtaaaaactgtcagtttgagactgcccagaagaagtgccaggaggcgattaatgctacttgcaaaggcgtgtcctactgcacaggttcgtgttcttgttgcttccttggaatgctgtgggtcaagtgtgtgtgtgtctttgaaaaacaagattatgttttgttcagatgagagacaccttatttttaatctcatatgccgggttgagtttctggcactccttagtttgtgacacttggctttggtgggtttaagacctgtttctatttctctttcatttccatcactctcctctttctcctcacagacatccactctactgtggttaatatttgcctggatatgtgtatatccttgaaagatcatatagtgttattttgtgcatgtatgtgtttttaatgtgccaaaatgatattctaccttaaatttacttttaaaaaattcagtatcatgttttaaagaattacccatattgtgctacagataatataacaaggtttttaatggctacatcctaatagcaaaattttggaaacaatcaaaatgacaatcttgggataatgaatgttatcatgaatctatgcactggaatagtgtggaggaagcaggatacaagttagaagggtaaccagtttttctatatgtatctatatgtatttcactgttggggacacctacatattgtttagttatatgattggctgtgttttacttacaagtcaccaagtggtagctacttccattgccttcatccccttgatattccagataggacacagatcacatcctcctacgtcccttcaggaacctgtgtgtttctctgggtactgaggagtgtcattgtgtagtcacagaggcaggatgtgctggtctctagagcaccactgctaggttgcctgtgtctgaggactccttatcctgacgttctggccaacgcttggaattaccctgctgtcctattagcatgatgagtataaagtaatctcttgttcttacttttttttttaacagcccttgtcctaatgcacttacttacatttttcttgagcatctctttatatttttcagctattcagatttctcctgtgaatagccagttcatatatttggttcattttttaaaaattgggtttcatgttatttcactactgtgaatttggaggagttcttatgtaatcatccatttgggcatacgtctcctatctgttgccattctcagaacagaaatctttaacgtaatcaaatccatcattttgttgtgtgtgtgtattttttaaacacatggttcagaaaagccatggcggatggttaaaaagatattttccacagctgcttctattagcttcataagttgtccttttacattcaggacttgaatctttctggagctaacctttccaggtgtccagtatcttttgttcggtcaattgttgctttaaaaatttcaaagctatgttattactaggtatataaacggacatatctctacatctttatctgctgttccttaccagtatataatgttccttttttacccttgcgatgttttttgacttaaattgtcaaaaagcaatattcagtttgctattctagtttttttgttcctctgatatatctatctgtcccattcttatatttttcaaaatttgtctctcttggttggttggtttgattttgtaatagctttattgatacataattcacactcatgtagtttgcccatttaaagtgtacagtttaatgatttttagtatattcagatttatgcagtcatcacaattaattttagaacatttacattactccagaaagaaaccctgtatcctttagctatgatcctccaatccccccattccccacaactcagagcaaccactaaccaccctattctttatggagttgtctgttttgaacatttcatataaatggaattatacaatatggtttcgtgaccacatattgtatgactggcttctttcactgaacatagcatttttaaggttcatgtatgttgtagcatgtatcagtacttcatgtacttttattgctgggtaaattccattgcatggatatgccacattttgtttattcattcattggttgatagacatttgggttgcttccacttttttgctataacaaataatgctgctgtgaacatttatctatgagtttttgtgtggacagttcctttggatattattcaggaatagaatttctgggtcatgtggtaactatgcttaatcttttgaggagctgtcagactgttttccaaaatggctacaccattttacagtctcagcagcattgtatgagggtcccagcttctccatatcctcaccaacacttgttatcttttttattgtaactatcctaggttttgtgataaggatgcaaacagaaagctggaggtcttcagggacctagtgaatgaagttgtgtcctattttggcttgattttggttttccgtgtgcatagtatgacatgttgcccatgtttttatcttttgggatctgtcactatcacattactttgccaaatgttaggaacctgatggcccggcacagtggctcacacctgtaatcctagcactttgggaggccgaggtgggcagatcacgagatcaggagatcgagaccatcctggctaacacggtgaaaccctgtgtctactaaaagatacaaaaaattagctgggcgtggtggcgggcgcctgtagtcccagctacttgggaggctgaggcaggagaatggcgtgaacccgggaggcggagcttgcagtgagccgagatcacgccactgcactccagcctgggcaacagagcaagactccatctcaaaaaaaaaccaaaaaaacaaatgttaggaacctgaatatctaaatcaagctttaaagaagcatttgctagctatgctcaatgtttcatcttcactgtaataataaaatagattgagaaaaatgctttcttttaaataaacgtaagtaaaacaatttgaaaacgtttgttcttatcaaacagccttttgttcccttgatattttatacaaaatagtagatagcagaggataagttcctgataaggaatcagtattttctagcaggaaaagctagagaacaacaacctcaaaaaaaaaaaaaaaaaagaagaagaaagaaaaaaagcaattagcatttcacaaccagcagcagcagcatcacctgggagcttattagaaatggaaattgtcagtcccctccctggatctactgcatcaaaaaatgtgggaagggaggccagcagtctgtgctgtgtaaccttctgtcaggtgatttccatgcatgctaaactttggggaccatgctagatagatgataccattttcagaattattttcctacctgtctaatactctgactttagtcttttaagaacagatgctcaacagatatttattgagcattttttaatgtatcagggcagtatcatataccaaaaatacaataatgatccacaatataaaccttccctgagctcactggacatcatactttcagtaatagtttgttaaatgactgttgacatgatgaatgcccagtgctcatgaaaggttttatgagaaccagaggcaaagtgcctggttatctgttgggtacttaataaaccatcacttttgtttgaaactggccagattttctgtacattttgtgttactgctctgaaaccctctaagtcagaattcttttgattggcttcattcttcagctgaaaggccagtccagagctgtggatatatagtccattgctttcataaagtgttttttttctcctcctctatttgtgttgacttttagctacttgtgctattcattttccagaatgattcactcattccatcctgtctctcccagtttaactttctttggtgggttttctttggcattattggcctgggcacagtggctcatgcctatcattccagcacttggaaggccaaggtgggaggatcccttgagcccagcagttttacaccagcatggtcaacacagggagatctcgtctctcaaaaaaaaagaaagaaaattagccaggtatggtggcgtacgcctgaaatcctaggtacttgtgaggctgaggcaggaggattgccggaacctaggagtttgaggctgcagtaagctatgatcacacccctgccttccagcctgggtgacagactgagaccctgtctcaaaagaaaaataaaaagaataattgatttatttaagaaatatttgtagtatacctataatatgatagggattggagataacttaatagatttgatcattgctgtcatggggctttccagtctagtagagggaaaacagaaaataacattaaatatatatatataaattgcaaaacatatgcaatgaaggagagaaggagtgtgatagtgcataatggaagtgggaggccacatcaacttagcatcctcagggatatctcagaaaacctttgagacaaaacttaatccataagaaaagccagctaattgccccaaaagagtggaaacaccagcattccaggtagaaggaatagtatctgttaatattgaaggaactgaatggaggttgtcatagccaaagcagtgggctgtgggagagttgtgtgcgatgaagtcagggccagatagggaaggccgtggagttcttttaagccttcatacaaagtttgcaatttattctaagtaatagcacataggatattcttttatatatgactgtgagatgcagaagtggagaccatgcattctaactggggcttgggaggccagggactcatgcagcctagcctggcacatagccaggcactcccatttaaatgctgattgctggtgagatgcaggctcttgtcctagctctgtaggtcactttttgcttttgcaaggtaagatgctcacttgtatgagaaacagcgtattatgcacctgtagaactggtggacctgtgactcattctttttgttatgactggtgtttgcttccaggtaatagcagtgagtgcccgcctccaggaaatgctgaagatgacactgtttgcttggatcttggcaagtgtaaggatgggaaatgcatccctttctgcgagagggaacagcagctggagtcctgtgcatgtaatggtgagcagttttattcccagtccagcagcaggagaaaacatggcctttgtctgccaggctcccttcctccatttggaggttgtgcgaatgacagcagtggtgagatccaagccgaggatgaggggatggggaagggcagggtggtgtctggagacagccatctctgcatgcagatccaccatacctgggagacctatcctgttggtgtttcttcttgctgcagtttcaggccatatggcaggctttgaggtgggagaggagggaattttgttgggggtgagtgggtgggtaggtagaggtgtgtcctagccttcctctgctccatatcatacaaaccacaaaagcagcagtagctatctacattacattggcatggaactaggatactcctgcaacaactccaccagagagagctgattccaggacctaaccccactagatgaggatttttgcagttatcaagaaggctgggtctgctcccctctgatctcttagagcagcctggggcaggagcctctctcctgctggcctgtcagttttccttaggtttctgtgctattttggaacccctgggtttgagggcatcctcatggactggtcagggactggctggactctgcttcccaccccacttaaaccatgggagtcgatgagggagttctcttgctttcaaaatagacagagagccaggtgtggtgactcacacctgtaatcccatcactttgggaggccgaggtgggcagatcacttgaggtcaggagtttgagagcagcttggtcaacatggcaaaacgctgtctctactaaaaataaaaaaaattagccgggtgtggtagcgtacacctgtaatcccagctgctagggaggctgaggcaggagaattgcttgaacccagggggcggaggttgctgtgagctgagattgcgccgctacactctagcctgggcaacagagcgagactccatttcaaataaataaataaataagtaaaaaataaaataaataaaagacaaagaacccggtagttaaataaaatcactgggttggaagctcaccatccatacagtggagtgaggaactcttccaagttcaataatgtgtaggtaaagaagataggttgagggcagtgtctcacatctataatcccagcactttgggaggccaaggtgggtggatcacttgagctcaggagttgtttgagaccagcctgggcaacattgtgaaacctcacctcttaaaaaaaaaaaaaaaaaggtaacacgtagcagatgccaaataaatctgttgtgttgaatgccaagaggcttggggtgctctggaaggacagagcccgacacagtaaaagtccaagaaatattttataaattagtgaatgatgaaaaggttttctttttttttttttttgagatggagtctcactctcgcccaggctggagtgcagtggcgcgatctcaggtcaccgcagcctccgcctcccgggttcaagtgattctcgtgcctcagcctcctgagtagctgggactacaggcaagcaccaccacatctggctaattttttttatttttagtagagatggggtcttgccatgttggccaggctgttctcgaactcctggcctcaagtgatctgtccgccttggcctcccaaagtgctgggattacaagcgagagccactgctcccggccttttctgaaaaggttttctttttgcttgtttttgtgttctagttgatttctttttctcctaagtatggtttaattttctggcatttctgccattcttatgtatgcccacatggctcacagatgcccggtgttttatcctgtgacctgtcagagctgttcttgggaggagttgtggagctttggctgcagggctcatgctcctggggtcactgagctccccacccaagggtggacagttgtgtcccagctgctctcgctttcagggagccagtgtgggccctgaggggcacactttagactgaaaaaccaaggattgaagtcagcagggtgacaagaaagttgggacaaagggaagcatttagaagagcattgtgaggggcttgaaggggagagaatagttagactttgaagagaggtcttgaatctagaatggatttttctctgcatttttttttaaaccttgtggcctctgtcactgaaggctgaggagtgtgacctcagaaactactccttggtgggggctatggatagtattagctatttaaataaaaaataaatgtgatttcttacctctttgggagcatggtcagggaggaaagaggaggcaggaggagaggcaggtctcagaacaatccagctgtcaatgcgtgttctctgttccagaaactgacaactcctgcaaggtgtgctgcagggacctttctggccgctgtgtgccctatgtcgatgctgaacaaaagaacttatttttgaggaaaggaaagccctgtacagtaggattttgtgacatgaatgtgagtatttatgtacagctttttctgtaacagccagataggaagtttttattttgtaagtacttgattttgcagatgaaaacaaatcaaaacacaagtggggctacatccttctggcccattgttatctacgggtattacttaggaggagaagacggagtgctttcaggtccctgcctgtagtttccttctgtggtgggaggctttgagcccagagactgagaaggactggggtggggactttatggtaaagttggttggtttcaggcagtgggtcctaattatgttttcctagattacttacagaactgactaagattgcaaaattattcagggtgtgattttgaaacaggtgctgaatgagtaggaaagacctagaaggctacttgacttacttaagccagacccttttgttctctagagaagcataatttttctcatgcagaatgatgggagagggttttaagatttacgaggcttcacagggagtctggctgtgttgttcactgtccactgtgtatgtgtagagtccttactggaatgcctcatctttagcaaactggtttccttgatttttgtctcctggtaattctaaatcacttgtaaaaatggagtaattatgaaagtgttaatgacagatgttctactttcttgggtactcattacgcggaagttattgccttgtgtcaaagatgggaaaacgtttgattttaatgaagccctttacatgtcagttatttttataaagctacattgcttctgaatacattgtgtttgggaatgatgctgtatgtatgttttttcttcatagggcaaatgtgagaaacgagtacaggatgtaattgaacgattttgggatttcattgaccagctgagcatcaatacttttggtaggtgatttccccagattacttactgagagctgagtcaatttctgtgatgacattagaaaagtgtgctttcagagtgatgtgctttaattctgcagtagaaggtggaactattcacagctttagttatgaaacaactttgttggctagaataaaatgaactcatagatagtctgtccccgtggagcttggatgcacagattttctgacaagggaaataaagtcaaaatactggcttccttctttacccaaaaatatccatgtgattagcataagcatagtttaatgctatagactgaatcctgattgatgtaagagtgtttatttgactgaatgctatatactgaatcctgcttgatgtaaaagtgagcctcatattttgcagaagcagggtatatcatgttgtcacgagtccataatttaatcacaaaaataatatccaggtaacaaaaactttgtcttcttaagcatttactagtagtagcattccatattaatctgttgacacagctactccaggtaacatgttgaatattctgcaatctcttcctgtcagccagtatatgagggctatttctttaaaagcacttggtatggagagatggtgtggtgtaatacaggcagcacagacattctgctctcggtagtatgtctagccagcagctctggcatttgacacaatggtaatatcctaagagcatttcactttagatttgtgaagtacttggtcaagacattaactgtttggaattgttcacaggaaagtttttagcagacaacatcgttgggtctgtcctggttttctccttgatattttggattcctttcagcattcttgtccattgtgtggtaagtcatcaacttttaagtaattaaatgttttatttaaattttgatcaactccaaccatgtaatctctggaaaaggtaaaacttgttcttagcaaagtttggcctgatatttccaatagctttttttgttgttattcctaggggaacatgtcttgtagaaagcttaactaatggtcttttaaaaaaaatactatttttgtgtgttggtgttttaatatataaatttcttaggaattttatacttttaagcataggagactgtttaactggatttgtccaggtcctttgatgagtaaagcccttattgaagagcattttcaggctgacttcgttgcaatagagcaaatatcaaacatcggcatttcagatgttccccatatatcatgtagattattggcagcagatggctatgtcttcagccttctgcacaaataggatgtagggactggggcccagctgtcatatagagtatttacatcttccccaaaaaataagagtaagcagtcttttctgttctcattcagaatcagtaacagctacaagttgaattgggctttgactaaggaactcctggtcctttataaatttgaggccctttttcataaatgttcttacgaatccattcacttgcatctgtggggaatggggatttgtctgctgtagagatgagaaagtcacacccaggcttccagacttgttttcccaaactctttcatagtggccttcctatgagcatttaaaaattccagcacaactctgatgacaaaggagtttttcctactgcctccttcctttcctttcctgctggcttctcctgcctaggggccatctcacagagcagctcttcctcagggtggtgagcatgatgggtataggaagatctctagggagcacttgtgctgaagaaagctgaaggtgacgtgcttgaagctttgacagatgtctctggatgacagtgccatccatcacgattgcttctattggaggatggaacctattttgtttacagggaagttgcacatgtggacaaggcacgacccttgatttcagagcaaagcctccgataggagggagggccatggcttgtttttggtcatagaatgcattgatggcacccagacaggaagcctagtcctggattcttggtccttgccctctgtcacctattatgcttcagccacaggcagggatggggcagcagatggccatgtggttagccttctgcagaagtaggatgtagggattgaggcccagttcctccagcagagcatggtccacagaaactgtggagacagctaagagagtgaggccatgggccggggcagtgcgaagaatgctgcaggcccagccacctgggtcttcctaccagttgcccttccagtcagtgcggtcctggtgtacccagcatctgggacatttgtcatttcatgcacaggaagatgcctttattattcccctgcccacagagggataaatttctcagaaaacatagcacttaaaccttgcctctttctgtacttaacgccaaaatgtatttcctttgagtgcaaaggaaacacttctagactggtggcataactaaagcttgggtgagaaatggattgtcatctgttgagcctgctatcactttctacaactcaggttctaagttcttcagttagtgttaggaatagcctgtgatgaaatagtactcactaactgaattgtatttgtagggaatgaccttcttgctgtttctttctaggataagaaattggataaacagtatgaatctctgtctctgtttcaccccagtgtaagtataccatatgaaagaaacataatcttcgcctggtctgaggccctgttaggcaaagaccttcacctgacccagcaagagctttcactggctgatggaaggtcatgttgcagcaggaagggtctaggttggaatgtttacccttctgacaacagtgatggtgaacttcgattagttgcatggatggacatttaaagagctgtgctgtccccttcccaagccataaggagtgatttagccattcaacacttagttaatattttgagttcaatttctctcttgggatcttaccttgagaggtttgaatcctcttttgggtcttcaaatggtaagtaagttttcaggatgcttgaaagctagtaattactgtttttgccattaaaagtaatggcattaattacttttgcaccaacctagtattttttagtcacttaggttgagtgagcctcacctagcacttttttcttagcatcacagtgccaacagaataagaggctgtttgatgggtaagggtggagctgtgaggacctccgattcatcttttattcctatcaatcaattgaacccatgtctttgcagaacgtcgaaatgctgagcagcatggattctgcatcggttcgcattatcaaaccctttcctgcgccccagactccaggccgcctgcagcctgcccctgtgatcccttcggcgccagcagctccaaaactggaccaccagagaatggacaccatccaggaagaccccagcacagactcacatatggacgaggatgggtttgagaaggaccccttcccaaatagcagcacagctgccaagtcatttgaggatctcacggaccatccggtcaccagaagtgaaaaggctgcctcctttaaactgcagcgtcagaatcgtgttgacagcaaagaaacagagtgctaatttagttctcagctcttctgacttaagtgtgcaaaatatttttatagatttgacctacaaatcaatcacagcttgtattttgtgaagactgggaagtgacttagcagatgctggtcatgtgtttgaacttcctgcaggtaaacagttcttgtgtggtttggcccttctccttttgaaaaggtaaggtgaaggtgaatctagcttattttgaggctttcaggttttagtttttaaaatatcttttgacctgtggtgcaaaagcagaaaatacagctggattgggttatgaatatttacgtttttgtaaattaatcttttatattgataacagcactgactagggaaatgatcagtttttttttatacactgtaatgaaccgctgaatatgaggcatttggcatttatttgtgatgacaactggaatagtttttttttttttttttttttttgccttcaactaaaaacaaaggagataaatctagtatacattgtctctaaattgtgggtctatttctagttattacccagagtttttatgtagcagggaaaatatatatctaaatttagaaatcatttgggttaatatggctcttcataattctaagactaatgctctctagaaacctaaccacctaccttacagtgagggctatacatggtagccagttgaatttatggaatctaccaactgtttagggccctgatttgctgggcagtttttctgtattttataagtatcttcatgtatccctgttactgatagggatacatgctcttagaaaattcactattggctgggagtggtggctcatgcctgtaatcccagcacttggagaggctgaggttgcgccactacactccagcctgggtgacagagtgagactctgcctcaaaaaaaaaaaaaaaaaaaaaattcactatctacaaacctagaatatttaaaatacaaagattgcctgttttcaaacactattgaataagagggtgagatatttcttaacaacaacaacaacaaaaaaaacaggttgttttgaatgtgatgagccagccaggagatagaatactacctgcccttagggttgggggctgtccccacaagacttgatacttcagaaaccctttttattgacccacaagcagatatttgaattacttcttactttattgctccaggattctggatgggctgcatttactgtgtgaaggataaaaatcattagcctggattctgatttctataaattgccattaaaagctttttttcccctaagaactgaaatgtgctcaccagccaaaacattttaacttgtaaattttgagggcagttaaccaaacctgtgactaatcatatctcctcctaccccccatttccaaggacatttgttactcagatacttgttatactaatacttgaacttgtaccttatggtatttgctatcttttaactagtcatgatattcttatactttagttacacttttggaatttgatacaaggttgagtggggtgtgtgggtgtatgtatgagtgaaacagttctcaaaagaatgtaagaaaaaccatttttataaaattgtgactttttaaaaacatagtctttgtcatttatagaattaacaagctgctcagggtatattttatagctgtagcactgatatctgcattaataaatactgtcgaaacacaatggacctaagtataaaacttccctgaaaaatcatctaatacttttattattaatatcagtggcaaaggtttaagcctgaggaaaaaagcgtacctctacgtattgacaactttgagttctgtagataacaagcagatttgggtctcctgtgattggctaatggtctccatctcccagcagacttaattcaggttttgcttctgctacatcccgccagtaaggaagcagcaaaggtagagaagagacctttttctctatcaaaggccagagatgcgagaacaaaaattcattcccctttggagacaaatgtagtccatctgataaataagatgagaagtcctagaagggagagaaatcggttaaaggtgggtaactggccacgtgtggtagctcacccctgtcattccaacactttggggccgaggattactggaagacaggagtttgagaccctgtctctacaaaaaattttaaaaatacaaaaattagctgggtgtggtggcaaacacctgtattcccacctacttgggaggcgaagatgggaggatcacttaagcccaggagttggaggctacagtga

SEQ ID NO: 13609 - DNA, 69062 bp, Human; identical to SEQ ID NO: 13608
  misc_feature (1)...(69062): n = A,T,C or G

SEQ ID NO: 13610 - DNA, 83428 bp, Human
aattgactaattacaaaacatgccctaggctcagtctctctctctccccagctccttccttctttctttcagggcagaatttctccagcttggctctattgacattcattgttgttcattttattggggtgggactgtcttgtggtttgtaggatgtttagtggcattactggcctccatccattaaatgccagtagcatccctccccagttgtgacaataaaatatatccccagacattgccaagtggcttctggggtagggaatctctcagatttaacaaccggttttggtttcggttttgtttttgagatggagtctcactctgtcgcccaggctggagtgcagtggcatgatttcagctcactgcaacctccgcctcctaggttcaagtgattctcctgcctcagtctccagagtagctgggattacaggtggcccactgctcccagataatttctgtatttttagtagagatgaggttttaccatgttggccaggctggtcatgaattcctgacctcaggtgatccacccaccttggcctccgaaagtgctgggattataggtgtgagcctccatgcccagccaacaaccagttttatagtgaccaaccatcccagtttgccctggactgaaggatttactaggatctctgaggcatttgtcagggattcaaggctaaaactaggatagtccagggcaaactgggatatttggtcaaccaacaagtaaagtttcatctcctggttaaattaaggctgtggtgagagggggcattgtgttgattgtgtggttgtcctgtcagtcttcagtttctctaagctgttgctatatcaagtacatctgcctaatactcctttcttccccctcaggtagcctgctagggttgtaggggaggtgtcttacttaaggaaggctggctgagccactgtatgggtcattacaggacagaagaagaccagagtgaatgctggtctctgtgtgttttttttttttttttttttttttttgcgtgtgtgtgtgtgttgaactaaagaactggtaggggcagttgggagggtgctggactgcagagagccctttagtgctgctccagtggacgtgcacatctgtgtttccactgagagttaatggatattggatggggaaaggttttcagctatgtgttactgtagcctatgactatgtggtatgagcattttaatttatttggtgttttgaaatacttttatgagttactctgacaacttgtcaaggatattttcctgagagaaacaaataaaagacaaatctcaaaaatagtttgctattaggattttatttgttgagatgttgaagatgtcttttcaacagtgatacatgttttggttctttgcaaatttacaaggcactcccaaaatgtcatttgtccctcattcttctattcttgatatcattctatgatcctgtacaggatgaaagcaactgagttctgaaggtagtaagtaacatgctgaggtcaaatgccaggatttgagtcaggttcatggggctccatgtcctgtgacctctctgctccaccaggctgtgaaagaatgactcttgcattcatgcagtcagtctgtgttgctgtaaacctgaatggtaaaatgacaaatgtagacacagagggtgtgaatcagctctattagcagtgactctgagaatagtcctttccctcctctgtcttccccttctctgtcttgcagcaagtgggaggacgaaacaggtttcataagagcagcgcccaagacccacagtcgcctagtgccaagtcaacaaccttactgatatctggatgtagtttcctgtgctctttgacacaggtgtggagattgtaatttgctgtgtgtgattgtttgcacttccttgattatgtaaaccagtggcttttgccaagaactcttcatgccctgaagctctgagctggttccctcccattggtggaccttatttcattttattgggaggcgtaactttcaggtcacagagcagtgataactacctgccagtgtctcttaggagtgaggtacctggagttcggggaccccaacctgtgacaatgacagcagacaaattggttttctttgtgaatggcagaaaggtaagtaggagctgacctttggttttgtgtcccttctccctgggaggggaaatgtgtcctctggcagagccatatcttgttctctgtctttcctgtcccctcttacttgttctgtctttctctctctcgctttaaaggtgtcgctgcattttggtaacattagggaagaagaccttctcggggctagagcacagacaagatactcagaggccaaagaatgagggagagagaggcaagcagagaggcatctgtgagctagctgccaactctctgcagtagtggagattggcacagaatgagaaaggggagttgagttctaggtgagatttgaggtcatcaccacacttctatttctgtctttaatcaaatatatcctaaaatttacgttgctctctttacagagagaaggaacaggaatgtgttttcctgcttttatcaggatataagatgtacgcagcctttgattctaatatattatatatataggtttaacagccagtcctgattcactgtgaggtgacatatactgacaccttgtggcaaaccacaatttttttttcataaagggcatctcctgcattccccccactccccacccacacacagtgagttctacatgtaagctgcaaatctgttacctacttgaatttaccttattggtacacagggacttagggaaggtgacatgggtaccagcccttggacaagagtgagaatctttgcaaattttaatgtggtgcagagagagagggggcaagcatattacatggtcactagcctccatttgccctcctacaacactgctgagatgctcatacctgttcaacttcccacttaggaatgaaaaggatagtaaaagagtcccatagttgcacattgtaacttactgtgtggactgtgcgtgatgaatgtgcccaaagtgtcccccaaagaagggcaattttatttgtctttctatattggcatttttgcattgagttgagaaacttttgatgtaattttgagtgacttttggtataattttcaagaacaataatgtgcttcactggactcctaggtcttaaatttccaggatgtgtttgggtgactgtaaaagaaatttcatgaactgtttcaacgtcagtgctccaaagattgatggactctctttgagtggtgcctttgggaagtgctggggaatggggacagccatgttcttctgggttcagagtttcctctctgagctgcatccttttcagggttggcacctggtaccaacccaagaagtagggcagagctttcaagtgtaagattttgcatccagcatttcaaacaacttctttccttcagcaattacattgtagaaatctaggaaaccattgtgcaattggctttctaggagagctacttacacaaagccatctctggaatttttattagtaatttttacattgggtaaacagctagattcaatgacgtccaaggtcatgtcttactctgaggttttattatttattaaaccaaaccattggttaacctgtaaaagtataagtttctgctcttcttcagggatggcttgctgttatgcactaaatctagaaagaagaatttcaaggtaaatctggcttggggaaaattattttcccttgcattttactttcactttaggagagtaattttaaatttttcgatggtaccatcacatcaaatcctattatttctagaagcttctactactgccagtttctgtgatgaatatccatgtttgtaatttataatgatgtagcatcttcagaaactgcaagaaaggtagaggggcaatgcagaaagtaattatgtgaaagcaatgctgtaaaaacaagaccaagcaagggaattcctgggtaaacaatggcagctgtgagaaagttgtcctcatttttattcagaagatattctagaccttttgttacaggaattgtgcaaagtagttaccaaagaagctgtaagaacttagtgactctttttttttattattatactttaagttctagggtacatgtggacaacgtgcaggcttgttacatatgtacacatgtgccatgttggtttgctgcacccattaactcgtcatttacattaggtatatctcctaatgctatccctcccctctccccccaccccacgacaggccccggtgtgtgatgttccccttcctgtgtccaagtgttctcattgttcaattcctacctatgagtgagaacatgcagtgtttggtttttaaatgtgagcctactcctctccttgttttgtaccactgtccaggactctggcttcactaaatggggtcctgcagaaggtgttcgatgcaagaagtcgaatacctctagggccttctgtggtggtgatgagccttgatgactattgttttcattcacatcttcttttgttctagagtcagagtcaaagggaaagagctgtccagtattttatttttattgtaatgacagcctttttgcaaggcagcattctagcttttctgagtagtcactctgtctagctgagactgtggcacctggaagaatctgggaggatctggcaggttgggtgcagccaaaggtgtccaggagtgatccccacaagaagtgagtgtcagctacagagatcgtcacggtgactttcactcactcactcactcactcactcacttactcatcattcacttgctcactccccatatagtcaacatttatcaagctccttctgaggcctcagacaacaggatatgcactgggggaataagatctccaagatcaggcatttgccattctggagcccatatactagttagagagatggattataattagacaaagtaataccttctgaaatgtatttcacagaaaactagcagcatgagatgctcttcttggatattcttaaaccacttagcacagtgcatggtatacagtaggtgtccaactagtgtggatggaataagtggatgaatttttaaaactttgagaaatcctgtagtaaataaattacttctctaactttgtattttacaattattttatatttaaagaaaaactgcaagaagaatacaaggaaatactaaataccctttatgtactttaccaactgttaatgttttgccacatttgctttattattctctctttctcactctggacacacacacagatacacatgtatgtattataagtacgtaaataattctatatattaatgtacataattaatataaatgaatatatagtataagatagatttctgaaccttttgacagtaagtttcagacatcatgttcctttagctcttatcctaagaataaatatattctttttttttttttttttcctgagacagggtttcactctgtcgcccaggctggagtgcagtggcgcgatctcggctcactgcaaccttgcctcctgggttcaagcaattgtctgcctcagcctcctgagtagctgggattacaggcgcccaccaccgtgcctggctaagtttttgtatttttagtagagttggggttctaccgtcttggccaggctgatgttgaactcctgacctgtgatccacccacctcggcctcccaaagtgctggtattacaggcgtgagccaccgcgcctggccagaataaatatattcttacaaaactgtagtccatttatagaaatcaagaaacttagctttggtgtaatactataaactttatgcaaatgtattccaattttcccaatactggcatttataactccccaaccccagcccggaatccaagattacgccttgcagttggttgccatgtctttagtctcctctaatctagaacagctcctcagctttcctttcatgacattggtgtttctgaaaagaacaggccagtttttttttagaatgttcctcacattgaattgtattatgctttcttgtaattagattcagagtctgcatttggggggcaggaataccacagaagtaatgtgtttttctcactgcattctgtcattatgtttgtttttttaacgtcagtttttgggtcttttttgtgatgcgaactttggtgacttggctaaggtgttatccaccacgtttcttcactgtaaggtaacttttctttacctttataattaatagaggctatgtgagaagataatttggaatgatacaaattcttgttcatcaaattttcacccactaatttgagtatccattgatattctttttttaaataatttttattgtggtaaaatacataaaatttaccatcttaatcatttttatgtgtacagttcagtggtattacatacattcataatattgggcaaccatcatcaccgtccacctccataacttctttcatcttttaagacaaactctataaatttactaaataataactccctattctacctttctcccagtccctggaaaccatcattttttctgtctctatgaatttgactaaactacctcacttaaggggaatcatacagtatgtctttttgtgactggcttatttcatttagcataatgttcacctatgttgtagcatatgtcaaaaattccttcctttctcaggttgaataatattccattgtatggatgtatcacattttgcttatccattcatctattgatggacattttggttgctttcacagtttggctactgtgaataacgttgtcatgaactcaggtgtataaatatctgagaccctgacttcaattattttgggtataaatccagaagtggaattgctggatcatatgctggttctatttttacttttttgtggaactgtcctacttatttttccacagtggctgtatcattttgcattcccatcaacagtggacaggtgttccagtttctccacgtccttgcaaacagttattttctgtttatttgtttgttcgttgatcatagctatcctaatgggtatgaggtgaaatctcattatagttctgattagtgatgttcagcatcttttcatttatttgctggccatttgtagatctttggagaaatgtctattcaagtcctttgcccatttttgaattgggttttatagttgttgagttttaggagttctgtattacacttgatctcatagtcactgatggctcattgcaacatttacataaaaaccagaagaaaagagaagaaggggagatggaaagacctttaatttttaatttttgggggtacatagtagatctacatatttatggggtacatgagatactttgatataggcatgcaatgtgtaataattacatgatagaaaatgtggtattcatctcctcaagcatttatcctttgtgttacaaatgatctaattatacttttttagttatttttaaatgtacagttaaattattattgactgtagttattctgttgtgttatccaacactaggtctttttcattctttctatttttttgtacctattagccatccctactttcctcttaccccctactaccctttccagcctctgataccatccttctactctatctccatgagttcaattgttttgatttttagctcccacaaatcagtgagaacatgtgaagtttgtctttctgtacctgacttatttcacttaacgtaatgacctccagctccatccatccatgttgttgcaaatgacaggatctcgttcttttttatggctaaatagcactccagtgtgtatgtgtaccacattttctttatccattcatctgttcacggacgcttaggttgcttccaaatgttggctgttgtgaataatgctgcaaaaaacataggagtgcaggtatctgttttatatactgacttcctttcttttgtgtatatacccagcagtgggattgctggatcatatggtagctccattcttaatttttgggggaaacttcaaactgttctccatagtggctgtactaatttccattgatgattcttaactggatcaattgtgttgattacaagatggccaatcatatttattagatgacattcttctgccaggaagagcttttccatatcttccatttgtttgtttgttgactctatttggactcataggttttaattgtatttaatgtattatagcccattatggctgttatttcttttgatgctcaagttttaccagagcaatctgcttaacccaacatttccttaactcacttccctacaaaatgtttttcctttgggatacccattggtatcctgttgagagtgttcaatggagtgcaccatggtaatcctgctgtcacaccttgagagtggcacagtcattctctatagcaatccacttgtggctggagtgataaggaaagcctttatgaagaaattgtttgaagtcttctgataagtcaaaatgcaggtggaagaggaatggcatagtcaaaggcacaggaattagaagatataaaatgtatttttagtgcactaagatgaccagcttggcagggaagtagaagggagaaaggctgaaaatgaagattgggaatatattgaaaagggccttgaaagacagcctaaggaacttggatgttaccttgaatatgtgggtggtcatgaaaagcactgagcagggaactgatgtgatgtgataaaagcagaactgcagtacaggagaaatgaacaatgtggtggtaagctaagaggctcttaatgttgtctacaagaaaggtgataaagattgctattttgtgcatttatgattacttctatgatttgtaaccaggatattgaataagctggactcatggggtgtaatcacataagaaaattaatttcatctactttcctttaaactttattcaaaggacaaattctggcagtttcatgaactttttattactcttagtcaataaaaaatcttatggttatttttaagttgccaaacagtctcaattcaggacggcggggtgaggatagcaagaaagctctcctttaattggtactattgtaagatggcttccggctttctgagccttttaggtgtttggagctgacctttcattcttcttgtgatggctttcaaggatcttcaagggccaccacagggaatatttgcatgcatgtctcatgatatgagtgatgcacttttctcaggctgctgttctccatcagcctccagtttggggaagtccactccacacagtctctctttattgaatgctctatcctgtattttgggaaatgatttaaagacctccaagccagctctttttatctcatgaatggcttgcattacatccataggcgacacttccacatcctctgctctaccaagctccgggagtgtataccaaccccagcacagccacctctccaacttaagtttaatgaggagtttaaacttgtcattgtcggtattaatttcttgttaagcctatctcttcccctatgctgcaaaggtggcatgttagatttttatgtagcacaaagcaagctccctcactaagtttgaggtgggaggcaaatattcctccccttctcctttaggaaggtgtgggtagtatagttccctccaacgaaaaccttatcatgaattctttctctttattatcccaataatatacacccttttaagctttggtaatgtgtgaagagtactgaaatcggtttttgtagatttcctttgacaattcacagtgggaactgacatcgcactttctagaccactttttccaccttattgaacctagtgatggatctttggtttgagatttctctttcatttctgacatgtattagtgttgactaatacgcatcacatgccaacactctgctctgagcacaggccaacagaatggccttccacagtcacatgcaggatctgagattgtatactcaaagaggcaaagtccgagatctgcatgccatgctctcagatgcccctgaaattcacaggtgtgatctagcagttgaaatgagatgacaggttttatttgaaggggatttggccttggtcgagccagcgtggaaggtgcaatgcctgcatgttctgtggtgggtcccaaggtgagcattgaggtacaattttagaatttaaggatttgagtatatacattgtctggctgtagtttataggttcattcttatggagttgccataaaaataccttagttttcatgatctatttagcacattgtattaggccattcatgcattgctataaagaaacacctgaggctgggtaattataagaaaagagatttagttggctcacagttctgcaggctgtacaagcatgacaccagcatgtgcttggcttctggggaggcctccaggagtttttactcatggcagaaggcaaagtgggagcaggcacatcacatggccagtaagagcaagagagagagagaagggggtgatgccacatacttttaaatatctcgtgacaactaattcacaactaaggggatggcactaagccattcatgagaaatctgcccccatgatcatattgcttcccactaggccccaccttcaacactggggattacaattaaacatgagatttagaggggcagagtccaaactatatcacacttcctactaactctacaaattattgagtgagacactgaaggaagaaattaattgcagaaagatgactaagtatacctatgatatatttttctttcatttattttaataggtggtggagaaaaatgcagatccagagacaacccttttggcctacctgagaagaaagtgtatcctgactttggagtgggagtgacggagaaggggggcaatggtgactgattctgtaggccttacattgtttcctagtgactggtggggtggccttgaggtgtggaggaaagagcactggattaggacttgggacacttgcattttagttgcacctgtaatctgaaattctcagctactgaatgagaggattgtttgtggtgatcttcgaggtgtctccccgctaagactctagtaatgccaaggtttaatccagggcctgtagaaaggtcctcattagccttggtgagcttcatggtcattcctctgtgggaagaggggggccttccttaggtgacatttgcttaatacataaatggagttcctggggaatgtttccagctctgcctaggtggagggaagcaagggaacatgtgtctattgggaaaaggatgcgtgaggtaagaatcctatacaggtagcattcattgtagaaacagcaaacagggagccctggagggtggggggactccttagaaagactggggtgctgctcttcactcagtgtgggtggggcttctggaaaagcccctttacctttagttctgagtatcggaagtattctgggaccctggaactaaaacgataataataattggagttaatatttaatgagcacttcctatatacaggcaggattcaaagtgatttgtgcagctcacctcaatctccacaggaatcccatggaagcgtaacactcccttttcacagaggaggaactgaggccttgatatgtgaagtgacctgccttttgctagtgtgttctggggaaatagtgatggagactgcaccaaagcctagagctgtgttcccaacctctcacccgcactggcaactctccagggggcctgtgagcaggactgtgctcatcctgacctctgtcaacaaaaccctccttctcctagcgggggtgtctagtgggtctttccagtgacatatttggggacagcaaagattattataacacgcacagaagtgagactggagcccatgctttcactctggtttgctcccctcctatcagacagtacagtggttggctttggtgtactttgttctggattttttaccttaagtgggtgtatctggaggttcacagaagataaacctggtggtgctggggagtgaaagtgtcactagatcggatcaggtgattgcatggaactccatttacagcccatctacctgggaggtctgggaagagaagctcattctcagagattattgagatcaattttagctttctaataataaaacaaattttaattttttaatcatttccattgtagttttgaaggcccagaagcctcagaaattccttatcagcaattggctgtgtcacatcttaaatgaaatgcaaaactgaaagttggcacataagtaggatgaccttgcagcttatggctatctgtgctgagagtcaatttatgggagttccagatgggggagaaaactccagccttgacttttacactagcttccagaaaggtctccaggctggaagaagaccttgctagactttgtactgccaccattcatcttcaggtgccaccattcgtcttcaggtgcccccaaagttgtttgacctgctgagagctgcatatatcctgactaggacacagaaaagcttcccaggtgtgctggggaggaaggagcgtgatgaagggagctcacccagtctggagtccgatggctgtgatggggccacaccggcagggtaacgtgttcctgtgtcatcttgtgtggcccacgttacctcttgggtctcagtttgttgttttttttaaatctgtgaggaagtttctttcctacctgctaaccaaatcattctggaggtcaaacaggtatctaggtgaaagtgcttttcaaaaataagatgttatatcattgtttttaaattttgtcttgaaaatgagagaagtgaccaggcgattatatcctcagttccctccatcttcagtaggtagtgggtggcttagaggcctgcaggtctgagggagaagcagccatgtgactcagggaaagtgacctccacaatagctgttctctagaatagcttaccagttaggcacttttaaaactcaaagtagcagatggtctttctgcaagtatatgtaagagtgaggcccaatattggacccagacctaaaaaaaccactctattttaatttccattcacatatcttttggaccaaatattcaaaagcctctggtctagccctaattttgattcttggggacttatcagcccaaaaagttcagagtgaaaagcaaggactcagaggtcccagaacagatcaatgtctcattctggcccaagtggcttcatggtgtgcccagctgggagtgatgtgagaactgccccgtatgctcaggtgtatgatttacctgctcacacatagaagacctcaacccaagagaaggctctaggactgaccagtcctagaactcatgtcccaagagatgctacttgggtgctgtccatggggttctgatgcctttgctcttctgtgcagtggagatggccgtgttccctgcctccctagggtgcagtgcagcccctctgaataaggaggccagtgggcctgctgccttccttggttgaggggcctgagcacgtgtgggaatgaatggctctgcccacagctctgcccaggcatttcctagcaacccagcagactcctctccctgagttcattctccttaactcttgaccacccagtggggctgagtggaaccaagctcggctgtggagaggggggctgcggggcttgcacagtgatgctctccaagtatgatcgtctgcagaacaagatcgtgtatcctttgcctgctggctgaccacccacatgggggctgcgatgcaggaccagcttgtgagggagtgcatgagtgtatgtgtgtatgtgcatgtgcgcatgtgtgagcccctgtttttatggagaatctgtgcacaggaaaactgtagaatgatctcttagcaagtatcttctaggcttataatattgaccaggctccgaactgctgataaaatgacttttctaaaatccacatttatatcacattccataaagcccttcaatagctcttcattgcccccaggacaaaatctctttgcttagcgggcaaggccctgcacagtatgccccaggtttcttctccagttttctttctcaccatgggcccagcactccattcaagcagagataattgtgaaataccaatgacacaggcccactaattgcttggtctttgtttaagctgggaagttctcctaggatttctctatctgactaactcttactagctctttacaactgggcaaaaatatcaccccctccaggaagccatcctggatctctcaagactgggttaggtgccccttgactgtgctggtcccatagtgccctgtgcacagcattcccaatgtaaactcaggcatgatacaatttttacagtttatttgagaaaacaacagttcatgagctcaagcagctccacattagaagcagttcaggagctccaccagggaaatgcaagcaggaggtttttgtaggatggacacaggcaaaaagcaaagaaattatttgattggttacaattatacaattgccttacttggtctatcccactggaaagtccctagtactatagttataagtttgttgactacttctgattggttgatcgtaaggcttttttttaatataaagatattcgtaagaagtagctcaagttaagactgctgcaaatcaagcacagtttaggtcacttgtgaggcctaactggtttcctctgctgagtcttcaggcctggtctcctttttaatttactttaacaagatttaaattgcaccttcatatggactttggttttctcagttgactgcagtctattgaagggcagagctttcatcttattcatctttattttcccagccctcagcagagtgcctgacttatgtctggcactcaataactgatgctgaatgtaagtgaatgagtgatgaataacagaagaatgcaaggaagttctagctaagggcttgctgtctcatgttgcctgggggtttcctccccctttccccacagagaaatgaaagcaatagaggcgaggaaatgcagggaagcaaagtgattggaagctaaggaacagccctgcaggcaggagcatgctttaaggctgcagcctgccagagaaatttcctcttgactcagcctcctgggtcaggctgagtaagaggtgactgaaagtgaccctggctccgttgctcctgctcagaggctgaggatgctctgatgcctgatcccacagtactctggaggggctcagctttacctataaggagagcttcctttgttcctttcccagagtcttcagtggagaggtgaggacactggtagaagagacaagaacataaatgggagcggagagacgtaacataaagcctcacaaagtcctccagagctcacagtcaggcccattctgatgatctgagtggacaataaatggaatgaccttaatctggggttctagccacttttctgccaatgcctgcctggcccccatctgctccttgcaccatgttgcagtgacaactgtggaaggaataggaagcaccaagacgaggctgcatcctgtgcaggtaaacagaggaaagggagctgtgctcttgagatcaggctctttcctctgcagggaggctcatgccaaagttgcagacttgctttgggttgttgggaagagtttcactgcttaatctaagaaggcatttcaccctggccacctccccatctcctctgggtaccgtgaggtgaaaagaagaaacacccaagcctgaagctccttcctgtgagctggttggttataacattgcatgatctgaagggacccaagaggccaactgaatctggtggctagaccagtccagaacttggaggaagggatgcagaagagcttcctcactttgttctggagtgtgtttaggaaactcccagccttcccagatttgaattttaattatctgtgccccttgtttataagcccacttactccctgcaatggtaattctgcaccccttacctcccacccgcagatagtacaaatgtaaactgctaggcctcctctttcattagactggaggttagcaagtgctaaataagatgacagagatttagtgcctgagcaaggctttctccttgatggtatcagaccacctgaaaatgcattgaaatccgaaacatttctggggcaaatgggcagtaataatcttagactggtttggggagacaatcaggatgctgttaggctgagtggaaagaaaggggagtagagccctgttggaaggaacggccattgtccccaaagcattttgtttgaggaaacttggggtctttgggagatcgagactatcctggctaacatggtgaaaccccatctctactaaaaataccaaaaaattagccaggcggagtggcgggcgcctgtagtcccagatactcaggaggctgaggcaggagaatggcgtgaacctgggagatggagcttgcagtgagccgagatcgtgccactggactccagcctgggcgacagagtgagactccatctcaaaaaaaaaaaaaaaaaaaagaagttaccagagcttggcccaggtcttaatcctcccttgattatttgaggagacatgtcattcaggcgatggagctggagcctcctgcggagaggctggtactattccttggagtggcatcttgggccagtcatgtgaggccagccaggtcggggtgggattgcttcccatctatagatttgtttcttaggcaggaagaggggaaattactaaacttgtccaacctgaaggagacgtgagagggttaattaaggcttgttattttctttgaaacaaacagatgaaagaaagaataaatagtttaaacataggagtcaagtattagtctattctcacactgctgataaagacataaccaagactgggtaatttacaaagaaagagaagtttaatggattcagttccacatggctggggaggcctcacaatcatggcagaaggtgaaaagcacatcttacatggtggcagacaagagaaatgagagctaagtgaaaacagaaacccttcagatttcgtcagatttattcactaccatgagaacaggatgggggaaccacccccatgattcagttatctcccacagggtccctctcgcaacacatgggaattatgggggctacaattcaagatgagattggggtgaggacacagccaaaccaaattaggttgtatctgtataatcaacctaaaatcctccctatccaatggtacaggttcttattcctaatcaacttattttggctacaaataggcttcagagccagattccacttcttgtccatttatttgttttctcttggtttctgtgacactgtggttctggcttttccttctctccccacacttgctcctcctctgctcagtctctaattgctgcagtgccctgagccctgacctgggcccctccccttcttcatccctatactctcatttacaacttcagctttgacctcccctcagaagttacatttccaattgcctatttgacatctcaatacggatgtctaatctcaaacttaagaaaaccctactcttttcctaatggcttccttccccagtcttctcccatctgagtcaatggcaaagccatccacccaattgctcaagacaaaaatctagacatcacctttgactgtttctgtcatatgccacacccaatccattcagaagctgccttctggttatgatagtcactgttctttgaagggaccttcctagtcatagctaacactggctgactgcctgctatatgcaggtacagtgttaagggttttacatgaatatctcagttaatcctcatcgcagctctagaggtaactacaaggatggtcctcatcatacagatgaagaacctagactcagagggcttggaaactggccaaggtcacagttggtaaatggtggcactggggcttgactctgtgcagtgattactacccccactatctctcaacatgtgctggctccagtcgagtcctttggggagcctgggagggttctgccatcccaggtgtctatgtcatctgtatcttttaggagagaattgccaaaagccacggctcccagtgcgggttctgcacccctggcatcgtcatgagtatgtacacactgctccggaatcagcccgagcccaccatggaggagattgagaatgccttccaaggtatgggccttcaggcacagcctaggaggtggaatggcaaacgaggccctgcagaggtcagggcaagtgccagggtgagaagcatgagggactaccctttggaggaagggctcaggccccccaacaaggtggtgactaagatctgctagaaagccaaccctctcttacttgggagaactcctggttggtgtggagacctcctggggtctcctgcctttgtgtccatatttctgaggtgtctgtctgccttccaccagtattggagtggggttggcagtgcatggctggtgcaggaagacgtcatttagaaaactccacgggggctagtgatatgatttccttccctctcagttttcaccagaacaggattctgcagggccaagaccaccaatgtgtctgcttctctgaattgaatagagaagcctccccatctattcaccatttccatcatttattcagttattttagtcacatcctatgccacagggataaaagacacaccctctactctcaaaaagttcatactctgaagaggagagtttgtaatgtagtctgataggctaactgatgaagctgtgatcagccactgtgggagcacttaggagaggtacctgactcagtctgggcattctaggaaggcttccattctaggaaagacttcctgaaatcatgataacttttctgaagtcaggatatgagaaggccaagaggccttccagacagaggtaacagaatatgcagcctggtaaagagagcacccaacttagttgcaagcaaagtcacaaactcctcacccatcccagggccctgcactgacattgcagttttttccttggcccacaggaaatctgtgccgctgcacaggctacagacccatcctccagggcttccggacctttgccagggtaagtggggaccccagaacatcagtgtctctgcttctaaaatggcaacactcagaaatcactgtggggagggagaccaagggcctctggtctacaaacaatgatgataagatgaccagttagtgagtcttccctctggggacatctggcatggggagtagagtctgccattcttattcagggaagggttcttatgaatagcatgggactttctgccagtgatggtctggagaccggcttcctggaagaggctcaccgcctgagagtgcctttgagcttggcagtgcctttgggcttggcagctttcccttggagactggcaggctcagcccatggcacaggtgctgaatgtagcatttaataacaacgtggccttgctcagcacttgcacccctcctccttccctctcctggctgctttctgtggctggcactctgttgggcttatgaaactggtaattagatctccagacagtttgtgaacccctgcaatgttcatataactctgagtgagaagtcacagccggatgtgtgggcattgattatataaacacatacacacacctgccatctggcaaggaaggcagagagctggcatctcctttcttggcttaatctccccccaggttttacttgacttctcaattgggccacgttaatcctgactccaaatcaaaccatctcatttcagtttgattctgggtccaggggagttacagactcctgtgctttccactcacctttagggttggagcatcatgaaaaagagtgctgtgtctgtataatcgtataatccaagaaggggtgggtaaacaaggagacaggaccttataaggatggaaaacaccacactctgattaatgctgctgctgatgaagaattaacaagtgtggaattaaatgaaaatgcctaaaagcacaaattcagattctgcagacctgggttcaatttgaggcacttaattgatgcacgaccttgggcaagtctccttgtttctattaggttggtgcaaaagtaactgtggttttgccattaaaagtatgggaaaaactgtaattatttttgcaccaacctaataaaatggtgattttattaggtgatttcattagaatatctaccttactgtgtttataaaaattaagtacttcttgaaaagcttttagaacaatgcctggcacatttctgttattcaataaatgggaactataaattatgaagctggtatatttcttccagtagcctctatataatcttcccaagttactcactgtttcctgagacccagagattgttaatcttgcctctatttacttcataagaacctgctcaaagtgatataatgtaatcagtcctcttaatttttcaaaagagaaggatttttgagtatagcagttgccttccctcctggaagttgaaatcgctcttgatttcaccatgcagaacttacctccctcaattcagctaccctgcagtgcagagcagagcaagactgagagctctgagcagccaaaatgcctgacacacaaaaggtgctcagaagctaatgcatgttactcatcggaggtctccgagatgtttcttcagagcctttttacttttattttacacacagctctaacaaactcggttactagctttcctgtccacagcacacactagaaagcgtgtggagggtcaactagaggtgggcacactgctcacggcgagaagtgaccacagctatctggtgacaaggaaagaaatggaggaaccattaaacaggtacaagcaagacttccagtttctggtctggcatgtaagcagcttaggagtctttatttcatctaaacaagaagaaaaaggctgaacaaactgaagaatcaacagttgtttttagatccatcagaggaatgaggtcacaggacaactcattgtccaaaaaattggagagacagacaggcagacacggcatatcagagcagaaacctctgcaggaacctttgccaggataggaagatgtaaggactaactgatgaattgctggagtttatacatggatataaactccagggggatgcagtcatggagcgggtgctctacacctttgtgagttttacctccaggatctccaccaggtcctcacagtaaatgttggagaaaaatctccttgtgtttctggtagggagtgggaaaaatgaaccattttggaatatgccagagcattctgttcttcttaaaaaggcctgtcctcagaagaaattattttaccgcagcctaaacttctgaggttatattagatcctcgcctaccttggggaggggaaatacgcaaccccaggacctttagtctttcacctgtgggaagggaaatacacaagcccagccccctccagccatcctgtcccaccaaacggagaaaaaaaaccctgagaagcgcttgtgaagttcacaggtgagcggcacaagctcaccaaaaaactgagactaatcctaggactataggatacttctccttcatatcttaccaatacattaactaaaggcctatttatatgaggtcttttcagccagtacatcatgtccacctttcaaccaaaaattataaggcatagtcaaaggcaaacacaatttgaagagactgaacaaacagcagaaccagagtcaaataggacaggaatattggaattaacaaatgaggaattttataaagctatgattagtatgctaagagatttaatggaaaaaatagataacatacaaaaacagatggataatgtaagcagagaacggaaattctaagaattaaaaagaaatgctagagattgaaaacgcttataacaaattgaagactaccttcggtgggctcattagtagactggacatggctgagaaaagaatctctgagcttgaggatatgacaatgcaaactttcaaaaccaaaaaacagagaaaaggaagtgaatgaaaacaaacagaaacaaataagaactgtgtgataactacaaaagatgtaacatatgtgtaacgagaatatcagcagtaaaagaagaaaaagagaaaggaaaagaagcaatatttgaaacaaaaatgactgagaatttcccaaaattaatgtcagattttaaaccacagagtcaggaaattcagagaacacaaaccaggataagtaccaaaacccaaaaccaaacaaaaactataccaaggcatgtgatattcaaacttcaaaaaatcaaaggtaaagaaaaatgacttgaaagaagccaaaggaaaacacccctcacctatagaagagcaaatataaaattatatctgacttttcccagaaaccatgcaagcaagaggcatggagagaaatacttaaagtattgaaagaaaaaaccaaagcacctaaaattctgtaacctccgtaagtatccttcaaaagcgagtgagaaatattttctcaaacaaaacttgagataatttgttgccagtagacccatcttgtaagaaatattaaaagaagttctttaaagagaaggaaaatgatgtaggccagaaactcagatctacataaaggaagagcatgagagaatgaacaagtaaaggtaaaataaaaatttttatttttcttaatcttaattggtctaacagatagcaatttgttcaagacaatcatagcaaccatgcatttgtttatgtgtgcatatgtatatatatatgtgcttgtgtataagtaaaatgaatgacaacaatgataaaataaacaagagggaaaaattagaaatattttgttattataagatacaatcactacctgtaaagcggtgtagtgttatttaaaagtggacttggattagttaaaaatgtatactgcaaactctagggcaactaccagaaaaaaaaaaaaaagaaaaaaggaagtataattgatactttatgaaaggaaaggagatgaaattatatataatgctcagttcaaaccacaaaagtcagaaaatgagtgaaagacaaaactagaaacaaagaataaggacgacaaatagaaaacaataacaaatatggtagatactaatccaactatatcaatgattaccttaaatgtcagtgatctaaatacaccatttaaaagacagagattgttagagtagatgaaaataacaagacccaactatatgttgtctacaagaaacctactttaaatgaaaagacacagatagattaaaactaagtagataaagaaaggtggaccatgatatactaatcgaaagaaagtggaagtagcatattaattttggacagagcaaacagttatcagagaaaaagaggggcattaaaaataataaaggaatcaatactccaagaagatataacagtccttaatgtgtgtgcacctaacaacagagcttcaaaatacatgaggcaaatctggtggaactgcagagacaaatagatgaatccattattatatgtgaagacttcaacacccttatatcagaaatggacagcaccaggccaaaaatcagtaaggacatagttggactcaacggcaccatcaattaattggatataattgacatttatagactactttagccaacaacagcagaaaagacatttttctcaagctcacgtggagcattcacctagatggaccacattctgtgctatgaaacacacatttacaaatttaaattgcatgaatagagatcatacaatgtctgctttcaaaccaaaatgaaattaaactagatatcgataacagaaagatagctggaaaacccccaaatgcttgaagattaaacaacacaattcaaaagaacacatggtcaaaaagaaaatctcaagggaaattttaaaatattttgaattaaatgaaattgaaaatacagcttatcaaaatttgcaagatgcagtgaaaacaatgcttagagggaaatttatagtattgaatgcatatattagaaaggaagattaaaaatcaataatccaccaggcacgacggctcatgcctgtaatcccagcactttgggaggatgaggcgggcggatcacgaggtcaggagttcaagaccagcctgaccaacatggtgaaaccctgtttctactaaaaatacaaaaattagccaggcatggtggcacacacctgtaatcccagctactcaggaggctgaagcaggagaatcacttgaacccaggaagtggaggttgcagtgagccaagattgcgccattgcactccagcctgggtgacagagtgagactccatttcaaataaataaataaataaataaataataaaaataaaatacaaataaaatcagcaatctgggctcccactttagaaaactagaaaaaaaaaggcaaattaaattcaaagtaagctgaagaaaaataaaatttggagcaaaaatcaatttcattgaaaacagacaatcaatagagaaaatcaacataactgaaatttgggtccttaaaaagatcaatgaaattaataagcctctggccaggctaactaaaaaaaaaaagagaagatccaaattactaatatcaaaataaaaagatctcactatagagctcatgtacattaaatggataatgaaggaatattaagaacaactctatgctcatatacttgataacctagatgaaataaaacaattccttgaaagatgtaagctaccaaaactcatacaaaaagtagataatctgaataggcctataactattgaagaaattgaatcattaattaataacctttaacacagaaagcaccaggcccagatagattcactggtaaatcctatcaaacatttaaaaaagaaattatgtcaattctccacaatctcttccagaagatagaatcagaggcaatacaaaagttaatcactttcatatgtaacagcaatgtataagtggaacttgaaattcaaaacacattatcatttacgttttacattaatactctccaacaaatgtaatacttaggtatgaatctaaaaagtgtgtacaagatttatgtgagaaaaactacaaaactctgatgaacaaaatcaaagaactaaacaaatggagagatatttctttttcatgaataaggagactgaatatgtcaagatgtcagttgttcccaactgtagactcaatgcaatcccaatcaaaatcccagtaaattattttgtggctatcaacaaattgatcctaaggtttatatggagaagaacaagatccagaatagccaactcaatattgaaggagaatagagaacaaagtcagaggactgacactacccaatttcaagatttactacaaagctgcagttatcaagacagtgtagtatggacactgtccatactacaaaaagaatggacaaaagaatggacaaagagatcaatggaacagaatagagagcccagaaatagaccaacataaatacagtcaactgatgtttcacaaagaagaaaaggcgatacgatggagcaaagattgtctttttaacaaatggtgctgcaacagttggacattcacatacaaaaaaaaatgaatctaaacacagaccttatacacttctcaaaattaactcaaaatgaatcataaacctaagtgtaaagcaataaaactcctagaagatgacataggagaaaacctagatgaccttggaatgatgatgactttttagatgcaacaccaaaggcatgatccataaaagaaataattataagctggacttcattaaaatttaataacgatgaatgaggagacaagcggtacactgggagaaaaatatttgcaaaagacacatcttgtaaagtacttatccaaatatacaaagaacttataaaactcagcaataagacaatgaacaactaaattaaaaaatgggtaaaagacctgcacagctacctcaccaaagaaggtatatggatggccagtaagcatataagttcgacatcatatgccattagggaattgcaaattgaaagaacagtgaaataccaccacaggtctattagaatggtcaaatccaaaacactgacaacatcagattctggtgaggatgtggggcaacaggaactctcattcattgctggtgagaatgcaaactgcacaaccactgtggaagacaatttggcagtttcttacaaaactgaacatgtcttatcatgcacctcagtgatcacacaccttggaactgactcaaaggaatttaaaacttattgccacatgaaaacctgcacaggcatgcttacaacaaccttactcataattgccaaaacttagatgcaaccaagatgtccttcagtaggtgaataaactgtagaacatccaaacaatggaatgttaattcagtgccaaaatgaaaggagctatcaagctatgaaaagacatagacaaaccttaattgctactactaagtgaaagaaatcaatctttagaagctacatattgtatgatatctattctatgaaattctagaaaagacaaaaccatggaggcagtaaaaagactagtggttgccagtgattaggggaaacagagggatgaatagtcagggtacagaggttttttagggcagtataactctttctgtaagatatcataagggtcaacacctgtaatcatgcatttgtcaaaaccaatggaatgtacaacaccaagagtgaaccttcatgtaaattaatggactttgggtgataatgatgtgtcaatgtgggtccatcagttgtaacaaatatgccacttttgaggatactgaagtgagaaaggttgtgcgtgtatgttgggataggggtatttgggaattctctacatcttccactcagttttttctgtgaaccttaaaccactctaaaaaaaaaacttttttttttaaaggcaccagtgcagaagccttagcctatttagtaaagtaggaatctcaggagggtggggatgagaaaatgtagtcttatccaacctcaatagaccttgagggcagtgatgcattactgtacatcacagtaatttatgtcattaacacaccaatgaattatcaagaaaatagatctaagtaataatgcactggcactttgtctggaaaaggcgcttctgtgaaatatgtccttcctcagagggccaggtgagtgggatgcaggactttcacttcaggtaggccagggcatttccctacatcactccttctccaagaagaaaggtgagaaaaggcactaagaaacctctctttcttcctttctttctttctaaatatagaggggaagtgcaaggtggctggctggggggaggctcagaatggacggagcaggtctggtgtccagtgctggagctgtgaatgcaggaagagtctgcacacggagcagcgtgtccaggtggtggggtgggtggggtgtttctctcctgatgccactgcctgcctgcttacaacttctccaaggtcacacctccagcatcccatgagtgctttcttgcagaagacaacgagttgtgaaacagactctggaaaatgccagcatggcatggtgtctcctgtggctgacttgcagaaggactgctcccagcctgctttttcaggaattgactacccgataaaagtgcctgaggcagaacctatgagtttcccctactttttcatctcagcacaactccaggactctgtcttctgaagccctgagctgcagatcagtcagctgagtgcgcccctctgccaccctgcagtgcctcggtgctgggtggtagtgattctagactctgtgtgtgctctgccactggtatcctaagaggtcctgagcaagtcttttcccagagatgctgggtggtctgacctgcatacttctccagaacaggcccacagtgaggagtgaagggtgtttacctttctgggaagaagtgcctaataagcagtagggaggccattgggcacactggctggacacagtgctgggctcagcacccgtcttggacatcctttggcagggtcctgcagagagcccagcctgggagacaccagccacgcccctagaaccttgctgatctggaagtcaagcctcttgagtcttgagagagccaatgggaatatccctcatagacgcttcctgaggaagcagcactgaagaagagaaatgggcataagggataggttttgataaagtaggacctagcttttatggagaaaagttcctgaaattcagtggccttgttgctcctatttgtttatccgtgagttgtttaatctacgttagccaagcaagagggaatgtagcggaggcctccactctgggcaacaggcaggcaggatgcccctgctgttgatgctgggacaggcgtcagagctggagtgttctggatattagtaatctagattccttagcttctgcaaatactctttgtaaatacccttgtgcagatgttcatcatctctctaggatggtggatgctgtggaggagatgggaataatccaaattgctgcatgaaccagaagaaagaccactcagtaagtgagttcttctccccctggaagcctgggggtaatctgagacttagaggagtcagtgcacgagctccatgtccctggcggtgggggctggaagaggaacctacggtgagtcggtgatggcagactgtggggatggtgatggtgcacgttagccccgggtcctgtaactgagactctctcattcctgcctcccagggattacctgctcctcttgcagcctgcagggggctgggaatgagcttgctggaaggaaaggctgaattggtcctcttgggtgtttgaaaggaggagatactgcatcacctacctgttctctttccccataggtcagcctctcgccatctttattcaaaccagaggagttcacgcccctggatccaacccaggagcccatttttcccccagagttgctggtaggtgatgcctcagggacagatccagccgggtctgtactgtgagtccctggaaacctgctttattttcatacccactgggaactttgtgtctttcttgtcctttatgtttcagcttaaatttcccttccattttctgacactcccctaggttgagtctctgctatgtgtacccacagcccctgcacttcagttcatgtgtgtcacagttacagttattaatttgatgtctgtgttccttgctaaatgacaagccccatgaggatagggactggctctctaggcacactgtgtagtgtagcaggttcactataaccatttgttgatctcctgcctatatctaatacataagcactccaagaaacctattccctctataagcaatccatttatttaaaacaaaacaaaacaaaacaaaaaacgagagctctcttcaaaggacatgatctgcagctcacagctctgtcttaaggaaaccccctcacacccactttatcaccatcactctaatatttatggcaacgaaagaatcaagccactcggagtttttgaagtgcacacttctcagagttttgagctatgaaaactaccttgtagcttcaacaggccagagagaatggctttgcagcaggccaccagcagatctttctctggactgtgaaactttgaaaatactggcagttcgatttgagggcttcgttctcagcccagtgtcttcctgcaagcactaaagccagccttcctaggcatccccttataacaaactccttccttccttccttccttccttccttccttccttccttccttccttccttcctttcttccctccctccctccctccctctctccctccctccctccctctctccctccctccctcccttctcatgccttgtccatggtgccccctggagatattatggggcactgcaaggaatctgggctttcagccaggtctgttggggacccctcatggcaggtgaccttcagcaggtcccataacctccttgaccctcaggatcttctttcactggtgaaaatgaggctcataatgcctccttcatggaagtcttgtaaagactagtcccaatggagttcctgcctctgaacatattacttccccttgcttcttcctgttagatattttcattctgaatgtcagtaaaacatcccattgaggacttaaagcaatttataagaggaatgacagtaggaagagggagacagtgtagtaagaaaactgcatttcccagaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggtaagggccagggaggctgccctggggctgccagggggtctgggggtgtttctaggtcctcttgcccatcctcacctccccctgactttacttgcctctgcaccctatccctctgccccactgactacctggagcccactggaaatccctggacactccagttcctgcaaaggcccctagctgtggagtcccacaggcctggctcagccccttgctggatgtgtgacctcagaaaagttgcttgtcctcatctaccctcattttctgttttttatatggggatactaacaactccttgaaggattgttttgggtgtgaaatgagatccttgcatgtagttgacttctctccacaaacatttacagagcaccgagcatgagccaggtactctggaaggggcttgggatacaaagctcaattggacatggttccttgccttcaagggccttctagtctaagggaggaggaactaatttaagcaaagtgtctaggccagtggctgatggacactagaggttccataaatgtcgcttttgaccccaccaccccactttttctgggggaggatgtgataaggtaaagaagaggagagctccaggtgtgactgtgtttgtgttgcctatgaccatggccacctgccctgtcagtgctaccacctaggacgtgaggcctggaatagttgaacaggctgggagactcagaatatgcacctctcagccccagtgctgtaagagatggggagaggttcccaggtccctgctaatctctgtcgatttctaaacctggcatggcctatttctactttgctggatcccaagcctagtgaggatctaaggaggagaccgtgggacagctgaggacctctgctgtggaggggcatgctctccttctaagcagtcaggtcctggctctggttcctgaaggagctgccaagccctgagttctggttggctcctcagccacagagaggagagcctggcttgggtcagtgctgatggagtcagaatggacgcctccctcgtgcgcacatatacataagatagagtccccaactgtggttttgtgacacactgaggcagcagggtgggctgagacacacctcaagaaatgtgatcttgatggccatggctcaacaggactcatggctcatgtagctcaggtgtagcttgatttaaggtggctgggggaatcttaggaggtccttctttttttttcctcaaagacagggtctcactctgttgcccaggctgaaatacagtggtgcaatgtcaccatagctcacctcaaactcatgggctcatgtggtcccccaccccagcctcaaggggatcatttcacacttgcatgctccctgccatgagccatccaatgtcctgggcccagttggattccaagagaaatgaataacaaagattacctaagttccacaattagaaatgatttctcaagaccatttccttctgcgccactcccttctctcttatacataccccaatagcatagtcacctccagtcaacgcagagtgttgggggaaggcagacaaagagaaaaccttagtaacgtagaacttgctgcttcaatctgtgttctttgtcctggaagctgatattcaaaaggggctggtattcaggtgcttctaggatttctgaagggagctttgaagattctggaatctggggatccacaaagcctagggcccccttcagaaatcctaaacagcacctggggggaagggggggcaaagaggtcacaggtatttcttttttaaccttttccatctatacactgttggcagggctgggagaggtgctgagccaactgggtctaaggaacagaggcacacttgtttaacagaggcttctgactcatttagtcaggaaggccagaaaccacacacagatgtgtggccccgcaaagccagacaacttgaagaactcaggcagatagtgggaactggaggacagatttgaagttttccctcccattttccttttttgttttaatgttaaactttcatgtttttattacgattataccccaacacgaataatcattccagtactgaaatttggttattcttagctgtgtgatttgggcaagaaacttaacttttctgtgcctcagcttcttcatctataaacagaaaaatcgtagtacctcatagggttgttgtgagcattaattaagttaaaatagggaaagtgcttagaagggttcctgacataccttaatttcctgtgttttctaatgtacacaaacacacacacacacacacacacacacacacacacacacacacactagagtgaattcaaactcatttcatttgaattcaggtaggttttttgagagggaaagaaagacctagttttgggctgacagtccaaagactgcatctaatcccacccctggtctactgagtttcctattcccagacacctacagtcaccagagagcatattatgattgtggatatgtcatatatcctgtgtgtaatggtgagaaaagctgctaaggcctgccctggtgatacaacaatgggcctacaacttcagcttcttgtttctctctaggcattgagatgaagttcaagaatatgctgtttcctatgattgtctgcccagcctggatccctgagctgaattcggtagaacatggacccgacggtaagaggaggttcactccaagcttatggaggggctgtgaggctggggataggttacaaggtgggtggcaggtatcagggtggtctccccactggctctggctgccccctgcttctcctggggctcaccttgcacagggaaaggcgggaggagaccccattcattgctgaaacatccatggtagggtgccagtgggcaagaggctgcgggatcttcaatcatttttctcaattctggctacacattagaatcactcatgcgggggtggggaggtggggattgtgcctgagtgcttttaaaaagaatgctaggacttcaccttcagagattctgattttaatgagttgagaactactggtttagaggaaagagcattggttgtaggatcaagaggcccaagcttgagtactggctcttttattagctgtgtggcattggttaggtcactcaaccactctgggccctcatttcctcatccatggaaagctgtgagtcctgattcagccttgctccagttgctggaaagcttcagaggagctgtgcatgaaagcctcttctgaactgtgggaagaattgctgtgattccgaacgtgcgttcccaggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcggtgagtcgctctcagaagcaagcgaggcccgtaggatggagctttcatctgaaagcagggcagccagactctcactgtgtcagtgcagtgggcctcaaactttagcgcttagagttgcctgggaggagcagtgcttgttaaagtgcagattcctgggccccaccctcagagattctgatacatgggtctgggatgtagcccagctcttcaggtgcttctgatgaaggtggtctgtggggcaccctgggaaatgcactccacgactcataggcttcattctgtggttgcagagatgaggcttcctgcctccctcccccttcctgagcttggctgagccaaacagtaggtgaacaagagatatggatatgctagggagaagtcagaattgagaggggaatttcctttcagagctatagggagaaccagagacagagccctcccacagagggaggaatacacctgttgattattcagtcagccttcagacaagtccccacattcccagtttgcaaatggtggcattcgaacaccctatgccaatggaagctcttcacaacagtttatggtgtcggaagaaaagctatctcttccatttttaaattgtttttttaaattaaaacaaaacagcctactcctattcctcccagcccccaccccaagtacctgtcacttctgattatagataaggaaacataaactgtagataaggaaacataaactcaaaaactctgctgagttccctagttctgctaaaatctatttccaggaagaattgtattttcatcgtgcaactgattttcttcctgttttctaataacgagaaccctgtatctgattcttcttacattttttttgccaagttaccaggaagttcagatccaaatagagcaaattgttcaaccttaagtcttcctcctctctttccttgatctttatcttctattttactaagtctatatggcctctgtgataaatcacctcaatcctttcgggaaaaggttgggtgaaatcatcaatcaaacacacacacttaaaggggcttgcctgctaaaattttagagtggggatccaatctcaagtattctgatttcaaattttgcgcatttttcagaatgccgaagttctcactatgctggtattgtgactacagtaggcacaggacctcaggggtttgcctgcagcaggtgtcacctggctggtatgttcaggagcctgctacgtgagcaggggtttcctggggtgggctctcactgcatgctctctgcttgttttagtccgttggagggaacatcatcactgccagccccatctccgacctcaaccccgtgttcatggccagtggggccaagctgacacttgtgtccagaggtgagctgcctgaagcagaggtccaggaagaaggacttgggggagaaaagtctcaccagataggtcattttctggagaaacagagctcaaagttcagtgacccagctttccctgtgatttggatccagggaagcatggagaatgtacctggtttggtggacgggaaagctggatattttctctgtagagaattcacagcaggaactgctacctgcatgccttacctagtggggtactggggctgggatgcactggctcaccacagcctgctgttggatcttcaggaattctgtgaaccatttgtgaaacacagttattaataaaaatcaggccaagtgcggtagtgcggtggcttatgcctgtaatcccagcactttgagaggctgaggcaggaggattacttgaggtcaggagttcaagaccagcctggccaacatggtgaaaccccatgtctactaaaaacactaaaattagctgggtgtggtggtgtgtgcctttagtcccagttccttgagaggctgagtcaagagaatcacttgaacctgggaagcggaggttgcagtgagccgagatctcaccactgcactccagcctgggtgacagagtgagaccctgtctcaaaaaataaaaataaaaataaaattgtataaaattacaatgaaataaattatattcaaaacaaaaggaataaatactcaaaattcatcacttcgtaagtacttcattttgctgttatcagtgctcctggagttatttgcatctgttctgtctgtacggtggaaatgctctacaattatgtgctccagtgcatctctgccttgtcagagggtccccaagaccaccccggctctgatattcactgagaggattcagcatgccgtcatattcctggctatgacttattatagcaggaggatgcaaaatcagcaaagggaaaagatacatgggagcaaagtctggaggaaccaggtccaatcttccagagacttctcccagtggagccacacagtgcatgcttaattcctccagcaataagttgtgacaacacaagtgatgccttgcctaccaggaaagcttgttagaggctcagcgacagaggttttcttgggagctcatcacataggcagcctctactagcatgtgcctaaagtctggactcccagaaggaaagcaggggttcagcataaactattgattgtacagataatttaggcgcagtgagctgctccatcatggagcactgggaacccttctgaagtacaagttcccaagggccagccttgtaagcaacccctacagaggacagcagtccgggttgctgtgctaactctttcctgccttcttcccagcttcacattcagtgatgcaactttggtggcctggaagtatttacaccacagaaattggcaaatgctataaaccagggcttttccccctacacggaactggttgttaaagattcaccagcacaccattgcttaaggatgcttaaggatttcagagagaggatttggccccaattgtgccagtcatttgctctgactgtgggcattggagaccagcatgaagaatcccactgatggttatcctttctccccatggggggttcccagcctttccctcactttggctcctcttcatcttgcttctgtacaggcaccaggagaactgtccagatggaccacaccttcttccctggctacagaaagaccctgctgagcccggaggagatactgctctccatagagatcccctacagcagggaggtgagatgttggaagtggttccaggctctgctcaaataagtcctattgccaggctctagacaaagagatcagaatctgcttcagggaccaacctgagcatctctcaacctttacattgatgatttttctctctgaactttgcctctgttgaaccaaccatactcctttctggacaatgagaagttgcaggataggagtccacatggcatggactgtggaaccagatagctagaaacttggtcctgagtgagccatttcacctttctgagccccaattcccttatctgtaaaatgggcaccatgtcacttactatacgggttattgtgaggactgaaaataaacaattcataaggttcctggtgatgcctagaagccagtggagatgaccagcagctaagaacagaattccaagaacacatctagctgtcgaggattcctgcccatgtcagaggaaatttgctttcccgtggtaaagaatgtggggttcatgtgctgcatgaagaagctgcctgtggctcagaccctcatacgctgaccttaggcttgacgaggtgttgcttcactgacctcgctgtggattggtgcggatggattcctgcttcatgagtggctcttctggcctgttggggcaggtctgggcaccactggctgccttcctctttgttccctgggccctgtgatgtcttgacctggtgtgggtctttcctcccttagcagctaccagctcagaacacatccaaaagggcctgtcagaaaaggcatctgggagaggcttggggagccactgtcagagagagtgtgaaggtttcccacagctggagctttagtgagtgttctaaggcatgttttgcccttggtaattttgacctccttaatgagaatgctaattaaattagagcatttatatccctgaggtggtttcttaatggttttctagcttgtctgtatagaccattttgagcagtgattcccagagttttgaatttcacagttcagtaaactttttttttttaattatgagtgatgaaagtggggaggaaacaggtgtagctctattcagtttttatttgccaggtatggtcattaacaaaacacatccttccatgaaagaaaggagattttaatacccagaattagaaactctcaagaaagggtattgtcagcctgacactgacagttcactgtaccccagcgagaatgtccccgtggatgggcacagtcctgggagtgagcacctgggacctctgttccagaacaaaggtcaaactctgggctcagtgccccagagccacacatgacatgcaagctgagctagctttatcatcaggagcgggctccatggcttcttcagggaaaagtgggtggccatttgggggcctcaactgtgggcctcattgtgctttttccaatagatctcctctccctaaacctgctaattttggtgttcatcagaatttgtggtgccagagtgagtacagacctcaaaaggaacctgacacagaaagggcctgaagtcaggtggctctttcctggaaaatagctcatgctctcctcctatccttaaagaaagatcctggctcgaacccaggaaggaaaatgtgtttaaagcacaagggcagtgattgtttcatagtgtgatagtgatattttctttcttgcttgctttcttgctttgcttgcttgcttgcttccttccttccttccttccttccttccttccttccttccttccttccttcctttctttctttctttctttctttctttctttctttctttctttctttctttcttcctttctttctctttcttctctttttttttgagacagattctcactctgcctgctggcccaggctggagtgtggtggcatgatcacggctcagtgtggcctcaatgtcccaggctcaagtgatcctctcacttcaccctcccaagtagccgagaccacaggtgtgcaccaccacacctggctaatttttttttttttttgtagagatagggcctcactatgttgcctaggctggtcttgaacatttggttttaagtactcctcccacctaggcctctgggattacagacgtgagccactgtgcccgggttctttcaccaagatttctgaacgatgccaacagactggtgggagaggcaggttagagagggcactgtggaggccacaaacagaggatgccaaaggccaaacagcctcagtccccagagaggctgggtgggcactgatagtgggcaccagggtagggaaggtaagggggatgaggggtctctaaggagcctttgtgaaagcacccttcttcccctgcagctgttgttcaatggagaccacccagttctactttgtccctgaccctcagcttttctgactagcagggagaaatcctgttttttttttcagcttctgggaatgttatctggaacctctcctaaacaggtggtaatcagttacatttgatctttgattcccggggccagttcacccactgatgtgtgatggtgttatcccctcacctcacctcatagccctgtggtttgggtctgccatttgcagcccctacagagcaaggtggaaaacaggcaccttcctgatctcttttagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagtaagagctaacagcacaatgaaactgctgctaatgttgctgctactaatagtatcattgttactgctgctgctactatgactaccagtagtattactattgctgctactactaccataactactgctactgctgctactactgctaccacttctacttctactataaccacagttgctactactactattaccgatactactactagtattactactaggagtattgccactgctatgctattaccattgctgctactactattgttactattattgcaactataattaatattatgattgctactactccagctgcttctactaaaattactactgttactcattattgctattactatgactactgttgctactactatcactgcagctatgatcactgctgcaattcctactgtcactattatgattagtattattgctgttattactattactattgctaatactactgctgcctcttctaccgcttactctattagtactactactactattactgctgttatactagtattttactaataacattactgcttctaatattattgctactgaaattactactactactactgttactgctactactactactattactattgctactagtattgctgctgctactattactactaacagtagtattactgctgttattgatgctgctggtgctatgactgctactttttggcattgcttctgttactactattattactactgttgctgttgattctatgacaactgcttctatgactattactacttctactactactatctatcttgttaccactactgcaactattattgctgttgctagtattattactagtagtattgatgctgatgctactactactgctctgttattgctactattgctaccactatggctgtgattagtactactgctactactattactatttctatggttattatataacagaaattgtaccgaacacttcactaacattatcctaggaaatccttacagcacccacataggatcaataaagcttaacttggagtttggttccttggttccgaaattcctggctttgtcatttaccaaatagataacataagtcaagttacttaatctccgtgtgcctcagttttctcattggtaaatgggtgtaggaattttgcttactacattttcaaatttaaattaaaagtgagaattcatataaaacacttaagatgttgcctggcacattgtgaggacttgatagattttaactgttattattttggtggtcttttaaaattgtatctatttttgaagatgaggaaacaggctcaatgagattaattaaagttgcctaaagtcacccaactctaagtatccaagccaaattttgaaccaagctttgtacagctccgaggccctgggcacacagctctacacaaaggggtctggagggctgggcgggagcgctgtcccacgccctgctctctggcaggctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacgtgagtggggcctggccaggcacaggctctctgtagcatgtttggggatataagaagttggtctgggtagtaaatttgctcctctcctctggacatctgagggcagaatagcagggaccagggtcacagcacaagaatcttggaaatgggagtgaccagctggcttagaggcagagtgctgggctgggctttggcgacagaggttcttgccctgtaatctcagctacgtgggaagctgaggcaggagaatcacttgaactcgggaggtggaggttgcagtgagccaagatcatgccattgcactctagcctgggctacaagagcgaaactctgtctcaaaaaaaaaaaaaaaaaaagaaagaaagaaagaaagaaagaaagaaaggaaaaaaagaaagggaatgcagagtgtgatgagtatgtagggtggaatgggaatgtcaggtggggctgcaatagccaggaggccgtggaatccataggatatgtcttcaagagagagtgcaggctgaggtgggcccagctcctgagatttgttcaccaagaatttattttgcacctatcctatgccaggttgcatgaggtgctagggggcagctcagtgtcggggagaacatggacaataaaggccacacttgggagacaactgcagagatggagtgtggagggagcccaaagtggagaggatgtcactgatgcagggacagcagagataaatccttctttaagaaaagaactttaaaaatacaggattggataaagaaaacctaaaattactcttactctcaaatcccagagaaaaccactgccaagtattttggttatttcctctgattttttttcctgcatttatctgtccatctatctgtcatactgtttgtctgccccatctctctctctctctgtttctatctgtccttccatccatctatcaatatctgtcatcttcctatcttttgatgtggatatattattttctaaatagacttgggaccacactgcatatagcgctttaaatccccctttgcttccattgggattatattgtgaacattttccatatcattaaatgcttcccacagaattgaggagggcaaggaaggaggagaaggatattcccaacagagacagcagcaggcataaatgcaagaaggagggaaagagtttggggtgttggagaaagtacagaccattcagtctacagggtccactggggggctagcagtgaagctgaggctgctcttaaattctgagctctcagagcccgtgtttggatgctgagggatccagtcagcactcaaaggcgtatgaagtgaagagacaaggggatcagttatcagtttggtcatttttatggacaagcaaggaaggaatcagtgattgaaatataatcctggtcacctctgttttcttgtctccacagaagtgtggtaaactggaccccactttcgccagtgcaactttactgtttcagaaagaccccccagccgatgtccagctcttccaagtgagtacggtcagtgtatggctaatatcaggggactttgcaggccacatgagttggctagtggctgaccatcggctaatgactaacttgaattgtatataggtccataaaactccttactcttgtgcgtaaatacccagtgaagaaaatgggaatcgtatagatgttaatgtcactatttctcccttgtttgcctaaatttctctctttgggattaaactcttagctgcccctcttccttacagattttttttttttacgtgatggataatgtacaaagccagacgtcttcttgagtatgctaaaacaaacaaacaaacaaacaaacaaacaaacaaaccatctatctgctccagctttttgagaggtgctacgtaaagggtcagcaaacttttcctgaaaacattttagattttgtgggccagatggtttctattgcaacttctcaactctgtcattgtagcacaaaagcagccacaggaaaaacaggaatgaatgagtgtgttgccttccaataaaactttatttacaaaaacaggcagtgggcttgtgttggcccccatgccacaatttactgccccctgcacactagagtgtagtcgtcccaggcatgaactctggaacctgactgcctgaatttgtgtccacactctgccatttcctaattgtgcaaccttgaacaacttacttattcccttgtgtgcctcttaagcaagttaattatacccacctgcaaatgtggataatcacatacctgtttcataagatggttttgaggattaaatgtgttaataaaagtaaattgcttagatggtccctgggatatggtgaaacactcaataaacattagccattgttatgattactttgtaaaacaaaaacagaactttattatgagatcaataatttaaaacattttagaaaatacagaaaagcataaagaagaaaataaaaatcaccaaaaattccacctccgagagcaaattattattatatttttgtttaattcttttcattatttcctatgtgtatatggacatgtatatactatatttatagcatatattatcttttcctacataattgaattattgtcaaacacaaacacaaatgttttgcgtcacgtttttatgcttgcatgaacaatccttctaattaaagttcttcaaaagtatgttttaatggttgcatactattgtgttatatggggctgcataatttatttacccaatccccaattagtggaaatgtaggttcttctttttcttgttgttcttttatataacaacactaggaccacccttgctatcacttatgcaccttcctgttccctttgccccacgcccctctgaattctttattcttaccccttggtgtcctttgccatgtagcatgaagctcaccagtgtcccctgggcccatagaggggcagtgtccttggcagctcaccctgattgatgaccctgtcattccaggaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtgagtgacaccgccaggaggagctggtggaatgctgtgagggggccactgggagtacccaggagacttctctcaccctgctaggccatggagatgcaaagataatgaggtgcctccaggacctcccaggctagagagaggggaagaccttataggcaggtcctattattatctctctgttccagatgaggaaactaaggcacaagcagggtatgttacttgccccaggccacacagttggtaagtggcagagttggaatttgaagccaagcaacgtgagcaactgtgttgtgctgcctcaggatgttcaagccagagagtgtgaacttcacttcctggtgggcgttagacacataccctgctgagcagatcagctaggaaaagcccttccttgggcccactgtgtggactaggaatcaggtttccttgtcattggtcttttctctgctgctgctcctagtttggagacgggatccctccaggaatggtgaaccaggcacagctgaaatctaacagataaataaacttgtccaggtccctgaaaacaaaaaaaaaagtgtttaagttcccatggttggcagctataggatacattctttcccttttgttccttgtcttgagcccatattgacaataccataacccacattgtctacgctcaaaccacctccatccaagcaatgtgtgaatggatggaagaggatgagggggttgacattgttgtaactgcaacagttggggccttcctgggctgcacacacttggaagtgggtttggcaggacagagcttaaccctcctaacttaacctcagttccaataatcccagtcacactgctttctggcttagtgactttggaaaaactacctaacttccttgagtctgagtttccccaaacataaaatgggaattaggataagtactttcagggtttcttgtgaggattaagcatttggaagatggttagaacttcagggcagtttacatacctttccctgaaatgtgttgccctatttccccatgggggcatgtgccagtgtgatgagtacatagttgagactgttatccttgatcatatagtcgggcattctccctttgcggttcgtgttgcctaattatggtaggatgccctgtcatgctgggatagcacaatgaatgtggggagacaaatccagctttatgaagctgttcagggccattggatcagtggcacagccgggctccatgtgctgattttgggagggagttaggtgtgatgtgtgcatgagccagagcgctccagagtaagtgctgttcgttctgatatggcttgcttgtacttggagaccagacagagcatcacgtaacatccaaagaggcctggcctgccttcttcactttatttatttttaaatggagacaggatcttgctatgttgcccaggctggtcttaaactcctgggctcaagtgatcctcccaccttgacctgccaaggtgctgggattataggcatgagccactgtgcctggctggcttattcactttatatccccagcaacattcagcatagtggcctgaacatggtgaggatttaatcaacatttgcagaataggatataattgaattagaatctaatagaaaagaagcagagaatcgaggaattaggatggagccaagccaatcaaaataagaacagggttgtccaaccaggtgatgggtcccctgctccagcttgctgacctggcccctcacaccactcattcttgcaggtccatagatacatcagaagctaagaaggttccagggtttgtttgtttcatttccgctgatgatgttcctgggagtaacataactggaatttgtaatgatgagacagtctttgcgaaggataaggtaagtcttggatttttttatatgaagtaaattgaataagtattgaagttttaatttgtgtacattgctccaaactcctgatctggaaaggttatacatttgcatggattatggccatcatccagttggcccatattcaggacaatccaaaaagatagaatatgttacttgtttatttaattgatggctgctgtttgtacatggcaggatgtctctatgccaaagtggcagtaaaacaacactggtgattgcatttgaactaacaattcggttcttaagggacaacagtaagctctttaattaaaataaaataagaatacatttagtacactaactagaaatcacaataccaccactacgtgaattggtaattcacttacatgaaagtttatctattgatttcaactatgtggaattcttcaacaacaaacaaaatttttcaaatgtttaagacagctgctacaaaagtccttatattttactcataggatagttctcgacagtcattttgtaattccaatagacatccaatgttgcaaattagacatgagtgggtacttctgaagagtgaattcatcttattattgatgtaaaagtgaaggagataacaaaaaactaaaaatatgagaacaaagactccatgaggagagcatttcatagaagaacaaattgctttacatactttaagagcttctcagagcagtgctagcattatggctagtgaaagtcagccagatttaaccaccattgcaataaccaacagccagatttaaccaccattgcactaaccaactgagtcaatagcttatttgggccataagagataattatcagagacatgcatactaattgttggttcctattgtcagaaacttcatcttctaaagtgatgtgttgtacaaaaattttttgttgtttactttttcggggatgttggatgacaattatctctgaaggagatccattaagcttttatgaaactgaattattaaacaaaataaaacaacaatcattatcatataaatttttaaaaatatttttatgggtcatcaagtctaagaaccagtatttgagagctactgcttttgggtattagttgaagtataagacatgatacttaaagtatcatgtcttgtaagtacgtgtcttacaggccttatattgatgcttacagcctttacagcctttgagaagcttttggtataaatctgggaaatagaacataaaagagagtggtgaggtgaaaagaaaataaaactgggggtcagggcctaaggttagtcatgatctgtcaatagtaactagccaaatgtggccttgccttctgagtctccataggaagaccaatggtgttggagtgaatccgaattgacaaatgcacttcctggtgccatatccccctttctgctcatggcaaacaaggaatcaattgccacattctatctggttcagcttctcaatagtctgccagtactaaatactcagaattggcccttgagatgaaatgtgtttgccatcttgatcctagtgatcctcaatcagtaggataaggaaattaagaggccctagggcattcctaaagtgtgctttgattgtgagggcagggacttcttttggctttttgaacaatccaaaaataatttgtttcaccatgagcctggttgcgttctttaacagtctgtctctgctactaggttacttgtgttgggcatatcattggtgctgtggttgctgacaccccggaacacacacagagagctgcccaaggggtgaaaatcacctatgaagaactaccagccattatcacaattgaggtaactgagaatgggctgcctgtgtagaggagtgagctccccgtccctggatgtgcatgtattaggatcccctggaggggatttgagcagcaggtagggatttgactagatgggtttttaaatccctttcaaccctgggatttggggtcccatgaaaccttcccctttatgatcttatgcccagtccactaacaacagccaaactgagttcctccttctcaaaattttacctccatctggtccttgtggtattctttgcttttcctcaaggtccagggttgtccacctacagctgaggaaatggaggaatatgattctctgggctatagtagagcttacttcaagtctgtatgtgaagcatatagagattcatttatggaaagagagagtcaacaattcagagagcttctctttccctaatcagaacctatctttccctccctgctaaaagccacatttctgaaacttctttgtgatcctcaggatgctataaagaacaactccttttatggacctgagctgaagatcgagaaaggggacctaaagaaggggttttccgaagcagataatgttgtgtcaggtagagctgttccatgccgcagtgggaatggggtggccctggtttgcaaattaaattcaagagatatgcattgaaccctgaagcagggaagtgatttctggacatttcctgacagaagattccctcttacgtttgtagcaaaataggagacagttggatgggaaagagcttcagttatcttaatctctactctcctgtctctaggctggacctaatgattctagagagattctagagtattctgatccggaagaccaactagggatgataacagccacatatgcctgacagccttaggtctgccaggcctctaaccgcataaattctcatcctccccctacctgaaggcagtccttacccatcttcaactagcatcctccctcctcttccctttgccctgctctccctccacctctgtctctgacactgtgaaatcaaatccattgctcccaccccaggacaacacagctgactacctcttttggaactgttttttacattggctgttgtgctttgcaaagtcactatgaagccaactctccaacaagcctggtatgaagccgactctccaccaggcctggtagcttaggttcgggaacatgcgctggttttcagtgtttcaatcacatctattaatccctgctttactttttccaaaattttacaatgatggtttttgaaatccttgatttccataagctgcagtgagaagagaactttggactggatgcatttcagtgtcgttctttctttgttgtgggggtggggatgaggctggagcactcagctcccagatagctaagactttgggatccttttccaccccaagtgggaaaccttgaggttacccctcaggtagccattgcttcctgcccagaccacttggcagagtatactctctccttaggcaagctggccccttctgcagcattgggctcactgtgagggatctcactgcttccccaggggagatatacatcggtggccaagagcacttctacctggagactcactgcaccattgctgttccaaaaggcgaggcaggggagatggagctctttgtgtctacacagaacaccatgaagacccaggtagatgccttttgggtcagctcaaggggctgtcagggtagcggggagctcctagcagaccaggagggccatgtgggaaataggaagagggagatgtgggctggtccagagggtactcgagtgtcatagtcctggagccagactctttcaccaacaagctggtatcactgaccttgttccataacctttctcagcctcagttttctcatttataaaatggggcctgggtgggttgtcataattattagatgagttttaatatttagactagagtttggtacatgttggcagttatcatttcagtgcctatggcctcggtcaagtcatatcctgcctcagtttcctcatatgtaaaatgaaggtgttggattaagtcatagccacagggaccactaaattatctacagcagctcaaatattctttgtttctctactgcctgtaatgtgacagcggttgccagtgttttcggcagctggtcctactctcatgatctaccagtcgctggtcacctggtcagacagaataagtttctaaaagtattctgtgaccaactgcttgccctctggttaaaaaccaatgctgaattcagtctggcaggccccagcatcactaaccacaaagctgcatgggattttcaatcaaggaatttcagaattcgcagcagtaattaggtccatgcatgttggacaggctctgccttaggcctgaaataagttcaggtaatgcattcagtgcgaatgttctgtctttcactcacagagctttgttgcaaaaatgttgggggttccagcaaaccggattgtggttcgagtgaagagaatgggaggaggctttggaggcaaggagacccggagcactgtggtgtccacggcagtggccctggctgcatataagtgagttccaaagcctgtttctcccatctggctctgggaagaagaataaggctgtctgtgccaggaaggttttcaggacttccccctgttagaattagtttccccctgctttgaattctcacagccctctgtttttagaacccttgggcatagtgggagggtaacatcgcctgttccgttgtggtctggcacaggtatccacctctgatctctcctactggctgtgagctctctaaatgaaagcacatacctcgcttccttatattctccaccttgtctatcacagtgcctagatggcaaagcagccctgtacaggtctgctcagcgtgcaggtggaaaagatggcttcccggctgtttttattctgagacttgcagggctgagctgctgttgaaggctcacaggcttctaacactgtcggtaacccccaggaccggccgccctgtgcgatgcatgctggaccgtgatgaggacatgctgataactggtggcagacatcccttcctggccagatacaaggttctagatgttggggctgtgctggggcgggatgagccattttgtgaggaaagctgggaccgaatgtccaggcatcctgagctgcactcctactttttgcctatctgtagaagttcaaataagatatagcaagaagagaaattcaaataggctaacagcaacacagaaaggtagtgctgagggaggctggcaccccatctcccaagggtggcattcgtgacttctgtggatttgctgtgttctgagtctggtcaggctcagaaacatgattcaccagcatactcagggtaaaccatcgcgcttggtagcccaacattaacatgatcacaggcctgatgtaaaaattggaatgacagcttagtaatttactgtgagaaataaaacttcccaggggcctggacaggcccaagatgttaggatgggtatgtacttttccagaccatggttggacacggtccacacttctctctgggacagtccctcttctgggtttctgtggatgaccaatgcaccctttccctgtacacatcagcaaagccttatggggctccgcctagctctagaaacctgagagccctctctccatgaattggccttgaacatggcctttgacctattctgagtttgtttcatgatttaactcccagcaagggattatatttctcttagccccaaattcttgtgggcctgaagaggattccttgatcttctggggtcccagtttccgtgtgtgtaaaacagcctgtaaagggtattttaacagtgtacataaggtcaaggatttgcgtgctcctgtgaaatgaaactttttgtgtcttctgaccaaaatctgtgaggagacagtccggtatctttcctagtttctcttccctgcgcttcccccccgccctatcgtgaccagccttctctttccaacctccttactcccctccgagaccagaagccaggtgccggtagcaggaggaagaggtgtggggacaagggcttccaggggtggggagccaagtgtgtgccactggggagaggtcagttcctctcttcttcacttgttaccttctggtgacttctgaaggtcacctttttttcacgggatgatgtggtgttctgtttatttcctccaggtgacataagtgggagggaggatcagagggagacagagaggtgggggaaacgggacttatgataaatccctctcctttctccttttatcaggttggcttcatgaagactgggacagttgtggctcttgaggtggaccacttcagcaatgtggggaacacccaggatctctctcagagtgtgagtaggacctgcagccgcccctgcacccagagctgacttcgaggtcagcctgttcccacgcaggcacaggcctccccagtccctgcttgctactgttgcagtagtctcctaatgggtccccaccttcaggtttcccatcctcgattaatctctatagcacaatgatgatcgtattatttctctggttaaaaacccatccttcctgttcaagataatttgccaagctagcaagttagttacaatgttttatgtatagtgtggtggcattgtgtgtgtgtacatatgcatggaatagtaatatatatatacagtaacatataaactaatactaatatatattactatatatagcatgcgtggaaaagtgtctgaaggaacatataccaaactgttagcagtgatgatcaaattgttaacaacgattggaatggtattgagaggcgtacacactgtcattttctgtgttacacatttctgtgatgttttaattttaaataattcgaattgctttttaaaaaatggtttcattgaagtataatttacataccataaagttaatccatttgaagtatataatttaatggttgttagtaaatttcaagagttgttagaccactgtcacaatccagtgtttgaactcccatcaccccagaatgatgtcttgcatcatttgtagtcattcccattaccattccataggcccaggtcatcattaatctactttccgtcttgtagtcaagtcattttatagaaccatacactatgtagttttttctgtttggtgtctttctctcagaataatgttttgtaggttcatctatgtttttattattattctttcttttgagatagagtctcactctgtcgccaggctggagtgcagtggcacgatcttggctcactgcaacctctgcctccagcttcaagcgattctcctgtctcagcctcccgagtagctgggattacaggcatgcacccctatgcctggctaatttttgtatttttagtagagacagggtttcaccatgttgatgaggctggtctcgaactcctgacttcaagtaatcagccctcctcagcctcccaaagtgctgggattacaggcgtgaaccactgcatccggcccatctatattatagcatgtatcactacgtcactcctgttcattgatgaataatattccatcatagggatataccatatgttgtttcccattcaccacttgatggacatttgtgttgtttccagttttttgcttttatgcataatactgctctgaacactctcatactagccttatgtagacatgtattttgatttctcttgactaaattcctaggaatagaattgctgaatctgtggtgagcttaacattttaagaaatgatcgcattttcatgggcggaggcggcccggcaggcactgggagagctgggctttattattactaatattctacaattgtttaaataaaaggaactttataatgaaacagtttggaatactggctcaagaacctatgtcaagatgagctgaattttagtaaattactttaggaattatgacgagctaattgaattaggcttgtgacaatgaggaatttacatgacaggtaaaactcatattaaaaatgtttagatatttgcttctatagatgtcactttaataaaataccaatttagttttacttgtggcttatctagttagtaagaactttaataggctttactgggacaagcttactgctcttgtaggagctcctctcacaagtagttgtaatgccatagagtgacactcaggatcagtagcttgagatgttatggtttttctcttcatctatgacttgcagagagcctcccctttttggatccagacatcttttctgaatcctggttccactagtacatctgctcccctgtgatcccaaatcatagtcaatggtgcctcgaacatagcaccttcagttaaaggctgcctagtgctctgaggaaagcttgctgattatcttcctgctctactcaccccaaaaggcagaaaagcaacatagtcagtcctgtgctcatttgtaattgtaaagatcagttatatatatatatatatttgtaatgagagcaagtatatactcattataggataaatttaaggagtttaaaatatcccaaagtagaatttctatatctagccttttgtttctttcatgaatatttgcaagcaattaccattaaattcacacatgaaagattaatctgaaagatcagagagaccgtattattcctgaccatgatagaactgcttctgtggtctgggacaagtaacaaagcatctgcttgagttttgtttgtaaaatacactattaatatttgacctacctcaaaacatattgaggatctgtgaaatgctaagtgtccaaaataaaatattgctgattgtctttttattgaaagtaaatttcctcattaagccaacctgccttctgtaagtcatagtgcttaaatctcaggatttttcattaggagagacctgtcattaaggatttgtaggtataattgcttagcctccattattggtgcttgggatagagaggttttagatttttctgttttttgttctgcttcaaagctcagtttattgaagacatttataagctattggatcatcacttgaatcaagattttgactagtgagcttaattgtccatttcttatgatttcaaagttacagtctgagaaatggctgattttaataactgtcctttcataaattaatgttggaataaactgaagctggagataaatacttcatgaaaactggctaaagtctgaaataattacctgttttatgtccaatagctactaaatttgatagaacagttttgagaaacatttcattcttgaaggcaacatctgacatggttctcagcaagttggaatagtaaagattgctgggctgttacgatgagtggaaggagcgtgtttgtagcatacaagttattcagcaatcttgtgctgttgacctaaaaatatgtcttaattcttcatcaaggcaagcctggtgaagtctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaacacagtagtctccccttatctgcaagagatacattccaagactcccagtggatgcctgaaacatcagatagtactgaactccttgttatacagtcatctccccttatctgcaggagatacattccaagaaccctagtggacacctgaaacctcagatagtactgaaccccttgttatacagtcatcttcccttatctgcaggaggagatacattccaagaaccctagtgggtgcctgaaacctcagatagtactgaaccctttatagactatgttttttcaatctgacaaccaaggcgggactaagcggctaaggggcaggtagtacacagtgtggataagcaggacaaagggaagattcacatcccgcacaggacagagcaggagatcatcagatttcatcactcaggacagcttgtgatttattttatttattttttgttttgagatggagtctcactctgtcacccaggctggagtgcagtggtgcagtcttggctcactgcaacctccgcctcctgggttcaagtgattctcctgcctcagcctcccaagtagctgggattacaagtgccctgccccaccacgcccagctaatttttgcatttttagtagagacggggtttcaccaggttggccaggctggtctcgaacttctgacctcgggtgatccacccgcctcatcctcccaaagtgctgggattataggcatgagccaccttgcccggccgacttgtgatttaaaacataaattgtttatttctggaattttccacataatatgtttggaccaaggcttccttggttaacaaactacggaaagtgaaattgcagataaagggggttactgctcctgtgctctaaaactggtgtttgggtgatcaggagcaggtagccaatgggaagagcacatctgagtgataactaaaggagtttctctggtggccttttcacattctccaatgctcaagcatattttccacttaccattttctctttcacctcattttgcctcaccatcccccatccctgcttatttcttaagcccattgatggcactcattaaattgtgtttagggctaatgaatcattgttccttaatatccttttcaatatgccacaatttaggacacatttaaaattttctaaaacaatatcctaatccgaatattgattaatttgagccacattcccaactctaactcagggcacactgccagtcttccccaatatctcctctcaattccccaccacaccttataaaattggaatcaaagaaatctcactctgtcattgtgaatctaagaataaaaacactgattttaatactgctttactagtttcagccttctaagtaggtaggcctctaggtattctgcagatcactggtggtcttgatagccattaatatatgtttgtattatgttattttttaactaaatcacagttggaaaaaaacatctttgatattatgcccttggacctgttactgcatcactggcgcttgtgatgcaataggacacttcgcctgtactaaaagggccaagagtaaatgccttgtttttttttttttggtttttgttttgttttgttaaacatgtctatagagttggcagttaatgctgaatttgtcaaacagcccttccaaaactattcttgtatttaaaaaataaatggatctacctaatttctattgattttttttaaaaaagaaatgatcaaattatattcctgagtgactacaccattttatattccaatcaacaatctttagggattccacatcctcagtaacacttggtattgtctgtctttacccactagaattagtgggtgtgaagtgatagctcattgtgatttcagtttgtgtttcttatatcctgtgaccttgcagaactcatttatgagttctaggatttcttctgtagattccttgggattttctctgcagacaatcattatcatctgcaaatagggatggtttttttcttcctttccaatctgcatgttttcatctccttttctttacatactgagatggctagccagaccttgcagaactataggtcatatatccttcctttgtttttattcttaaggggaagacatccagtctttcaccattaaatatgttattggtagggttttgtttgtttgtttgttttttgtagatactcatgatcagattaagaaagttttcttccattagtgttttctgagcatctttataatgaatgggtgttgaattttgtcaaatgctttttctgcactgactgatatgatcatgtgattttttcttctttagcttgttaatattgtggattgtattcattgatttttttaaacactgaaccaaccactgtccttggaatgaatccagcttggtcatggtataattaatatattgccaaattttatttgctaaaatttgttaaggatttttggatccatattcatgagaaatattgctctgtagttttttcttttaaaattataccatcttggtcagggtttggtgtcaggataacactagcttcataaaatgagttagaattcctcttctaattctagaacagattgtgtagaattggtgttaattcttctttaaatgtttggtagaattttccagtgaaatcgtttggacctggagacttcttttctgatagccttaaaactattgattaaattgcactgtggtctgatagacagtttgttataatttctgttcttttacatttgctgaggagtgctttacttccaactatgtggtcaattttggaataagtgtgatgtggtgctgagaagaatgtacattccgttgatttggggtgaagagttctgtagatgtctattacgtcagcttgatgcagagctgagttcaattcctggatatccttgttaactttctgtctcgttgatctgtcctagagcttaaaagtataatacttgaaaaaaaaagaaacaaacaaaaaaacactattgattaaatttccttaatagttctaggactattcaaattatctatctcatactgaagtggtagttttgtattttgagacattcatttaaaaatgttttgtttttcattattattggtacatagtagttgtatatatttataggatacatatgatgttttgatacaggcatacagtgtatcaggataaacaaatcagggtaacgtcaatatctatcacctcaagaatttatcatttttctgtgttagggaacatttcaattctactcttatttatttttaaatatacgataaattatcatatatttaaaaatattatagtcaccatattgttctactgtatgctagatgttactcattctaactatatttttatatgtattaaccatccccattttatcctctgtccccctaccctccccagcctctggtaaacatcattctactctttatctccatgaattcaatttaattttgtctaagttattaaaaaattcatgtgtgtagaatcgttcatagtgtgttcttatttctcttttgatgtcttcagggtctgtagtgatagcccgtgtttcaatcctgatttggtaatttgtggcttcactttgtttttctgtcttgccagaggtttgtcaattttattgctctttttaaagacccgggtttttgtttcattgattttctctattgtgtttgttttcaatttcactgatttctgctcttatccttattatttcgttcactctgtttgctttggatttattttgcttctctttttctaggttcttgagttgaaagcttaaattaactatctgagaatgttttcctcttttttaatgtattcaatttagtgctgtaaagtttcccctcagcactactttagacaggtcccataagttttggtatgttgtatttcatttttttcttgtatttttggtctgcttgtttatttccctgacaccttctctttgatccctaattatttagaagcatgctgtttggttttcaggtgtttatagatattccagttatctttgtatcctgaggctttctattgatttctagtttcattccgttttagttgaagaacacagtctataggatttcaattctttgaagtatgttgaggttcatatcatggcccaggacatggtctgttttgatacaagttccacgggcacctaagcagaatgtgtattttgctgttgatggctgtgtattagttttctgtggctgttataacaaatcaccacaaattgggtggcttaaaataacgaacatttattttctcacagttctgaggccagaagtctgaaatcaaggtgttggcaggaccgcacatcctctggaagctctagggaaggatccattcctgaccttttgtagtttctggtggctggtggcactccttgacttgtggttgcatcagtccaatctctgtctttgtcttcccatcaccttctcctgtgtgtccattcttgtctacctagacatacttctctcttacagagacatgtgattgcatttaggatccactccaatggttcaggataagctacttctctccagatccttaactttatcacatattttgccatataaggtagtatttacaggttccatgattagaaagtgaatatatctttggggaggcatttctttttcctaccacatgtataatgtgctataaatatccactagatcctgatggtggtgttgagttcttctatacccttcctgattttctgtctattttttgctaccaattttgagagaggagcattgaaatctccaactgtaattgtggagttttctatttctccttttagttctaccagtctttacttcatatctttttcagctcttttatttggggcagacacaattagtattgctgtcttttgggaggattgacacttttatcattatgtaatctccttctctctgtctctggtaattgtatttgctctgaagtctactttatctcatattaataaagccactcttgctttcttttgattaatgtttgcatgttatatctttttccatccttttactttcaacttgcctacattattatatttgaagtgattttcttgaagacagtatgtaattgggtcatgtttgtaaatccattctgctaatctcttttaactgtatttatacaatttatacatcatataatgattgatgtgttgaggcataagactgccactttattttttgttttctgtttgttctatcagcttttcatttctctgtattcttttgtgtgccttgctgtgggtgggttacttggacattttttttaatattccatttttattaaaagtatctcttacatagctttcttagtcattgttcaaggtattatgttatatatacacaacttatcacagcctactgaagttctcattttactagttttggtgaagtatagaaaacttacctccctttatgactctgccctttcccatttatattatttttattttaaatattttctttacattcatttagaaccacatcaagacagtgttttaatttttgtttcaactatcagacaattttaaaaactgagaagaaaagcttactgcttgtacccatgattttgcttatagtgtttttccttccttctaattttccaagcttccttcttttatcattttctttctgtttagaacttcctttagtcattattttattgtgggtctgctggggacacattttcttagttttccatctgagaatgtcttgatttttttccttgttcctgaaggatcactttactgggcattaagttttgagttaacagttcgtttctttcagcacctgaaaaactgccacttcgttctggtctctatggcttctgatgagaaatcctctgtcattctaattaggctccccctataggtaagttgtcatattctctgggtgctttcaagatttttcctttgtctttagttttcagaagtttaattatgataggacttaccatagatttcttcaggcttatcctgttttaagatcaccaagcatcttgaatctgtaggtttacatatcttgaaaccttgggaacttttcagttattattgctttgagtactttcatgctcttctctttttctccttttcttccagatctccaatggcatgagtgttaggtcttttgttatagtcccaaatgtccttgaaactgtaatttttttttcattccatattctcaatatagttcagactggataatatatcttattctattcttcagttcactgattctcttctatgtcccttctcttctgctgttgaatccacccaataagctatttattttggttgttgccttttcaattctgaaaggcccattaggttcttctttgtatcttctatgtctttggtgagactatctgtttatttccagaagctttttatttctgtcaagtgtgttcacaattgatctcagaggcatttttttcatggctgcattaaaactacagtcagataattttaacatctttgtcacctcagtgatggcatctcttggttatcttttattattcaggaagtttgagatcttcctatcacttggtatgacaagtgatttttcactgaaacttggagaaacccgtcattaatgtacagatgatggtggtgatgacgatgttctgagagcttggatctatttaagccttctattttaattggctccttctgaccttgctctagcagtggtggatgccacctcatcactgctaggtagaggtagaaatcttgatcttccacttggcctttgttgatacccaggttaggaacaactccttcttacttctgggcagagatgggagatctacattccacgtgttgtccatggacatcatggtgtgggtggcctctttaccactggcttgtgctaaaagccttgactcttcactagactttttctgacacaaccagaaaggaagggaagagtggtgtgtctttgttatgtgggtggggaagtcaatgtgttctccagtgactccatcataaggtgtaggtacagccttatgactggccatcagcaatgaaagtcttgactcccgatctggtctcctctggcaccatcccagcaggaatgttggggtatctcataacagcctcatgaatgtggaagtctgggctcctactgagcttttgcaggtgtgagtaggaatgagactacgttttctttttctgtgatgtttggctggggtacttattgtctaaaagtgtttagttttgctagactgcccttttcttggtcttttggctagagataaaaggatttggaatatatagtgagctttttggtctctgtcatcattggcatttctggattgccagctcctgccccaagtctgggatatatagatgaggcaaaaaggaaacccctggaactcaccatcatgtcattccttgggttgcaaagtccctactgggactgcctttttttttcctccacttttcagagtattcttacattgttgttgtggttgattttaaataaatatatagaattccagagtttttagtggtacttaatggaagtatggaagtgaaagtctctgtatatacttcaatgttgagtttctcacaagatagaatcctgagtaatgtgtcagtaattatcgtgtgcttttatatttagtctcagttgatgctcctccagtcacattgtaaatgaccagggtaagaccagaagtgggagctacgtactcctcattattgtggtcacagctttgggagatgaacttggaatattgagttgtttagaaaaataactagagggcttggatgaaataaagtcaattgtgagaattaacaaatttattttggtggtaccactttttacagttttttaaatcttaattttgtaaccatagtagttacgtatgtatagattcttgtttgaaaaaaaaaaaaaaagaggtggctgggtgcggtggctcatgcttataatcccagtactttgggaggccgagatagacagatcacttgaggtcaggagttcaagaccagcctggccaacatggcaaaagcctgtctctttgaaaaaaaaaaaaaaaggttaaagttttcaggaaaagccgacattcccctttacccttttggatcacactcctctctgctaggggctgcctaattggctcagttaggaaacttcacacttcagatctagggttaaaattgttcaaaaaaagaattattcttatttcttgttctcttcaagtataagacatgctttctggtatgggaaaaaatcacgttgaaaaacatacagtctttgtccctagacatcctacaagattttcaattcaatccagcaaatatattaagtgcctagggtggctacataaggaaggctatgacattgtttctgccctcaagaaattcacaatatggcaggggaagtagatgataaaagaaacagaaatacaagttgataaagtactagggaaagcaaaagtagaattaattgagacatagaaaaatcatttaggatgagtaagactgaaattatcaaagacacataaagcaacttgtgggagagagagagtacccatagggaaataaaccaaaaccaaaataaaacaaacaacaaaaaaagaaagctgccattgatctttccagagagatgagatattacaacttaaagaaggaacagaatgttactaaaatggagcagtcaaagaataaaaatgagctctcatgacttgacactatgaaagcagaggggttcaaagaaacttgacaaatctcccaaaaatggaaaacaatgtgaaaaaatagagaaaatacaaaaaaattttgaggatcagttcaagaggtccaaatcatagacatttcagaaagaaagaatggaaaaaacagagaaggggaagctatcaataattcaaaaaattttccaaaactgatgggcatacactttgggattaaaacagcccatataataaccagcacaatgaaagaaaatagacctatgccaggttataatgttatgaaatttagaaacctgaggacaaagagaagatttcacaattttcaggaagaaaaaacagaactctccaagaattggaaaggcattgattggacttctcaatagcaggaagctagaatgtactagtaaaatgccttcacattgctgagaaaaactggaaagcctacttccaaattaggattctatatacagctgaatcattaattaaaggtgaaagtagaataaagacatttcagacatgcaaggtgtcaaagatgttcctctttgtgtaccctttcttatgaagatattaaaggatgtactccaacaaaatgagggagtaaaatttaaaaagggaaaggcatggaatctaggaacaggggattcaatatggagagaggtgaagggaatccctgggatgaatccctttacccctttggatcccactgggggatttaagatttaaatccttaggtaacagctgaatagcagatctagtgggcagcgaatttaaattggagtaggccagatggctctaggatagaaaatctgatgtgcttgaacatgttggaagcagagctcaggagggaaaagagaaaatatattaggagcagatttttagaattggggaaaactttaagttggcttagtaataagtacatacaaaatgaagcagatgaaaaaataaagacaattattaactccagggtgaaaaaaatattatcaagagagaagaaattgtaatgtaactacatggttcagctgtaagtaatgtttacagagttataatattaaattgactgttgatctgatcaaaatacaactatactgggaaataggaagctggtaggggtgagggctggagggagggggctaagccaaaactaaattctccttttccataaaagaaagacaacctaaaagtctaaaactgaaaaagtcaagacatagcaatgtagccacattatctagagacgtataagtttatctaaatagctgatagatgataagctatgagaattgtaagtagttgcttctggagactagaaggaaggaaagtggaagaggctactgtttttcataccatgacttacagaagtatgggacacttcaaactatttgcagtacaactttcatggctgtttcatagttttcattaactaatttacaatgaatttttaaaagttaactgttttcaaaaagaggcaagtgattagttccaactagaggctctggaatgaatttctccacagagttgctgaatgaggggactagtgggtggataaggtgcagtaaagatgctgccgcaggctgggctcatgcctgtaatcccagcactttgggaggccaaggcgggcggatcacgaggtcaggagatcgagaccttccaggccaacatggtgaaaccccatctctactaaaaatacaaaaattagctgggcgtgtggtgcgtgcctgtaatcccagctactcaggaggctgaggcaggagaattgcttgaaccagggagtaggagtttgcagtgagccaagatcgctccactgcactccagcctggtgacagagcgagactccatctcaaaaaaaaaaaaaaaaaaaaaaaaaagatgctgctgcaatatcctgggggagaaataacttgggtgcagaggggaaaggcaggcaatggatacagccctcaaagttcctactttgaggaaccaatgcaatcagtacactgttctctcccatttttgtttcctctgcttcagattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtaagctgagaatttggtagcacaagtcagagtgctttagactacttcgggggacagcggctttgtatcttgggcatctcccatgggggcagatgacaggcaggggctgctgagggggttggaagcttaactttaggttgtgccctgcccccacagtctcttgccgccaacaaggcctctgtgtctctctccttgggaaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaagtaagcactaggagtagaagtccagttgctcttctgggtttcatatcctacagcctttctgctgaccccatataggaagctaataattcaatggataacttatgagactgctgagtttgccaactcattcacagccatctctttaagatcttataatgatcttcagcccggggcaggtgggctcacagcctgcaatcggtgtcatagcctgtcagttgtggttcatctttacgcgtttgtaaacctttgggcacaccgtatgataaagaacactggcctaggactaacacgtcacagttatgcacctgcctctgacactgatctataaatatgaatttgggagtccctgggcctcagtttcatcatgtgaaaagtgggcataattgggctggctctgtcttcctcacagagttactcagataattaaatataaagcacagagaaggctttattattgtcagtgaggcacagtgcctcctggagatgatgacagcccaagattaccagggcactctgacccagtacgggttgcactcagggaagaagagtgttgacaagaccccctggtgtgggctgtgcaccagctgactgttctcatctttgtgggcaaccccaaggatgtcctgttttgatgtgaacatccaaagatattcatgtcctcaatatgatagcgaaggttctataagaatattcctttttctctagggagaattgttggaaaaagagaggattgtgcataattcccaccaagtttggaataagctttacagttccttttctgaatcaggtaattgctttatagaattgtgtccatctccgctggactgggaccccatttccctgttgtttacagtattgcaagggaaatttcgttgtcactggtaacagggcttactggaggaactctttgctctttaaatgaaagtcgaacttgcacagtcctatttgtccagtaggtcatgggcagtgagactcagagatctgggatcaacctctagttcttacctttccttaactatcggactggagagagctactctatttttcttgttctgtttcttcacttacagagtgaggacagatatttgacctatttccctttgagaacaagagaaacagagagaaacatatgaaaaccttctgcaaactactgaagtgctatataattaaatcatgagattcatactgccataatttttgtctgaggtttacatccaaaatgctgctggttctcttgttcctgggctccatacctttggtcccaaaccttaatgagttggattttactgaattttgtgtctggcatccttctctttccctaggcaggagccctacttcatgtgtacacagatggctctgtgctgctgacccacggggggactgagatgggccaaggccttcataccaaaatggtccaggtgagcagccctctctggcagtgttgtgtccgttgttagaggaagtggtataagaaattgagcagtgggacctatcagagcagaagcaggcccggggtctggccctggccctgttgcttatgtccgtgtagcctcgggcaagtcttttcccccacttgaactcagtttcctcatctgtgcaaaggagttggccaggtgacctctgaggacattgctattaccaacattctcagtgtgtgaggcgggcatgctctgtgtgtaaaggtcgcgagtttcccacattccaagactcctcggagtggagtgaggacaatgagctggattagagtcagcacatctgcttggcgcatggagactggccagattggatcttttgaaaagtgagtgttagtgtaaaaaggcactgtttgtcagtttatgaattttttatccaaccgaactccaccaagtgctccttcaaattcagccagatgtaaggacatcccagacaatgagattagagtttacgaaattgttttcttgcctgtaacagtgaatgtgaatcctgtcttggggagaaggcagccaagccccatgataaccccttccctagagggcaatgtcttctcttttcgcaggtggccagtagagctctgaaaatccccacctctaagatttatatcagcgagacaagcactaacactgtgcccaacacctctcccacggctgcctctgtcagcgctgacctcaatggacaggccgtctatgtaaggagcccatgggatcccgcagagcagagggccagcccagagctgtgggcctggagagtctccctgggtgggagctagaagggttccttgcaggctctttggctctggccaggcctctggctcccttatccaggaggatgctgtttctccaaacctcaagctaaaagagaggcccaagaatcataatcactgccctcaaagctgggaaggatgagtgcaggatggggagatgaggataccgagggaaagcagaggcttctggaattactccctggtgctggagctagcaataggacaatgggctgaagctgaaatttgattatagaggcaggttggccacactggctcctctgccatatgggggatataatcaaacaagcagtttgagggaagaagacacctctctggggatccctcaaacatttcgccctctgtcagcctaagaattgagtcaggaagtgctctccaagcagggactagtggtggccctattggccaggtcctgtcgattctaccctgggccttgatcattctggagtgggtggccaggctgtttgagtggcaccctgggtacagcattgcttggaggtagccttgctggggccctcgggttttgcctgggctacagaatgcagaggactgatgtgtctggggtgtggggggtgtttactttaggcggcttgtcagaccatcttgaaaaggctggaaccctacaagaagaagaatcccagtggctcctgggaagactgggtaagtctgagctgatccaagtcacgtttgcaaaggagagggaaattgacagcagggcctccgttccgaatccgaacaagtaataggagacaatattttagtcagaacagcagagagaagttgaggtggtttgtgtgattttacaggatgaataaatgctcattctggctgggtccctttctctatagctttcatcattgagggaggtcatttgagggaagtttttgatccaggatcttgacagccttgtgggaatcagggttttctttgcctgagcctgagaggatgggtgcctgctgaacatgcctcatcggattgtcttgactcagtgggtctgctcccacaccccgcttgtcccagatgagcctggttttcctcaaatctccatctcttgagtctgagtctactgagattccctctgtgacagcgtggggagaaaacatcacccaaggacttctatcattcctgtgatttggggaatgacagaacaagcacttatgataagaatgagcccaattctctgacttctagaccagtggcctgaatgtcagaaatctcagagggaaggggcaagggagtctcttgcaggcgggaggctgtggctcctccagcaagtggaaatattaatggcagctctgcatccttccccagtattggagtggtagaactgggcagaagagtaacacatcaaatgtgactgcacataaaccggctcactagaaatcttcctcaatagatttaaagaaaacatgccatttttctcagacccactcatcttactatgccttctatgacctctccataccacgtgtaccaatagcacatgaaagtagcctgattttggtagttgggttttagcatggatttatcaggcagtttaaatgtttttaacaacagtcccgacaacaatgttctatcatctgacctgtggatctgagctttgtcttcaaccaccagccatgtagaccagtgtgcctgggaaacagataaccccaataaatgaaccacagtcaccaacacatacatacacatgcgcatgtgcacgcacacacaaacgcacacaagcatgcgtgcacacacacacatgcacacgcacattatgttaaatgactagtgcaggttttaggaccaagtctttccaagccttagtttcctcatctgtaaaatgaggctaataatagtataggttttctggggttgtgagtataagtaagataatgtatgcaaagtgctaaatagcgcgtgtgacacagtaaatcgtttggtggctgctaatgaagaaggcataaattatatcaagtacaacttaaatctgagtctgtgctagtgtttggggataccaaaaaagcacattatatagtccaagggataggatggagggatagtttgatcaacaggaaagcatatgtaaaagcacaaggtgaacatgtgaagtaccacatgagcgctatagcgtgttgcttttataatggccagttagggagagttcaccaaggaggggagaatggagggcaagtttgagtagttgttgagggaagaaaaggatttgcacatatatagaagaggaaccacataaataaaggtgcagaggtgtgggagatggaagaattgagagagatttagctcttgagtgtggctggggtggccctcgtgtgctgcaaaatgccagagagactgtggtccttaacatcaggcatttgctctataggcaataaggagccgtggaaagctctagagtagggtagtgacatgcacagtgtggtatgttaagatggccactctggctgggctggggagacaactcaagggaggaagaccagttaagaggtgactacagtgttccaggcttcagataatgaggacctggtgcaggtggtgccagtgacaatgtgaggtaaggtatggaaatgggagtcactagtaaaatgagttgattggcttccagaggaggtgagctcctgaaagcttagtggcaggtcagggttcctgaaaacctcacttcacctgcctgatggccatctcctctcctcaggtcacagctgcctacatggacacagtgagcttgtctgccactgggttttataggtaagtatggtgttgtccttgcccagctcatagtgtgatgtcgtcctaacctcactggtccactccagcaccgaatcctgccaggctgtggtcaggagagagcagctccacttatctcttcaacagacttccgctaatttcagtctaaagatgctctaaaatatgtggaatggccacactgtgtgccaaggggtaaaagcaccagctgtgtgtcagaagacccgacttctagttctggtctcagggtgcaccatttcaccagaggaagtcagtggtcctgctgaacctgttcccctgtttcctcattggtgacgtattggggccagtacctaaccattcctccctcagtgttctcctgcagaaaccaggctgtgtagtgttatgagttaggcattgctgttagctatgcatccttctttgtactgtgtgtgggacttttttatagaatgagaggaggatttagagcacgtggtcttattacaaaatgcagaatacagtggaaccttattaatacagggagattttcaagagagcgtatgacttctgcaactttaaatttagtagcagcgtgaatagctagagaccctgcccatctgacttagcagctgtaaaaagatatgatcatatttactgtcagtcatcatattttagccgtctctgggaagtttagctaggaccttttctttcacagatatttggaatattttctttcaatatatttggaaaataattcaatgtttctttaaaatatcatgtctgaatgtatgaatatatagatgcataaatatatatatgtataaacatttctttgtatgaaacatttattttccgtatgtatatgaatatatatatgaacatatatatatgttaggcatatatatgtttatacatataaggcataaacatatatacacacaaaaaacatttatatgccctatatatgaacatatatatggctaatatatatgtatagatattacactgaatatatatgccttatacatatatgtataaggcatatatctgtataaacatatgtacacacacaaaacatttctatgccatatatatgaacatacatatggctaatatatgtatagatattacactgaatatatatatgccttatataaggcatatatatatgccttatacatatatgtatgctttatatacatatatataagtatataaggcatatatatgtattatacatatatgtataaggcatatatgtataaacatatatacacaaaaaaacatttctatgccatatatgaacatatatgtggctcatatatatgtatagatattacattgaatatatatgtataaggcatatatatgtataaacatgcatatatatatatatatatatatatatatatatatatatggtgaagaaatgttttgccaatgctttctaggtttttaatatctgacctacacatacataaacacattttctcataaattcctattacatttctggagttcatgaaactaaggttttataaaggtcaaagcagaggagcatggtgaaagcagaggtcaaaggaattggtggtggttttttctgggagaagccttttccctcagccccatattggttttgtttttgtgcagatctggtcatatcagctcatgttattcctgtgtagtgtatagaataacacagagtcagtgtactgtaaactctaggtgtgtgaatacacatgcacaaatgcatagatatacacatatatttatatgactcaggcaaaagtggaattgtataaggtactccagattgaaaattttaaaaatgtataagggagcatttgtttctattcgtatcatttccctcaaatcatttgttgaactttcaaagggaccagcaggtggggagtggccgcttaaagatgcacccaggttagcatgagatgctgatcttattaactttcaccttgagaaggtaagcaggagaacttgtgtgaacagtctaagagccaccacaggcagaaccttcagtcctgaagaccttggattctaattcagtacatcctttggagtgtgactttcatgtccttcgtgagcccagatggatctgttacctctctttctactgtgcagaggctagcatggtactaaacactgctaggctgtacagaatgagtacagaagggctactggcaaaatagaggagggcccagagacaaaatgttctggaatatctgggtttcgttaacaggttcaaattgttcaaaccatggacttttttggagaacagctgaatgcaaaaacttgtggggtttaaagatgttgtgggtcaagctgtacgtgcatagggaagggggtgtgttcatgttaatacatgtgcagtaccttctctttcctctcccagaacacccaatctgggctacagctttgagactaactcagggaaccccttccactacttcagctatggggtggcttgctctgaagtagaaatcgactgcctaacaggagatcataaggtaagaagtttgcaaaactttagtacttagtgggaaagagaagagaaacaactgagttgtaatacctagagctgatagagacaagatttctggttggaaaaataatgccttccattaaggataggcaaacatcctataaagggccacagagtaagtgttttagacttcgtgggccatacagtctctgcctcagctactgaactctaccattgaagtgtgacagcagtcatagacagcttgtaaacagataagtgtgactctgttccaataaaatatgatttatagacactgaaatttgaatttgaattgaatctcatacaatttttacttgtcacaaaatattcttctttttatttttccagttatttaataatgtaattattagcctacaggccccacgaaaacaggggcaagttggatttagcccatggaacgtagtatattgactcttttgtacatgatctacccagactcagattcaaagccccaggtttctgggaccctatctgactactcacgtatgaatgtgtgttattcccagttactgagagatcattgctgctccccacttcctacccggctgctacaaactcagactccagcggggatggtggcagcagagatttggtgggaacatcaacacttctgcctgagcacacccagggctttctgcttgggaacgtactctttggttggcacttgtagtctgagggtcactatgagtcatctgtcatattccaaacatcttttcctcctctaacttcttgtaattttgctgtctactctagaacctccgcacagatattgtcatggatgttggctccagtctaaaccctgccattgatattggacaggtgaggctcagtgggaccagggtggtgacagacttggccaccgatgcaccccattcccctcctggggccacctgccacaacatgttgtccaaggttgtcttcaaacaggctgaaacatggaacctagggagtttcccccaaagtagaatttagattggtgatagtccaaccaaccctcaaggcagaaagcaaattaatatgggtcaacttgggaagggcactcacaactcaaaaacaagatgagaaatgaggaaacatggcatgcacatgtgaacatgcacacacacccaatttgagtgtgagcacaacgtagaatggggattgagtttgggatcaatgcccagacagtggggtctgaggtcagaagagttttctgtcttctcattcctcctccacccaggacagcttttgtaccccaggaagcagatgctgccaaacatggagtggtggaaggccctgggagcaaaacacaaaggcttaagcagaagtagtaaagggaggtcccagagaaaatcgctttaggagaatatgggattactatgaagaataggtgaaatagggctgggacctgtggctcacacctgtaatcccagcactctgggaggccgaggcaggcagatcacctgagatcaggagttcgagaccagcttggacaacatggcgaaactccgtctctattaaaaatacaaaaattagctgggtgtggtggcatgcacctgtaatcccagctactcaggaggctgaggtaggagaattgcttgaacctgggaggtggagtttgcagggagccaagatcgcaccactgtactccagcctgggcgatagagcaagactcagtctcaaaaaaataaataaaataaaataaagaataggtgagataggaaaaaacagaggaggaatcaagaattcaagactgagcatctggtagaaaatacaaattgtacttctaaaaaatggacaactactgagtatacgaaaatctggccattagtcaatctgttcattaattcattgaacaaccatttatggtcccctactgtggccaggcaccaagccagtactgcagacccaaagatgattgccagtcggtttcttttctgaatgctcgttgaggtatggtagtgccccatgtcacgcttctgagcagggggctgagagagcagatgtgtgggcctgtctagcatggcagttaccctaggagagacctgtaagctgaactgcagtgggggcactttctcccagaggacaggcaggggtgggcgttcaaaaaggctggaggtaagtctcaaagaatctactatcgaataaatcctcctgtgagcttgcttcttagctttggctcaccatttccccagtagcaacatggaaggaacatctccatctgcactgcggcaggttgtagtgggaaacatgcccacctagaatcactgaccttccgtgttaatgtctttgctctgcctgagccaaagcctggcagaagtccggatgggttatcccagggctgaggcgggagccaggtaagcaatagagggcagttttagctacattccaggccgcgctgcagttggcgctttgtgtccattgtggcaagtggtatctgtcctcagggaagaaggtggcaggctaactgtgctctccatccatcctgcaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggtaccattgctctggctctgtgctgtctcttctgatctgccctgggggaggccccagcgggtgatgagaggcctcagtgacccacctggtgggacttcaaagggcatatcttgaggagggaagatggtttgacactgaccttggtaggggcagtgggatagttgggcagtcctgcttgagaaccagttaaattgggttgaggagagcaccttagtatggtctgaagcccacttctttgggtgaatttagagggattccttcatcaaatcttctcatttaaatcctggcccacacccatatctcaggcgtacgtcactggtgcttgatcctaagagatgattttacaggtacagcattagtatggtccaatgacaatcagcacattcactgccaatgggatagcacctttgtacacacccttttacctccttcagttgccaatactcgaccttaagacttgatcaggctgggtgcggtggctcatgcctgtaatcctagcactttgggaggcctaggtgggtggattgcctgagctcagaagttcgagaccagcctgggcaacatggcaaaaccccatctctactaaaaataaaaaaaattagctgggcatggtgggacacgcctgtaatcccagctactcaggaggcttaggcacgagaatcttttgaacctgggaggcagaggctgcagtgagccgtgactggaccattgcaccccagcctgggcgacagagcgagactctgtctcaaaaaaaaaaaaaaaaaaaaaaaaaaagacttggtcagatgcctggaggattgtgtcttctatttcttccttatctgcagtaagtatgaaaaaatggttgaaaattgatttagctgatgcatataatcctagtttgaagaaggaaggcaactaatccttggtaaccaaagaaacatccatttgctcatctcgtggtttactttaccatagtgggtggggaagctgggacatattgtgacccttgccattgactgtcatactttaccatgcttgggaattactgaggcccatgataaaaatgtgcctttctggggcccacgcctagaaattttgctccaataggtgtggcttagggccctggaacatgcattttcagcaagtatctttagtgattctgatataggtggtctctgatctatactttgagggggagaaaaaccaacctatgctagaaaatgttttaattcctgtttgttcttatgcctataattcctgcggatgctgtaatatgactatggtgcctgtaaatgttggtgtcagagttgcaggtagactcttcccctcggctagtgactgaggaaaaggttaaaactcacgtcagattttgtggtctgtaaaatacaattaccgagtataactttaaatggtacattatatgtgcatgatgtcatcagagaaaattacatgagtgttcaaagaaatatgtccatgcggtccagtcatgtactagcttgattgttcttagcccctgatcatttctgactgtgccttcctgctgtatttggtgtggctcccatcagtgctttcctggtgccaccagccctcctcgtgcagagtttgctgcctggcctcctaggtccacttgatgatgtggaggcaggaccacctgcctgagcccctgccctgtgccctgtctgtgttcaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctggtatgatgcccctcaagcatccactcagtccaggggaggccagggataggctggcaaactgcagggaaggttctgcacagaggagaggtgttgggctctctcctaaccgggcagccttgcatcaatggccacccttcattgtgcatggtatgaagcacacactcgaacttgcaagagaataatgagaaacctccttaaagctatagcttgtagctgggcctccttagagatgggaggaatgtgtggtgcacagtcataactcacagattttattattttccatctagataaggatgatggatgaaactccagagagcctaatctttagtatgagtcagtcgctagcatttttttttttaatttatgttaaggacactgtatgaatattggggggatggagggaaaaagaggaaataattaattagatcaaccacatttgtcctgtgatgatcatgtgccattctgatactggggacacatagatgtccttgaggactttgcaaccttgggaaaccagatgattccattatagggtgattgattactgccttggaggtgtatgtggcagaaagtagtagaagaattccgtagtcattggaatcactttaagaagcacctatgtgatacttgtagttggcaatgcctaacaaaagaagactttgctaggacggttgcttccgctttggggatctcagaaccagcccagcctctgagtggtgctgaagtgggctctgtacagtggctttaattgcctttgcaactgcaacctgtgtggagttagcaggactgggttcttcctgatactcaggtggggcttcctcttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagactggggtttcaccgttttagccgggatggtctcgatctcctgacctcgtgatccgcccgcctcggcctcccaaagtgctgggattacaggcgtgagccaccgcgcccggccggggcttcctctttttaaaattcgatatgctttttggatttataggtaaagtgggtacatgtggtcccaagtggggagggcacagaggaaccccaggggcagacaaatccaccatccgcagacctcaacacagtgggtgaaggaggcatatgggtccccattcaggtcttccttgggtctaccaagagctttagctatggagtgagaactacacagaccgtgtggcactcccaggcagtaaagatgcccacatctgtgcagcaacctacccacagcccagaaccttcccactatggctcccaatgctgacaatcacccaaacccatttccctgagaggagtgggtggcatggctcccaataagctgccacagtttgcaaggcgagctctttgccaacagtctgatgcagaactcagtcattttcgtaagctctctgtggccccagacctgaaacaaagatccgtttctatgttacaacataccagcgatttaaaaattcttgccatggatttgcatgagcagctgattctatgaactttttaaggactgtgagtttcaaaagggatcacatctgtattgtttgtcaccatatctccaaaacctaatagaacgcctgccatgtggaaagtgctcagtgaaaataaatgaatggcttaggaaattaaggagtcctgccctgaggcattctcaacagctaggcctgcagagtggtgcttggccttggaatgatggttggcagtggtgggaggtgaggtatgcaagagagtgggaggagcatgatcagcagaccctggcaatgagaacactatcattccttcctagtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctggttggcgtgtgaaaaatgcttattaattatcatcacaccaaatgctagtatcttcagtatcttggccagccttcatttcttgaaaaacacacacacacacacacacacactttcttacaaaaatccctctccagagtatcctagatatgctggctgttgtacagcatggtcaaggtagaagagctttaaaaactaaacgagtgtttacactgagatccaggtccatttcagatgattttctgggatgttctgggacagggcctgagacctgtcacttgtttttagtgaagctcttggggtgaagcagtgacacagaattcccttgtgtgcttaggtaccaaggtgagagtagagtggtcatgaaaatccaacaagaaagtgctttgtgaactagaaatcactgtgctattcagaggcatcgtccgtctgagacaccttgccttgccctgttgtcttaaagtgcttccagtctatacagtgagatgtcttggtcttttttggtgttgcacaaggaatgcagtcaacactgcctgcggtatcgcctggaacctgcagagggcagtagaagattgaacaaggggcaatattgtccaggtggcccagcagcatcgcatttgttaaccattaggtactgatttaggtaggatctctgcatagaccagatgtcctcggaggcttccccaagagctgaattc

SEQ ID NO: 13611 - DNA, 96074 bp, Human; identical to SEQ ID NO: 12760

SEQ ID NO: 13612 - DNA, 9729 bp, Human
tcgaactcctgacctcaggtgatctgcccgcctcagcctcccaaagttctgggattacaggcgtgagccactgctcctggcaccgtttattttgctttctttatcagagcaggagaaagtactagctcaggaattgggagataggatccaatttccagctatttcctgttccagtacacttaactaagagtgcctcaggtgtacttaactaagagtgcctcagtatacactgcctatactgtattccaagaggcacaaaagactcactaattttccttattgctagcaatcccagtatccctattaagtaaaactgaaagctattataacatttattgactgctgactacatgttgagcactgtcatataagcaccttatatgttgtcacggatgctgtgcggtgccacccagatcccgtcttggggactgtgatcatcatttcccagggtgttagtctctctccaggaattgctcttgacaaagggcactgccttaagattaggctgtcttcttgggcagctgtatgcaatgaatggtctttatggggttaccagggccttgtcctcttgcttcagtggacagttccaaagggccagctgagcttccgggcattccttggaaccagctggggtctctgttgaaatggcatggccttcaactcctccctctgcccagacctgctttctttactccctcttaattctgataactctccccagtaaacctcctgcatgcaagtgtctacccgagtctagttcctaggaactcaaactaagaattaatttatttagttctcacaaccaccttatgaaataagttgttctcttcgtagagacaaggaaatggaggcatagaaaggttaagcagtttgcctcgtctcccatcagtagccagttaacagtgaacgtggccttcctgcagctgggtcttcagcaggtcacctggcagagccatgacttgaaacctgaaaatctaactctagaccctgtacttttaacctcacatacagcctcttaatagcaatcccaatgcctttatgggaagatgaggtgagaggaagggcatttattacctttatgtcagagatggagacaataaggtattaactgcttaaacccaggatcgtccacaggtatagccgtgaccgggtactaacctttgtgtgtgtgtgtggtgtgtgtgtgtgtgtgtgtgtgtgtgtgtgcaatggaaaaagaatggcaaattcacatttgaattttggagccaacacttactagctgcacatctttgagcaagttatttaataactaagactttgagcaagtcttacttatgtgcctagcacatagtaggtgttcaataaactactcatccctattccacttttctgtcatctccaactgtgatcttggacaagtttatttagctttctgattctcgatttcttcatctataaaatggagatgatgatgaagagcttacttagccccgtgtccatcatggtaagagcctcgtaaagggtacttatcagtataatcagatgctgttttgcccaggtttgcaccctgtgcgcctgtcctcaggacccagcaggctcagacttgcctgcgatcaaagaaagccctgtgtgcctcccagacccaccacccccgtgcaaactctctcaacacgacaccgctgcgtgactttcctgctgttactagaggtcggcaggtacttttccctaggaaactgggtgtgcacgtctcatccccgtgccaattctcttgccgcttttccttccacacgcggcgtcctctgggcggagggtgcagctccgcgtgctccagctgccgcgaaagttgcacccggcccagtctggctgcgggccccgcctccgccttctcagcgcccagccccaccctccgattggtcagcagtgcccagccccgccccgctcctccgaggggatttaaagcagcggccgctcagtctgggcgcttgcaggctgctaaacccaaccgcagttgactagcacctgctaccgcgcctttgcttcctggcgcacgcggagcctcctggagcctgccaccatcctgcctactacgtgctgccctgcgcccgcagccatgtgccgcaccctggccgccttccccaccacctgcctggagaggtaaggggaggttgtccaactgcttgggggaagtcccaccaactcttagggagtggagcggcaggcctggggacctgggtgggcgcggggatggggcgctagaggcttgagtagagaggtagaggcgcacttgatgccacgtgctcagattccaggagcagggagaaagcaaggggaagggaagcaagggcccgcggcttgctgccatccccatcctctgacaaactgcagtcgtgctcaggtgacctgctgaagacccggctgcgggaaggccacgttgacatttccaggcagcactgagcctgcccatttcttaagcatttgtttttcattcctcagaccagagctaggggcattgcctcctctgcccctggaagacagggagatttttttttttttggtggggtgtgtgggggtgggggctcccactgttgagggtgtgtccatattccagagagctactcaacagcttccaatccttactggctgggaaggaaaaagtaaagatgaaggcaggaatcagtttcccacacagttcagaaatacttctgaaaagaatgctgagttcttttctgaatcaacaggcacgaagagagatcagtgtgactttagggaaaagcccatatatgcagcgtgtgtattacccagaaagtgtaagacctaccacagcatagctcaaacattgcttttgttgctttggggttgatgatgctgataagagaagcactcttggcctggggacagccaagagtttccaggaactcttgaggctaaagtttgggtggcaccacccagagctcttctgggacccataaacctctccacactggctgagcaaatgagagaatgctttcatgttcctgatttgtttttcagagccaaagagttcaagacacgtctggggatctttcttcacaaatcagagctgggctgcgatactgggagtactggcaagttcgagtggggcagtaaacacagcaaagagaagtaagtgttgctgaccagctcagggctccgagagggaagggagtgggaagggagtcatgaggagggaaatacagggagaagccaggacacgctaagtggaccttggcaacacctccctagagattttagtgggacttgttgctggtctgttatgactacttggctcatgggtgagtgggtaggtggctccagggctccaagtccatccacggatgagggcacacagggcatgaatgcctagttcccagactctcccacctcgggattcattgcacgtgcatccagggctaggacagaatccaagaccacttgaagttttctagtatgcaccttgcctagaaactctttcatattggctatcaactgtaccaaactctggagttatgtgtagatgtaatctctatttatgaggaccttatttccttgggaaggtgtacaaaacaaatctttgagagtcaggggaattgaaataatttttggacagagacgagacaggcttagagatattgactgaggactaaagagtccctggctttgatttctggttgctgaattgtgctctagaaagcactactgcttaccctaagtccaactaagagtttgaggtgtcagcttcagcaatcaccaagcaagcctttctgtgaattttatgcagttttccatcagagttctggctagaatttgtactatgctttggtttgttgattttttttcttactctttttttttctttttgtcttttagtagaaacttctcagaagatgtgctggggtggagagagtcgttcgacctgctgctgagcagtaaaagtgagtaggagccttttgtgtctgtctctgggtggcacatgtgtactcatgtgctttggagccagccccaggactgctgagagcctgggcagaataatagtagtagtaataataataataatgatcccctagtgtgccagcctctattcaacatataaaggcaggtcattgttcaagaaaattatgttctaaaaatagagccattaattgcaattgctttcctttcttcttgtattccctgctgtccctccagctgacctatttcctcttctttcccgcaaccccagatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggttagagcccccatatgcccagtgaatcctcacgaccctgcctgctccttcccctctgagaatcagggctagaggggaggaagggctaggtgtagaggtagaagggccttacttggcacaggggtgactgggcttctgtgaccagagactaggaaagccaggcccagtgccactcctgggtgcttaaccctaagactcatgatggggcaggatgtgttggcaggtttttcggcttctgtccatacccacctttataaacccatccgtttttagaggctcaaaacacttagcaactggggagacaaggtcagcacagggaccttatgtaacctggctcagtccccaggctgacctgcctgaggcctgctggtctgtggtctgtgatttttttgtctaccttctctcctggccgctaaacgcatggcagctgcatttgctaaagaacacagcgccacctggtggaaagataagagtaatgccttacttttgtaccttatttttgttttctgaccgctgattgattccacataattctgtaaaggtgtattgagccccaattatattcaagacactgttacagtcactgtgtatgtcacagtgagccacacaaagtcccttacctaatgaaacttataatttgaatgggggaagatgccaataaccaactagacaaatatatgccaggtgatgagctatgcactcataaaaatacagcaggaaatgagagacagggagtaccagaggtagggcctgggaagacgtaaggttttccattctgtaaagggaagtgaggacatatgaacagagataagaaagaattcagggagggaagaacattccaacacaggaagcagcaaatgcaatggccagagcctgcctgtcacagtcacggatgagcaaatggacctgtgtagagcagggcaagagcaggagatgaggtcaggcatgaggaggatggccaggtgtgggcttggggagcctcgtgggcccagcaagccctttggctcttcttctgaaagacatgaggagacaacagaggagctaccaaactgagttgggtttttaaaggctcactgtagcgactgggtagagaacaaaccacaggggtggggggtaaggtagcagagagaccaggtaggaggccttggtgcaaatcccaggagagctgatagtgacttgaagcagggttgctgtagaagaaagggtgaaaggggattgcgtttgtatacattcttgatagatcctcatgttaattctgagagattggaggacagacactggatcagatgtgggtacaagcccagagctgaaaagctagtgatcaactcaggagcccccacttcctgatgcagcatccgatgctctttccaatgcccagcctgccgttggccctccctcagccatgcccaccctcttccccaactcaccctgtgtgtgtcctccttcccgcaggtcaacattgaccatgagacccgcgagctgacgaggatgaacctgcagactgccacagccacatgctttgatgcggctcaggggaagacacgtaccctgatggagaaggactcctacccacgcttcctgaagtcgcctgcttaccgggacctggctgcccaagcctcagccgcctctgccactctgtccagctgcagcctggacgagccctcacacacctgagtctccacggcagtgaggaagccagccgggaagagaggttgagtcacccatccccgaggtggctgcccctgtgtgggaggcaggttctgcaaagcaagtgcaagaggacaaaaaaaaaaaaaaaaaaaaaaaaaatgcgctccagcagcctgtttgggaagcagcagtctctccttcagatactgtgggactcatgctggagaggagccgcccacttccaggacctgtgaataagggctaatgatgagggttggtggggctctctgtggggcaaaaaggtggtatgggggttagcactggctctcgttctcaccggagaaggaagtgttctagtgtggtttaggaaacatgtggataaagggaaccatgaaaatgagaggaggaaagacatccagatcagctgttttgcctgttgctcagttgactctgattgcatcctgttttcctaattcccagactgttctgggcacggaagggaccctggatgtggagtcttcccctttggccctcctcactggcctctgggctagcccagagtcccttagcttgtacctcgtaacactcctgtgtgtctgtccagccttgcagtcatgtcaaggccagcaagctgatgtgactcttgccccatgcgagatatttatacctcaaacactggcctgtgagccctttccaagtcagtggagagccctgaaaggaggctcacttgaatccagctcagtgctctgggtggccccctgcaggtggcccctgaccctgcgttgcagcagggtccacctgtgagcaggcccgccctggggcctcttcctggatgtgccctctctgagttctgtgctgtctcttggaggcagggcccaggagaacaaagtgtggaggcctcggggagtggcttttccagctctcatgccccgcagtgtggaacaaggcagaaaaggatcctaggaaataagtctcttggcggtccctgagagtcctgctgaaatccagccagtgttttttgtggtatgagaacaggcaaaaagagatgccccgagatagaaggggagccttgtgtttctttcctgcagacgtgagatgaacactggagtgggcagaggtggcccaggaccatggcacccttagagtgcagaagctggggggagaggctgcttcgaagggcaggactggggataatcagaacctgcctgtcacctcagggcatcactgaacaaacatttcctgatgggaactcctgcggcagagcccaggctggggaagtgaactacccagggcagcccctttgtggcccaggataatcaacactgttctctctgtaccatgagctcctccaggagattatttaagtgtattgtatcattggttttctgtgattgtcataacattgtttttgttattgttggtgctgttgttatttattattgtaatttcagtttgcctctactggagaatctcagcaggggtttcagcctgactgtctccctttctctaccagactctacctctgaatgtgctgggaacctcttggagcctgtcaggaactcctcactgtttaaatatttatttattgtgacaaatggagctggtttcctagatatgaatgatgtttgcaatccccattttcctgtttcagcatgttatattcttataaaataaaagcaaaagtcaaatatgacatcctgtcttcaagtgctgtgtgggtcaggggaaaaggggaagtgttgtggagagctctggggaggagctggcttttgggaattccacaggacaggcgagtaagcttccatggcacaggcagaagtacagggagagcttgatattcacctggtacctgccagagtcaagagaagggataggttctaacgaggctgctatgatcagtgactttttaagctcgtgacagccccacttgtgttgggctgttgtgtggattggactgggctcagcccactgtcatttcagagcccgtatcttttgcccacctggctgggactcggcatgagccatttccaattctgcctgtaacagtgcaggggtcagtaccccttggtcaagtagcaagacatcatcagttaggtggtgacttttgtaggatttttacttttaaaagtaatttgtaattaaattcaattacaaatcttttgtaatttatattcaagaaattattattctttttataatttcatagaagtatctgagatgaggtatatgaagccactctgtacatgaggctgctccattccatgggccaagggaataagggttgaactgtgcttgaaagaatttgggggtacggagacaggcgcggtggctcatgcctgtgagcactgagggagggaggctgaggagggtggatcacttaagcccaggagctcaagaccaggctgggcaacatggcaaaacccagtttctacaaaaagtcaaacattagcagagtgtggtggcacatgcctgtagtcccagctacttgggagactgaggtgggaggatggcttatgctggggaggtcaaggctgccatgagctgagatcactctaccgcactccagcctgggggacacagtgagaccctgggggtaggtttgcaaggatcaaaatctgttcttcctctgctaattgcctgcttgttctcctttttcatcctactgaatccctctcatttttttctgattacgactacttaaaaaaatgttttcttctctgttgaatgatctgtttatacacagatctggaccttaaatgaacctttatttcttccctattgatagtctgagtaaagtgatcagacttcaggaacatggggtagaaatccccatagaatcacatcttaagcacagatctaaggagggattctgtgggtgacaccagggaggatcctgaaattaagggcctgggaaggaagacagggaccaacactgtggcaggccctgagctctgttagtccttacaacagctctgtggagtgggtctgaacactttatcatccagagaaggaaacaagctctgagagggagggacatgcttggggcagccagccagtgagtggcagaatggggatctgaactcagttatgccatggggagtccagtctgtgaaagatgggtggaggaatgtgactgataagggaaggaagagcggaggacccagaaagacagggaggtactaacactcgccctttcctactgctctccttccatctttatgcctttaacatgcatgtattgagtgcatcgaaatccctcagacccaaatgcgttgggtccagcttctgcacaggctcaccaaggcttccttagaggactctctcatcctctccaatcagataccacaatttcccggcgggtctccctaccccagcctctccctgtgctggttcattttccacactgtgccagtcttcagctctaaagcacagatctgagcactttgtggctacgttagaacccctcagcggttcacttttgactctaaaataaagtccagctttaatcctgacacacaagggggtctctgacctgacccaagtccctctccagacgtatctcctgcctggacagccttcattctcagacttttcccttctctctctctctctttttttttttttgtggctacacatgctgttctctctgcctagaacacctctttctcctcttttttagaaaaaattgggggt

SEQ ID NO: 13613 - DNA, 56939 bp, Human
  misc_feature (1)...(56939): n = A,T,C or G
cttcaaagaagatgtacaaatggccaatgagcacataagatgctcaacattattagtgctatggaaatgcaaatcaaaatcacaatgagacaccagctcatccatattcggatagctgttatttttttaaattggaaaattacaagtgctggttaggatgtggaaaaattggaatcctcgtaaaatgatgggaatgtaaaatggctcagctgctgtggaaaacagtttggcaattcttagtggtgatgttcacgcaacattttggatgtacttaactcaactgaactgtaaacttaaaaatggttaaaatggtaatttttattttatttgtattttactcactaagaaaccaacaacaatgaatcaactaataaagcaaattacaaagagatggacaatttttttaaatccacctttcctgaaataacctgtgttaacattgagtagtcatgctaataccttgttctgtgctttaaacttttgttgtggatatttcagaaattatctctatcaaacagtatagataataatatataagcaacacccatgaacactggatttgttgaacatgagctatgacccaagtgtgggcaggggctctgtgtgcctgcagcgcttaccagccttcgtgggattcacacctgcaacggtgatagaagatgatctaacctagccaacttaggcacgaaactaatgactaagtaaaaccagaaactaggaaaatccataggtcacatcattaaatgtgtctgtgataagcatcaccgctctctgcttaggttatttgctagtactcttttattttggtctaatcctaagtgttactataatggcttctcgacctttggctaagatcaagtgtttaggtgttattgtaaatgttttctttttgctctatttcaaatgtttctgcatataatactataaaagaatactggtaatatttgcttttgtgtataactaggatatatttttaaagaaaagatttaatgatatctaattgagtagactggtgtaaattaaagtgtagaaagtcaacgggtactttgttatattttgaattctgtcattacatttcttgtaatcttagactaaaacagcatcattaaaacagaaatagcagtcgactcttttgcagaatttacagtaaggcaaagttaatagaaagagctggaatatccagtaaaatgaccacaatgcaaatactattggtgtctctcttcccacctcctcagttttcaatatgtattttttaacaattatcaatgaaaaatgtataaattataaccttactttaccattcattagttgtgtgacaattaacctttctcagcctcaattttctcatctgtaaaatagacataatagtagggcctgcttcatagttttgttataaaagttaaatgagtttttatggaaaaaagtccttagaacagtgcttgcatataataagtccttgataaatatgagctacttttactattgttgctgttgtggtgatgatgatgatatacctactatgcattcaacccttggatgaatatgatgagcactagtagtacacttcctcatctccaagacatttatttggagataatacgcaggtgaggccttgaagcgagccttgaaatataagatttgcaaagtctggggggaagccctatcttttttgtgttaggcatcatagcatactctacaacctttctctgcatgcctcataattaaccctatcaggtaatatagacaggacttgctgaatcagggattcttacctaaatccaaagcctttcttatttccatgctctactgcatgtttaacaatgatcgcttgtattattctgtgtcttggccagttaggtacttctaaatttccattagtttatggtgaatagttttatttttactgattttttccctttaattttactgtctgcatatatactgaattgtatttttgctttttaatttaaattttcctgatttctgttctttcataatttaactcaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatgtaagaattaaaaaaaactagttatatgtttttttgttttagatttttaaaaatgtgacagtttggatacagttgcaagcctgtaggcataaaattattagggggttaacacaatcttcaattatctgagctgcatgtaatcatattttcagggtattttgctttggtgctgataaccaccatttatctattattgataatataaggagaaaatagatttttttaggcagaattatacataaagcagtatttctatatatgagagttttaaacaaagctatcggatctgtcttagggaagtatgtagaccctaggcaaatagttgatctcagcagtccttatatgctggtgaaaccaagttaagggaaatagtgagagacagccttgaggcaaggggtagagaagcaaccaaaaagaggaagagaataagtatgtgtaatggaaggtttgataaatctttttttaccaagttataggcatgccaactctgttaagcactatctgaaattgccctgtttttttccccctcctatctggtaccactttctttttctatacaatgccagctatttggttttcacagtagttaaggaccacttgtaggtaggttttggactgttcattctattctgttagtttatcataacctagggatagagctttcttgacatatctttgggattaaattcctatttgtgtaacaaaaagacaagccaattgaaaaatcgacaaaggaattaaatagacatttctccaaagaatatataaaaatggccaagaagcatgtgaaaagatgctccacagcattagtcattaagaaatgcaaatcaaaaccacaatgaggtatcacttcataccttttagggtggccataataaaaaataaaaagaaaataacaagtgttggtgagggcatggagaaattggaactttcatacattgctggtaggaatgtaaaatgggggaaaccactgtgagaacactttggcaggtccgcagtcagtgaaacatttgttaccacgtgactcagcaattctattcctagctatatatccaaaagaattgaaaacagatgctccagcaaagcctgcacagaaatattcatagcagcagcatccacaatagccaaaaggtgaaagcaacctaatccaatcaacagatgaacgggtaaacaaaatgttgtgtatccatacaatggattattagtcataaaaggaataaagtactgataaatgctacaccatggatgacccataaaaacatatgctaagtgcaagaagccagacacaaaaggccacagattgtatggttccatttatatgaactatccagaatatgtaaatccatagagacagaagcagattagtggttgccaggggctggaaggagaagggaatgggaattgactgctttatttgtaagaagtttcttgttgggttgatgataatagtctagaactatatagtggtgatggttgtgcaacattgtgaatgcactaaatgccactaaattgtatactttaaaatggttaaaatggtaaatttcatgttatgtgtattttgccagaataaaaataaatcctaatggtgcagaaattttccttatatttatagatgagagagtcacttactaatgcttgttatagctctacaaggagtcacagaaattttatttttcttgtggatattccttctatcatcaaatactgttgggctttcttcctcttggactcttagctctttcttttgagagcagagtctgtattctggtatcccacgtagaagattttcagtagaagttttctaagttgaataaatgttaattagttgtagagagacaaaaaagcactacagcagaaaagtgaggaggcagtgaaaacacgaagcctttgcacaagcttctgtctccctcacctcccagcctttaagtcatttctcacaggagatttaatctcctctttatgaggtacaaagtcctgtggttttgctgggttttttttttttggcatttcttttaatgaggaatggaagagaagagtgttaggaatttgggggaagtgaaaattaggagaaagagggaatgagatcagaaagtgttagttataggcactggaattaatagtgactattgatacccataaatgttctgtaaatttgacaattctgcagtataaaaagtcaagttagctaaggtaatgaaaataaatgtatcaccattttttccccacatttgtaagaaaataatctatggaaacctacttcaaaactctattctaatatttagagtaaattagtagaaatttggttacttatataatttaagaaactaaagaaaatatgtcaaatcaaaaacatcagtactaatatagcatatttcttatattagcaacatatactgatttttaagatatactatgtttaagatgtacttgatgtgtttttttctcctgtaattttcattgtatcaatattatagtctaagtgaacagaatgctttcaaaacaggtgctgtagtcaactagtcacttttcattagtcactgtgaagaaatagaaacttagaatgtaaaataggggtttaattgggttttattaataacagaaagagttaggagaccatcactgtgtcattatgctaaccataaaaccatagtgagtgtcacagccacatatttcctatacatttaatttttttagcgatatgaagagaaacatgttagtcttgtgtttcagtttcatttactcattccttagtgagaaacaatgcatctataggaaatataaatatgaagcagtatttaaaatttacaaaatggtaagtaatttgcttttatcttaaaaaaaaagcatttctagagaaaataacttatatcccattgtttggctgatttatttgccaggaaaagttttaaaatgtgtcatgaatgttttgcctttatgtttatttgatgattgtaagcacattttagaacatggttgttacttcagaataatttaggacaccagaaagattagttgaggtcatgaaaggcctaccatgcttaaagactgagggcaagtaaaggaaatgaattagtcagttgacagtgagcttagttgcacatgctaacaatctaagagttcccaagggtcaaacaatacattttggtgtaatgcagatacataaaatctcgttattttatgaatttgtggaaagtatgtttataattttatacaatttccaaatgcaggcttcagggtaaaacatttgaaatacaatgtaaaacctaccttgttttcagttgagttactgaacagaagcaatgagggcacatcaaataatcaaaattattttgcaggatgtttttcatcttttatattcaaaagctgttgagctttatttatagtaatgttatttttatgtagttttggtctattttagattttggttttctaagtactcaattcattttgagttttgtctgtttgacccttgtagcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcaggtaatttaaaatatgcaggagcatattttaaaataggattattacaattcagatttattaggtaaatccagttttgcttagtaaaacataggtggggttttaatgatgtttctgtatgtgatgagaagtacgttttgaatgatggccaagttgtttggatcatatattcacaaaaaaaaaccctatatatttcagtctttatcttagcagaagggaaatttgaagaggtggagaaaaggagagaggggtggcagcgggtgggagagtaggcttgagtctcaaaggccttggtaaattggttcagttattaggttggtgcataagtggttttgccattaatggcaaaaaccccaattacttttgcattaacctaataaattattttagttagtcaccctcttggggtcatttggtcttcctgcccattcatgatagggagttccaaaccaaccaggagacatagcacgagtgagtgatgttgaggagatatggacataacttcctggaaaatattggtattcaactcatactgggcaggaagaagagaaggagcatgttctcctataaactgacagctcagtggggtcatcaagaggggacctgggcctcttgtgagaggattgtgttgactcacccaattggtaaaaagtacatgaggaacataattttccccgtcactttatagaagttgcttatgaacaaataacataagaagaaaatacagttttaaaataaacatatgtaaaaatgatcaactttgctagtaatcaacaaattctatacgaaaacatcaatgaagatctttttaacctgttatttgagtggggggtggtggcagaagagtaaagcagcaatatagccaggtgattaagagcactgtggcattagacagggtctgagtttagtttagatactaccatttagttgctgtgtgacctcggacatggcttataaaccttctgaaccttagcttcctcatctgtggaagaggatgactaatagtggttacatcagagatttgttgtgaggatgatgacacaatacatgtaaagcacttaggtcggtgctttgacatatggcaatactcagtaaatgtaacatattagtattaataatgaatgtcagagtggacgatatgacgtgtgcacattggtggaggaactacaaattgtataaactggtggagagcagtttgacaaaactattaaagtcattgccctaaaaaagcctgctttgagaattcatcctaaggaaagaattccacaggatggaaaagctatattcatgcaaatgttattatagcatgatttgtaaacccctcaaatatttgacagaaatttagtggataaattatggaacttaatgaaatctgaggcaacaaatttaaaaggtaattatgaacctacatggtaacatggaaaagtgattataatgttaaaaaagatataaaattgtatattacaattacaataatgtaaacataagtttttatgtggatataattacaaaaaaatcatgtttgtattcctaaggtggtaaaattaaggaattttttcttcatgttccagattttcagtgtgtgtctatgtctaaaatattagctgctgtgtagtgagtaattagtatatgcctggctctgtgctgtgtgcttcagacacattatctcattttgattgcagctacccttgggtgggcattactctccctgttaaatggagaaataaagtggactttagaaaggatatccaaaattatgttaatggtggaactggaatttgagtctaactgtctgactgtaaagcctttgttaactactataccatacagcttcactaaatacttcctgaaacagtattgaagaaaaacttcaaaacagaaacaggaagaggctttcctatggttatatttaatttggttcttaaaatggtgacattattacagacaaaatagaaataaaacagtataaaaggcaagttgaaaaagacaactcttgtcatgcttagaattattcagaattaaattacaaattattaaattattttcttaaatctagattttgattttccaaaaaggttcaccttaagactattgtttagtacatgttgattgacaaaactacagcagggttttcaatcaaaagctggttatcatgggaaactacatgagtatatttagtaagtttttttttaagtcagagggacacattacagattataacatgagtgttggaaaagagctttgagggacaactgtatagatactctctcaggcaggtgccccacagataacatttccatcccttcattttgttgagtctggggcaaaatgattatagttcataaacaggatctgtcttaggggttccattccaaattcttggtataatctggctcccacatggaatttccactgtaatttcaatatttcacagtagttaggggcctgggacccagaagctcccagaagagattattgcatagatttctcagaaggaaagggaattgttacctagtaaaccataaaagttatcactcacatccatatcaatgaaaatggaggatttacctccaaataacctgatttctttttttttgagatggagtcttgctctgtcgcccaggctggagtgcagtggtgcaatctcagctcgctgcaacctccacctcccgggttcaagtgattctcctgcttcagcttcctaaatagctgggattacaggcacaccccaccatgcccagctaatttttgtatttttagtagagacggggtttcaccatgttggtcaggctggtctcgaactcctcaccttgtaatccgcccgcctcggcctcccaaagtgctggattacaggcgtgagctactgcgtccggcttttgtttgtttgttttgtttgttttttgaaaataacctgatttcttaatgatttcctaaaagcaaaatatattgagattaatgaatattagtgaaaaactgtttggttagacagtttaagaaatataaatcttaaattgagatgcaaaagaaataatatatacttttaagggcaatagaaggaaaaagttctgtgtacaggaaacaaaattaaaataagcatagagagaagccgatgggcattacctgacttttccttgtttgaaaaatacaacttctaaaacttatttctatgtaaagattttaaagcattttacagacagccaaagggaacttggggctgacaaccagaaatggtggggttttttttttccaactgtgtacaaatcatatcattaagttttatgattgaatcaccagttattgaatacacatggtaatgtttacctctgactttgcagataaataagtgatttctttctagtttttcctgctccttagtgacagctgaggtagaattcttctcagataggctttcgtttttcttactttttgtaaccctttcccactctgcagaattcttcttttgtttcctcatttacacaacttttttttagtctgttgttataattgttctcttttattattagctattgttgttaatctcttaccatgcccgctttataaattaaactttaaaaagtttgtataaatttaaggggcacaagtgcagttttgtacatggatatatagttattctattaacatatttatttattcaaccaatatgaaatctgtcactgtttccaaggaatagtcttgcttttggaaagggtgcctggagagcctgtgccagctggaagcatgatgggcaaggtaggagggatggtgggattccccagccgccgggcttcctcagctgatggctcagccactgggaggtgggtgagggaggccgctgcaggaggctccaggccctcctcccctggtccccagcagcctccctcaggccttgtgactgaagtcctgtggctctgtggagggtgcttccaatgaatggccgtctgtggagacagtggccgcaatgagagcacttgggactgaggtgggagcagcagcctggctgcaagtgtgcggaagtgttttgtgtgaatagtcttccacatttgggctcaaaaatgagttttaagtgtttattttgggagctttagctaaaaaaaaaaaaaaaagtgtttctttgtggtaaactttggcttatctcaagcctggcaaagaggaatacatttgattagacattctacaacttttaaattattgatatagttgtcacatagatgagcagactgaagtagagaggttaaaggatttattctggttacacagcaatttacggtggaactgcttggcaactgctcaacacttccagagattcttgcattttacactgtgagggaggaatgtgtacaagatctcatcattcttttttagctccttgtaatatctgaaagtcttgccagatacctctgtttctaatctccgttggccgctttccacccggttgactcttctttctcttgtggacctgatttctgtccagctctgtggcagttgggagatgagcttgctgcgccagagatgagcagcgcttgcagggtctggctgatgtggacgtgacggaaacattgagtccattgtatcctctttactagatagataatgtaagcaaggtctcaagatgagctggcagcccgattgttttctatcttgtattgaatgatgaaatgataaaatgaaaagtttaaaattcagaattcttttgaatattcttcttatgccacccatgtacaaatatcaatagcttaaatagtgcagaacaggcttaggaagcagtaattaattaaaaaatctcacctacttatttatggtgagaacacaaaatatagtcttagcaattttcaaagtaattaactttttaaaaacccaaatattaatgacaaatatcagagataagagctaaggactttgaatggtttttcttagagggggaatggatggggagaagggactacaacctggtaattaaaaattattttaaaggccctgcagacagccgtctttactgacgcctatagatttcggttggttccagtaacatcttttgcttctttatctttcttttcatacctttttttctattgtagggggttgaggaacacaaacatagaggcaaatgaggtatgtgggataacatatattatatatttcatttattttgaccctagcacttattttcacaaatatctttgtattttttaggtgctagtgaaaaaaatataaagtgaaaataaatatccctctatgttttttgggcatagaggccaaatgtgctaaacaaaacaacattttaattaattataaccttgttttacttggtagttacctaattggttggttatttttagggttcactttgtgtgctggtaaaaaatgttgtgattcttttgtgtttttatttcttgtaacatttttagttgggaactcttggctaataaaatcttctaattttttttaacttagaatctagagcaacagaatgtaatatataagctcagattcctaagttactcatgcctctgactttttatatgaggctagcaattcatttatttaacaatgtcatcatcatggtaatcatcaaaatgtacttgaggcatttatgtctgtgttcccatatctttcccactatatgaagtacaataaattgactaagacctcgtgtgtgggactttataatctaaggcagaaaaattaatacagatgagcatgcaggtcatctagacagctaggcaaacactgacacaatgtacaatactgtattaaaagcatatataatgcattgagtgactatacattagagtaaatgaaagatgaattataactgggcagagtggcacgtgcctgtaatcctagtactttgggaggctgaggtgggaggatcacttgagcccaggaattcaagactagtctgtgaaacatagtgaaaccctgtatgtaaaaaaaaaaaaaaaaaaaaaaaattcaccagatgttgtggtgtgcacctgtggtctcaactatttgggaggctgaagtgggaggatcacttgagcccaggaggttgaggctgcagtgagctatgattgtgccactgaactccagcctgggcaacagagtgagaccctgtctcaaaaaaaaaaaagatgaattttgagttaccttttttgtacagtggcaaaaaagaggaatctttactttctcaagaactttgttacatccagataacaactgaacagtccttggcgtagaaataacaggaggaagtgatacatgcagtagtaagaggaaggaaagtgctttgtcccacaaaatacctgctctacttgataacgcctacaattcttttagtttaaatctttgtttttggctttatgcaaatacctgtgggagaaatgtgattaagtgtatgtgtgctaaatggataaagagaaggatattttgtgtactggtggtttggaaataaaccaagtttgaacaatgcaccatgacatgtttctctattgtttcttgaacttagtttgttttccagtcactggcgtataaatctgcctaatacctttttgatattggggggaggagcccacttttatttacatttgaatttctagaaatacatgaagcaaaatatacttgactgaaatttgaaagtgctccaattgagcatttcacaaacatctacaagagagtttgctattagaagctcaggagttggttagcataagaattgtaccttgagataagacatgttcatcatcttgttttcccatagatttttaaatccacagtctacaggaaaataggagctgtattctcatcatgttagctgactgattttgcacagttaatttttggagcttggtttgctcttatcagggttttagatgaatgaactagtttgctctaaaagtgtggaataagttaattgcctcaaaggattttctttttttttttttttttgagatggagttttgctctcgttgcccatgttggagtgcaatggtgtgatctcggcaacttccccctcccaggttcaagcgattctcctgcctcagactcccaagtagctgcgattacaggcgcctgccaccatgcctggctaatttttgtatttttagtagacatggggtttcaccgtgttgaccaggctcgtctcaaactcctgaccttgtcatcctcccgccttggcctcccaaagtgctgggactacaggtgtgagccattgtgcccggccacctcaaaggatttttgaagataggacctctagcgtttttggtgtcactgtgctataactagccacagaccatttctctgtatcccttttgatctcacactacagtgttcgcagtatggtagcctctattcacatgagacttttgcacacttgaactgaggctagtgcacattgaggagctacattttttattttattgccatttaattaatgtaaatttaaaaattgatactcaacttagttatttaaaaatttgtaggtataattggagcaacttgggtatgtgactctaccttttcaactgtaaactttttgaaatctaaatacttattgagcatttttgatgaaaatttagtggctgaattgagaaatgctgtaagtgcaaaatacacactagattccaaggcttagtgtgaaaaaatgtaaaatatctcactaaatgtttaaaatattgattgcatgttgaaattatatttgagatatattgtgttaaagcatattaaaattattttcacctatttctttttacttttaaagtgtggctaatttcgagttttaaattacattatgtagataatatttctattgggtagcacataaaattactgtgtctgtgctttgtagatatttgttaaaaggcaatgtgctagtaattctgtggtcttaaaaagacatgtgttatttttgtttatacatacgtgtatacaaacatacatgtataccagtatacatacatgcatgtgcgtatacttgtggacatgtgtgtgtgtgtgtgtgtatgacctgtagtagccagcctcccacatcgtgtgtcctggttttcagacccttgtttagtcttctcctgtcttataccagggctggtctgtgtggccagcagaagtcatggtatgtcacttcctgagaacaagttataaaagataagaggccaggcacagtgtcttatgcctatagtcccagcactttgggaggccaaggtgggaggattgcttaaggccgggagttcaagactagcctgggcaacatagcgagatctcatctcttaaaaaaaaaaattagctgagtatagtggtgtacagctacttgggaggatgaggagggtcacttgagcaggagtttccggctgcagtaagctatgatggcgccactgcactctggcctgggtgacagagtgagatcctgcctctggagaaaaaaaaaaaaatcagtgcttctgtcttgggcactctgtctttcttgggccacttgctctaggggaagctgttacgtggacacttaggtggcctatggaaaggttcacatggtgaagaactgaggtttccagcagccagcaaggaatggaggcttcccagcaatgacgagattgagctggaagcagatcctccccaaggtgggccttcaggcgactgccccagctgacaactggacagcaactttgtaattctgagccacaaccacctagctaagctgctcctgagttcttgacccgcagaaactctgaaataataagtgatgttgttttaagctgctcagtttgggattgtgtgttacatgacaatagataactaatatgtaatctgaatgcaaaagaggttcattatactgtataatagcaaacaaccaaaccaaaccaaaccaaaaattaattaaatgtcctcaagtgggaaactggttaagtaaatgatggcatatttgctcagtgggatattaggcaactgttaaaaatgttgggttagctgaatcctcaggaataaaagtagccagtggaaacccatgagggtgtgagaaccactcaggggagtcacagcaagcactgctgaccagggaccacgtttataaaaacatgacatctacatattaccctcccaatgttttatttttatttcctctttctgttttctctcctttacctgttctagagaatcccatcagggtacctgtggccttttgctgtctagccttctccatcagattgtgctccttgaagacagggacttcttacctagcactgggctggagcaaggagtgaatacctttgaagtttgaataataacatgcattttccatggtttttaaaactgtttctattatttattttaaaaattatttttgtatattaattaaaaaattgttatgtatttacggggtacaagtacagatctttttttcttttcttttcttttttttttttttttttttctttttgagacagagtctgactctgtcacccagactggagtgcagcggtgcaatctcagctctctgcaacctccgcctcctgggttcaaacgattcacccacctcagcctctcgagtagctgggattgcaggtgcatgccaccacgcctggctaatttttgtatttttagtagagacggggtttcactatgttggccaggttagtcttgaactcctgaccttaggtgatctgcccacttcggcctccctaagttctgggattacaggcgtgagccagtgcgtctggccatgagtacagatttcttacatgcatacattgcatagtggtgaagtctgggcaggttttttttttttttttttaagcaaaatgcaaagttataggtagagtgaaaccacaactatggttgcaaatgctatataaagcaggtggaaaacaaatgaaacaacttctagattcaaaaagcattactttgtaaagatgtaattccatttattttagctattttcttctttaccgggacactccagaccctctctgtagttttgcgttactcgattcagcttggtctcagctgttaaaggtctaatgctaaattagtggtggggatgggagctaaaatgacttcaaatttcctcagcctattgttgttcaaggctataaccaagtgtttttgttttgttttttttctcactttccttttgtctggtctccacttcttgactttttcttaccatgttttgaagctgctttttacttgagtcctgtgagagctgccttccctcccagctgattgtaatttcttactaaagccctgttaactccagatcaatggcttatttgactcacttgactttttaaaggagccagaattatttcgcctttaaagcaaatgtatgtatgtatgttaacccttaagctctcaaacactcaacccatgtgttagggttaaactaatggctctgacgattgggtggaggcaagaaagatagaaatgatgagagtaggaaaaatgacatttgtgtgtgtgtgagaaataaaaatcactcgagacttttacatagtaatatgcaaattccccctttatgcttttctcacttccacctgcaattggagatgtcaatctctcagctgagaatgatagctctagtgagtcactgttgcctatggagggatgttgtcttgcagatgtgttggtgtagaacaaagctttttgtggtagcagcctccatgatgcctgcctcctcttattcacatccttgtgtagtcccctcccccgttgcaccaatgcactatagcagaggcaatgctatgccacgtccaggcttagattataaaagactgaaatgtcttttataatcttgagtcttctcttttgaatcacttgggtcctctcttttgaatcactcactttggaggaagcctcatcatgagcagcctatgtagaggcccatagggcacagaactaaagattccctttaaccctcccacgagtgtgcctggacacatatcctcaattgactacagccccagttgacttcttgattgtagcctagtgataggtcttgagcctgaacctggcaggtaagccactcctagattcttgacctacagaaactatgagataataaatgtttgctgttttaagctgctaaatttggtgtgatgttacatagcagtagataactaaaccagttgtaaacagctgggttagaccaaaacctaaagagatttttctttgagacagggtgttgctctgttgcctaggctgagtacagtggcatgatcacacctcactgtagccttgacctcctgggctcaagcaatcctcccacttcagcctcccgagtagctgagactacaggcacgtgccaccatgtccagctaagttttgattttttttggagacagggtctctctctgtttcccatgctggtcttgaacccctggatgcaagcagtcctcccaccttggcctcccaaagtgctgggactaccggagtgaggcactgcgcctggccaacagatttcttttactttggaagtgctattaccaaaatcatgctggagttaccagtaagtaaccagctttggtaattgcagcaacatatttgttattataatttcacccaatcatgaaaaatttggttgaatgggatgaggaattattattaacataacattaatatcatataagtggcagccaattttaaatgtaggttttgtttgtttgtttgtttgtttgttttgagacagggtcttgctcttttgcccaggctgaagtgaagcaacgtgatcttggctcacagaaacttctgcctcctgggttcaaggggtcctcccacctcagcctcccgagtagctacaggtgcttgccaccatgcctggctaatttttgtgttttttttgttttttgtagagacggggttttgccctgttgtccaagctggttttgaactcctggcttcaagcaatctgcctgcctcaggctcccaaagtgctaggattacaggcatgagccactgtacccaggcaaaatgtagatttttttttttagacctgctttatttcaaaaagcttttgaagtgatacagctgtatatttttatggcaaaaaccagcccatcttcaaactgataaatagggccacctaactgcaaagaaatgattaatttataactttgttgtattttttaatgaaacaaaatataactttggtagggcttagagatagttaaaagcagtgtttgaaaaaaaattaaaaagcaataaagtttaaagagattaagttccagaggagttttttttaattagtgtgctggatacatatttttttcttttttctttttggagaacctcttcattttgaattctttttatgagtcctcatgatcacttgtttgctcaaattcttctgtctcacatctccactatgagctgaaagattattcgagtatcatatgtttagagtaatcctttcttaagagtcaatttttaggtttttattaatttcttagaattctctgaattttcttacgtaaccacaatagtggttcttcctctgtgaccccaaacatgacttcaaaaattaaaagtagaaagaacatcacctttccatacccagaaagccccccacaggctgttttagagggtgtaagatttaagcctatggttgtaaaatggggtggttcaggccgtagcaggcccacagaggggtgtgttttatttggccagcactatgttgtctcacacagtgttcttaaaaaaaaaaaattgccaacacttaaaaaccagataatttcacattaaaaaaaaaaagtcctgacaacagtaggcctatattcctacatagcaacactgggctgaaattaagaaactgctgccccttgtagatggtccctaggcttttgcacttcactactgctctcccactccccgaccttttttttttttttttaaatgtcctctggcttcatttattttagttactttcccgggccctgtgggcatttgcattgaccacttctgatctaaacagacaactagccgtgacataattgagagaggttgcagtcactggggcactattaaagcaagattacttttgtcttatttacctagtaacaaccatacttatactatgctaaggggcattcctgtctgctctcttcccttccagtcaacatagagttatttctaatgttccactcatgcagctttagatagtactaatcttatgaatgttgttgatcttaaaagtcctccttttaatttacgttctctttttgttttaaacttaaacctaaagtcatactgaggtttttgattattctaagttgaagattttgatccacttaaattgcaacacttctcatgcctgttactgacagatcactgcaagcttagcccttcgttaggaaaaaaccaaacaaaccaaaaacccagattccaagaacagcacagaatgaaattcttaagaaaatgcaactgtgtgagaagcaaagtcttgtcaccccaagtttttacggatcaaaaaattgtatgcacataccctcataaatgttgttggaaagaattatggaaaaactgagagaggcagagaagtgtgaaaagattacgcttccccctcgcttgtcacagtaccacagaggaggctgcctcagtttcttcactcaaaatgagctactcctaagccacataaaactagttattcctttactaaaaaacaactgatcatcagatttggcgactgtacatttttatctacatatatgcaataaacagctttaattattattcatgaataaggaaggtgctattggatagtttcctctgacagtttgcagtcaaaaaaaaggttaaagataaataacccctaatgtttaaaaaatgtaatattttaactttaataagggtctgaattaaggcagcagggtaagtgtgaaaaagtaaatgaatattatttctagtatatattattaattctttgaagaagaatgatacactcctttcatataatttattttaaaaatagtgatagaggcaggatgaagtagcctgttggatgtgtagtatgtatgatgtgcattatttaggtgtgccttattaaagaagacatatattccaccatcttttaaaataagaaactttctgctatattaaaaattaagctaaaaattttacatttgtttatttctttgtaacaataatgttagtacagttaggcccagcagtagctatatgtatgggcaagagacatgcttatatttacttttttaaaactcatattgaagaaaatttggcaaacagagaaaaaagataccacccatagtaccatcaacccagtataaatgctgttagcatgttgatataacatgtagccttttctctttgcatttttagacataggtataaccagtttttaatcttgtttgttatgtaacagtataggatatgtcacatattattgtgtaatggaagatatattataaaaattttttgaagatttacttaaaatttgaaatgaggcaatgatattttcagggactgaagataaatttcttggctcactgctttttttggtcaaccttttttgagcatctaagttggtacatatcaatctttgatttcataatgtgataattggacatctaaaaactcatttccatgtttgagtttaaaatgaacttcatgagatttctcctatgggaagtgatctttaggtgtgcagagttttgtatgtgttttggttgctgctggtttttttcgagtagaaaatacagaaaaacctgggcgcagtggctcacacctgtaatcccagcactttaggaggctgaggtgggtggatcatgaggtcaggagttcaagaccagcctggccaagatggtgaaaccctgtctccactaaaaatacaaaaaattagctgggcgtggtggcagttgcctgtaatcccagctactcgagaggctgaggcagagaattgcttgaacccaggaggcagaggttgcagtgagccaagatcacaccactgcactccagcctgggcaacagagcaagactccatctcaaaaaaaaagaaagaaagaaaatacagaaagaaagaagaaaagaggagaaggaaggaaggttggaagcacttcctgaaatgatacttctgtatacattttccctgaacactccacagacctgattcctggctctgctctgtacttgtagtggcctgttcatgtattcactctgagcagggttttctagaacagaacaatgtttttattccctttccccaagatctagccaagtgtgcagcacatagtaagcacttaatgaacattcagtgagtgaaagaggagagaaaaccatgtacagacaccaagcataagagaggaaggaattatatcaggatgtttttagctgtaagttgtagcatgtaaactacaagtggctcaagcaatagggacattttttaaattcacatgacacaaagttcagagtaagggcagttccaaagctggttttgcagctgaacaatgtcatggagtacccagatgtttttcatttttgtactcagccatcctcagcatattggtgatttcttccattatagttgcaagatggatgtaggagttccagatgctatttgcagacatgaccatgtccaacaaagaagaggtggtattttctgctgtgtatctcagtttattacagagctttcacagttgcttccagctgacttctgcttaggtctaggattggctcacaagcctatgccctagctgacgatggctatcgggtagacaccaacagtggctggcatagaaacaatagaggaaacaataatgggaaaaagagtagtgataggtcagaatgaaatagcctgttggatgtgtaatatgtagagtctacattatttaggcctattgtattcttatctgtatatacattcactatctgatatttaatattaacatatgtttgaagctaggagaacaatacttctaagtaaaaagtgtgctactcaagagcagtagaaccatatacatttggggatgtaaactatatgaaattgcaagtacaaaattgctaggcccactttaggtccttggaaacttctttagcttcatggcaaatctttttccactgccatccccggccttccccacatttaacattgctactctggagagaatagaaaacttgggcaacaagttagaagaacagaatttgctttctttttaacattatgttattctaaggaagaaggacattgcactcaagaattactcaaggaacaggtcaaatgaatgggaattataaagatagataatagatgtttttttaaaaagcatcttgagtttttgttaatagtacttttaaaccgttgtagtttgctacatattctttactcgtagaaactggatataaaagtgaaaatacatcaaaacaaaatattcagcccactagatatatatattccaggtgtgcttaaatagggacatatgaattattactatatgacacttgtataatttggatagagtcgaattcttaagcagaatgttaattatcagaaaatgagtattttatttagaaattatatgtaatataacattttatatttttttcccatttcctttggatgggtgtgggggtgtggtgggggaagagaaacagtgaccacctgtgtcacctgctgtcttcatggtcttcagtctattgcagtagcatcccagaggctgtttctgaggaacctgttgtattgctagattgatactgcagtctgttggctattgtcttctattttaaaaacagagcaaaacaaaatatattcctgtcatctgcctctcgttcttgagattacataagaacttcccatagtatactagcttttacaccaaattttaaaaattgaaacatacctttgccaacgaatgtagtggtaatttgcagaagtgtgtcattggcgccgagctgaatgagcctgtcacttaatagccttccattaatacttgtttaatggaagaatgaatgaactgtttatacaatattgggacttctaagataattatgataatttaaggaaagcaaatattggacactaacctgtatttgctaacattttcttttagaggttgtgatattaccaatactttgaaaaatcaaacactgtattatcttcaaattaaagactttaagtgatatgctaaatagagctcttagcttgacagttaagacatttatatataactaaggcactacacatctgggaaaataagaacatattttgaaaggaagagattccagaaatgggtgtctgtgattcagtaagaggggccgtgaatacaatgtgagtagaatctgtaactgtgtgtggtgctttatgcttctcaaaaggcagttttttcatgatattatatgggtctgcttgcctgtctcccattatctgtaatttaaagtgtgctatttttgtagctgttattcttggacatacaagtaaatcaacatgtatgttcaaaagatatgtacttgatttctgacaagagtaagataaatttattcttgtatctaaacattagcatttatatacaaaagtttattgattagtagtaggtctcatttttgaaagtatttttatatgtacaatgaaaaggcagctttctattttgtatgaaatttttaaaaaatcttttaaaagtactacaagataaaaggaatttaaaaattgacattattggcacaagattgatgttaatgtttactcacgtaaatagcacaaaatactgcctaattagtgtggttggtaaatttttggtacttaaattttctctgttattgtaaaccatgcataaaatgcttgtctattgagaagtgcagaattgtcagagcttaaacagctgacatctgcttactctcttaaaaaaaaaaaaaagaataacaagccatttcagcctaatctacctcaaatgtgttcatgtaaatggaggtccatctattgacctgtattcttttcagctcaggattggtccacatggtttatgaaaccaggaagcctgatttgaaatgcagatgttgagagagtgaagtacaccctccccttttttctttgctgtatctgtcagggtgaaaaatggcttgcacaagggtcagtcacccatactcacttaattacttttcttggacccacagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaaggtatttcaaaataaggttgaaaaatacatcagccttcttataatgtaagaaaatggaaatgtgtacacgtgaatattttgcatctaaaaataattagcaaattatcattgaaaacagatatgaatatattatgtatttggtctcttaatatgtgaaaataatactgtaaggattagataaagatgtgattggggaaactatgtacaagatcagaagtaacaacagtgttaacattaataattaaaatacagaatcacataataattaaatcctggtttggaaaagacctaaagatttttgaacccaccactataatattgtttcttatggaaattgcaatatttatcttagccttttttatagctttctaaaatctgatttttagttaatagtcaccaattatacttttatattctaatagttatatcctataatgttttaaaattgttaacattaactaagcaatggaacattctttgaaatggtatcagcatcatgtcaaagatattgttctgcttgatgatttttgtactaaatgatcacctgtctcataaattagcaatttcagtgttgcataattaagaagtggtattcatccagaggtcatgttatttaatcatctgtaatagatagagtttcaaaatattgagaactaatttggaaattaggaatttttagaacttgggtataagacttgaatgtgaatgtctcaagactcagaaatcttaggctgtttaggcatgtacatttttttccttttataaaggaatttgaatatatataaaactgtttacattacatctgaactctgtagtggatgctatatagtgttttgttgttgttgttttttttttgcttcacagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgaggtgaaaagaaacttcaaggcacaataatatgtagtagttagttttagtttttaaataaaacatcaatttgtttatagggcctaggggttgtggcacatgatctagttgagtcaggatttctcgtcttctactgatgttttggactgggtagttctttgttgtggggagctggtcctgcacattgtaggacggatgtttagcaggatccctaacctctgcccactagatgccaaaagcacccttctcccgcaagtggtgacaatcaaaaatgtctccatactttgccatgtgttcctcagggagcaaaactgcctccagttgagaacactgggttatattagcagagtttgagcttgaaatctgtttctagtcatttccaactttccatttgtagattgtgaggacaatggaactttgccatccttacaattttatgtcagctgggagtagtgagaacactattatagctccaggttgggagaaatcacaaaggtcccctggcctactgtgaccactccagtagctgctcttacatggtgatttcccgccctgagttcctagatgggaaagaaatagagagaaagcaagcctgtgttgattctgaagtatcttttttctgtgtatattttgactaatcaatttttatttcattaaactttaagtcctcattgtttatttcatctaacatctttatttgcttgagatttttcaaaattaaagtgcactcagctagtaatcattactagcaaagggggaataattaggttagaatatttcaagtccgacattgtctttcaccattcagtgattaatctgcttcatactcacccattgtgatgggggggtttcagtagttagttatgaaccagccctaggcttagagtctacatgaggaattttgacatccattataatagggataaaagttgtgccatcgatgcatgaaaaattgaaccacagagtaaagctcctcacagtttgtgcatttgaactagcaggtttattgtacttgtatatttctttaataaatataataatttcactaaatgataattcaatttcaccagttgtttttaggttctaaatagagtgtggcaatattaaactgtatttaaagaccatcatagggtcctggtgatctaactcttgttcccatcgcttagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaaggtttgttcttgcttcgttttcttccagttgcagtaagaaattctaagacagaaccacagattaatgttctccaacagaatacaaaatataactgactggagcaaaaaaattacctgaaaaaaattttgattgtttcaatgcttattagcaagttttattagcaaggtaatgggaagtttaaagttttactcagcgtttctcatcaacaggatatcaactattttgagcattagtattatctgtatttaaatattaagtttatttgtatcttgaaggattaattgtacatatctacaaacatgtaaagcttaccttggttagaaacacctatttgtaaatgacatgcccagtagtcattttcagtattctgggaggtctatatacccctccatttcctgccacttcagtgggagatgacaatggctaggacatccctttttatccactttctcttcttcagcttttattaactatttctcttcttagatttaggcaattcagagcacatgtcagtgtttttgtttccttgctctagggcttttgctttatctcagttcacaattttgtaagaacccctcatctagtgcagccctggcacatagtaggtgcttacgaaatgtgtgctaatgaataaatattgatctctggacgaatgcttcaaagcctgtgtgcttacagtgtgtgcggtgaccctctggggtgtgggtttcttatcagcatagaaaacctgctgctgtatgttaaacagaaatgtggattttttttatcccttactaatcctcagaataaaaaggagcctcagatctttattttctacctatttcttgataattctttgctttactcccttttatcctgctcttttccttttgttcttctactaccacagactgtgatagtgactagagcaatagtggtgctttctgaagggtcacggtaaggatgttactaggtttttgatccttggttcttttgtggatagtcatgaagcttatgcatgggaagaatgatgaaagaagaagcaattgccgttgcttcccatatgccttcctgaaattaaccagggagctctccccttctttggtctaaggttgctgctggcctttcccacttggtttgtttttcagatagagatcaaggtgttgcttgctgaaactccagcagtttcgggcaagccacatagtatggtagcactctctgcttttcctgtgtggtactataaagactaacaataatactttacatttaaatagtaattttaaagcaaatttgcattccttatcttatttgttattcattataattgaggccaacaagtcagagcttcagggatggagtagaggcactgtctccttttcctcctgtttcttcagtcttgttacatcctggacatgtgggctttctggaaagttgcttcattctgaagacaggtctgacctttaatattggcagacatacatttttagttgtaggaaagaagccaatgaagaaatatagctgacctcttcaggaaattggtcttaataaccaaattaaaaagcaaagaataaaagtatatatgatgattctggcctttgctgtggtagcataaccatgtgatctttttttgtggtaccaaatttaaggtgattaccataatctcaaattagtcagaaaattacacctgtacagaatttggaattagaatttgattttttaaaattgttccttgggtatacaaaatgtaatgtatttgaggctctttagtttattctgtttttattgtttagataaaattgaagcataagatgcaaaatgtaagcatgtgctgtgtaacaaaagtagtcgttgttttgacattcagtcatgttaaagtggaaagaactataatttaaaagttgaccataattgatggaaagttatttatgtactgtttcaggaaaggtgttagtgaatatattccgctgacaaggtacttaggattcttactgatttattttattctcaggcttattatatcaggtttattatatttggtgaaaagacaatttctttaaagattctaaactttttaacaaaggaaaataaatgattttaaaattctaaacatttttatttagtcacagtaaaatctggctttgcctatttcctagtctgtgacatctgttgtctggttaaatacctctctatttggggggtaaaagctagtagagaaattcttggtttagttgaatcgttaccgataattaaggtaatttagttctagtcatgttattgacttaagaaatgacagcccctgtgatgtgctcatttattgaaccatttaagaaaaaaaggatcaaggccgaagtgatttcttctcatgtttgagagacatggaagactctttaatcctgctctagattcataacacttgctcttttgatccacgctgcagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaagtaagtgcttaattctgttttatgaagattttggctcatttaaaaaatatgtcatttcaaatctctttgttttcatcatggacaatattgttttatgagtcaagaaatacaaatttatcagaactgacttcactcttctttgaaaatgagttaccctgtctctaaaaatcagtgatatattttagagaaaattctctatgggtgcaaagttgtttgtaaaatgaatggttaatgcagtctacattcctgttgactcttcttatgtagtgggaattgaagaataatagaattttttagtttgaatttgctggagagacctctagttcattttacatttaaaagtgaaatccaaaagaatttaaggtacctttcaaatgtatcatataactagtcagagggcatttttgaacccataatttacctctttaattccaaggtcacctgaccttttaattatatgtcttatatttgtttctttaaaaaattgtctataagactcactaaattaaatatttttaaatcatgcatttttaaaaggcagattttctgaaatattactagctactaaaatgcttcacaaaacatgaatatgaagaaggatggattatttaatgattttataatttaaaaaaaaagaaataaaatgttttccagcatagttcctattaggaaaacttgtaagtttttgaaagcagcttgtaaaattgacttggtttgagggaagttcacagaacagacaataatttaacagtaaattaaattacatttaaattttaattaaaacagtaaacaaataggaaaacaatttggtgaaacttaactttagatggcataatgagatgggaagttttcttgaagtatacacttaagggactctgaaagttatgtatagtgaattatctatttgacttgtaaattttataaaagtaaatttatgtatatttggtcatgtttgcatattatttctctactaatgcattgagagaaattggtttctaagatttaactttttttttcagtttttataaggctttctagaccaacaattatttaatagatttagaacttccctcatatgtctctcacatgtgcattctttggcaatgcttggtaaagagagaaagattaacaatgtaaggtcttttctagtttagcaggtctctttaactttctggtgagaaaccaaaactctattcctagctttaagttgtccaagcacagctgatatacatgtatacgtgtatataattgtaacctatatctgtagtcctcttttggcttcgtatttctttaacccattatcattgttgtttttctcctcctcctttccttctcctcttccaccctctcctgccaccctcctgagtttcctcttaagttttggaaataaagtaaagggatgtatgagctagagcataaatcattaatagtggactcaatagtaatttcagcttgagaagcccttgcaaatagtcccttaggtaagagtatgtactttttatatactactaccttatatatcttgccttttaataaattattatgatattatgttgtatacatatcactggagaaaaataaatttgaaaacttcactttttgaagtaagataaatttcattgtgtttaacaagtggtgtttttaggttaactaatagaaattaacttccttctgcctatatttagtacagtgttactttcaggaaatacactgagtagtaagtgaaaaagtgggatctttaccaatcattattccatcaacaatcttttaaaggcttcgagcccatccaaatattttattattgtagggatttgatcattcttttttctttccccacggtctcgtgaattctctcagttgttattttaaagggtgtagaataaaagtccattcaagcctgttcgatttgacaccatctcagtagggaaaagtgtatccaagagtgtcaagaactgtctaatggtatttctcatttgttactctatggcaggtttcaaattataagcccatgttgaagttcattttgtcccaaaggcatgtcagcttctgtaagcattctctaattggtttccatgcaggagaacgaatgagcaatcttttggaatttctctcatgttttctttggagaaatatctattgagaccctttgctcattttaaattgggttacttatctttttattattgaattgtaagagttctttgtatattctgggtacaagttcttatgaaatgtatgatttgtaaatactttctcacattctatagattttcttactatttgctcccatgttattccaaatctcttaataaaaatggaaaagaagtttttttctaataagcttatctacatgttttgaaaatattcaggcagttatacctttatttgtttggatttagaggcatcatattgaaatgtttcatcttactttggcatttgaatcagctcattctagttataaaactatgtttaagataattatttaattattgtgttcttacggtaatagttgttcccccttcattttttagcagctttattgagctatagttcacatgccatacctttatccatttaaagtgtaccattgaatggttttgggtatgtttacagaattatgaaaccatcaccactatctaattttagaatatttttattccccataaaagaaatgctacccattagctgtgattctgtatcccctctgcctagccccaggcaaccattaatttactttctgtctctatggatttgtctcttttggacatttcatttaaatggagtcatacaacatatataacctttttagagatagggtttctttctgttgcagactggagtgcagtggcataatcaactcattgaagccttgaactcctgggcccaagtgatcctcctgccttagcctcccaagtagctaagactacaagtgtgtactgccacatctggctaattaattttttctttttttggagagacagggtctcactgtgttgcccaggctggtcttgaactcctggcctcaagcagtcccccaccttgacctcccaaagcactgggataagaggtgtgagccaccacacctagccatgtgcctgccttctttactacttacttgaagtttcacagttcgtccatgttgtggcatatatcagtattttgttcctttctattgccaaataatattctattgtattaatatgtcacattttgtttatccatttaccagctgatggacgttggattatttctactcttgactattatgaataatgctgttataaacattattgtaacaagttttcgtgtggatgtatgttttcatttctcttgggtatttacccagggatgaaactgctgggtcaatagataactctgtttaacatctcgagaaactgcccaactgttttccattgtactaccagcaaggtatgatggttccactttttccacatctttgtcaactcttgttattatctttatttttgattgtagtcatcctagtgggtttgaattggtatctcattgtggttttggtttgcatttgtcaaatggctaatgatgttgaaaatcttttcatatgtttattggctgttcatacgtcttctttagagagatgtctattcagaccctttgctcattttaaactgggttatttatctttttattattgagttgtaagagttctttgtatattctggatgcaagatcttatcagatgtatgatttacaagtattttctcacattctgtgggttatcttattttcttgatgatattgtctgcagcacaaaagttttaaattttaatgaaattcaattgcatatgctttttgtgttgtatctaagaaggctttgtctaaccaaaggtcataaagatttactcctatgttcctcttcattttaatagctattactctttggaccacaatgctttcagaacaaaaataactttctgaaaagaatttttaaaaatttttcagcagttttcattcaagataattgtatttgtttgttctcacactgctgtaaataactacctgagactgggtaattgatgaagaagtttaattgactcacagttctgcatgctgtacaggaagcatggctgggaagcctcatgaaacttacaatcatggcagaaggcaaaggggcaataagaatgtcttcacatggcagagcaggagagagggagcgaagggggaggtgctacatgctttgaaacaagcagatctcatgagaactctgatatagtttggctctgtgtccccagccaaatctcatcttgaattgtactcccataattcccacgtgttgtgggagggacctggtgggagataatttgaatcatgggtgtggtttcccccatactgttcttgtggtagggattaagtctcatgatagtggatggttttatcaggggtttccacttttgcatctttctcattttctcttgctgctgccatgtaagagtgccttttgcctcctgctgtgattctgaggcctccccagccatgtggaactgtaactccaattaaacctctttttcttccccatgtcgggtatgtctttatcagctgcatgaaaacagaccaatacaaactctactatgtttactctccaacactgagagcaagccatatcaataatccactaaggaaagcaacaattagtaatttttggtattcttccaatttttagtgaaaaacaattgaaattgtattggtttcccatagtattgtcaattttattttgttaattgctatttttatgtgtagtgttaagaggtaaaaaaaatagtgttgttacttactgtggtttttccaatagccctaatcagggaggatacagtcagtttttagaaatgacggaaaaatgaatgaagttagaactgtagatgctatgctagttaataggtaaaccaggcccaaaccctcagaatgccctcaatagatagcccaggattccttctctgacatcgtcatatattgtatctaaggataaacattaactactaaatgcaatgacaattaggaaaatttataatctgttattcattagctcaaggtaagatattacttgatttactgaactaggtaaataggagagtttttttgaccccataaaatttctgtacaattcatggtatggagttgtaagggctattttattttgctcacagccataaacaaccaatcataatgcatatcttctagaaggtaatgaatcttaaaaccaacgtgtgacatgatcttgtatgtaaaaaaatcctaaggaattcacacacacagacacacacacacacgcacacacacaaatcatagaactaataagagttcaacaaagtcatgggatacaagatcaatatacagaaatcatttgtattttcttttttgagacagggtctcactctgttgcccaggctgggctgctgcccaggctggattgcagtggtgcaatctcagcttactgcaacctccacctcccaggttcaagtgattcttgtgcctcagcctcctgagtagttgggattacaggcatgtaccaccatgcctggctaatttttttggtatttttagtagagacagggttttgccatgttggccaggcttgtcttgaactcctgagctcaaatgatccacctgcctcggcctcccaaagtggctgggattagaggtgtgagccactgctgctggtctctcaattgtattttcatgtacaggtaataaacaattcaaatatgaagttaagaaaataatgttattcataataacatcaagcattaaatacatataaattaacaaaagtttaagactagtacactgaaaactataaaacattacttaaaaaataaattatgagacattccatgttcatggactggaagactcaatattgataaactggcaatactccaaattgatctatatatttaacataatctctatcaaaatcctagctggcttttttttcccccagaaattgagaagcttatctgaaaattcatgtggaaatgaaaagaacccagactagcaaaacaatcttgaaaaagaagaacttaacactccccaatttcaaaatgtaccacaaagctatagtaatcaagataatgtggtacttgcttacagaaagacatatgtatgtatcaatggaattgaattgagaatctgaaataaaccctttttatcatcaattgatttttcacaaagatgccaaggcaatttaatgtggaaagaatagtcttttcaacaaaggtgatgggacaattgtatcctcaagtaaaaatatcaatttggacccttatctcataccatataccagagttatctcaaaatggatcttagatctaaatataagtgttaagattataaactcttagaagaaacctgggaataaatatgtgttacctcaggttaggcaattattttttagatattttacctaaacacaagtgattttaaaaattgataaattatatttcatcaagataaaaaaaaatcctcttatgcttcaaaagacaccattaagcctgggcacatggcttatgcctataatcccaacactttggaggacaaggcaagaggatcacttgaggttaggcgttttgagaccaacatgggcaacatagtgagaccctatctctacaaaaaacaaaacaaaactagcagagtgtggtagtacatccctgtagtcctagctatttgggaggctaaggcaggagtattgcttgagcccaagaatttgaggctgcagtgagctatgatcctgacactacactgtagcctgggtaacaaagtgagatcctgtctttaaaaaagaaaaggttaacattaagaaaatgaaaagacaagccacacaaacttggagaaaatatttgcaattcaagaaaggagtttaagtattattatttttttttttgagacagagtctcactctgttgcccaggctggagtgcaatggcacaatctcagcttaccgcaacctccgcctcctgggttcaagcgattctcctgcctcagcctcctgagtagctgggactacaggcacccaccaccatacctggctaatttttgtattttcaatagacacagggtttcaccgtgttgtctaggctggtctcgaactcctgacctcaggtgatccatctcccttggcctcccaaagtgctgggattacaggcctgagccaccgcgcctggctgagtttaagtctttttaacaactttattgagatataatttacataccataaattcactcattttaggtatacaatttaatgatttttagtaaatttacagaattgtgcaaccatcttcacaatcaaatttcagaatattttcatcatcccagaaggaagcctcatgcccatttgtagtcactccctcttcctcctctcaattatacccaccagctccagacaactattaatctactttctgtgtttctgaatttgacttttctggacaatccatataaatgaaattatacaatatatgaacttttgtgcctggcctctttcactaagggtaacatttgtgaggttcattcatgttgttgcatgtgtcagtacttcattccttttcattgtcaaatagacatgcaaagaaagtcttaagtaactaggatttctatcatgctggataatatagctgattattaattatgatatacatttctatctagaagaatataatcataagctgattatatttcttccacatgaaagatagtaaagctcagtgaatttctagtgtcattagactcttttctacagttcttgattaataacttgacaatacatcaacttagaactactagaataaggctgtctttattgtacagtgtatgtgatttctactacactgttcaagaaccttttcactgataacagtgaagttaaatttgttagcttgctaagattatcacgatttaagatagttcccaagtatgttgggaattgagagtttaattccaacttacattatactacttgtgggaaaaagctgggctgcatattttacattccttgttttatttaatctaatttataaaacagtgtttgaggataaatgtgtcaagcaataagaggctatgcaagactgcttagcctgggtctccaggaaaccttaaattcaagagattctttactaacaacacacctgtggtaaagttttgctgaatagatttaccaattataaagttcatgatgtgaaaatcacaatgctccttgacatttcaagagcactgcaaaacactcaatagcaaaacagtgtggtgatcccagaagaccaggttgggtaaggcctcagagagagaataagtgaagagaaaagccataagggagcactgaagcacaaaacctcagacaagcagatgtggaattctagtggaaaatagctggagacaaacccaattgttgtgaagctttccaaactgaaggggacagcctttaagaaaaagaaaatgaatcacaaccagccatggcctgagggctggctgctgtgatgtgctgcagccccatcagggtccttctccacttgtagcaagggtcagcaccacctgatgtcaccttgaaatacggagtgcaggagggggtagaaatggtacatatggtacgtattcttctgcttgtgggtgatacactccctgtgttgagaagatctgtagttgagtagatcctatctgttttgcttctgtgaatggggaaatgtctacctacgagctatagcagcacctctgcaaatgctcattgaataatgcacactgtagccacttctgactgcatatgtataagccatgaagtcatggagaatatagaatgcctgataatgacattcttcaaaaaaccaaattattttctcgtatttgttgataagtagaaatgggatatattagttatctcagtttcctgtatacaaatttttactctaatatagtacatattaatttatagtctgtaactttgtgctttataattttaattttcttctaggtattttaagagctcagtaatacactttacattttaaggcttaacacaaagacaacttgtaggatattctatgataaaatcaatccaagcaggagttttttttggacaacaattttaaaaaatgaaacaactgcagcttagaccaggaaattgattttattttgaaattccaggaatgtcagatttgaattcttgtcaaggtttcattgattacttacttatgtatacattctgctttgtatttctagagtaaaaaagccataaagaatatcctgcaaaaatgtacctacttaccagcccttgaaccatttctatatgatgctcctcccaatattctgaaacatgtggttggacagttcagtaaggtaagaaatgccagcctctaaggggaggaagaaaattaaaatgatttgttgttattttttttttctgttgggtcagtagctttttctgtaacacggggtcatggttttactgcttaactctcaccaatctgtatggacagagaagttaccttaataaaattcacatgtaaataaaacactttcttcatcctcacattttccttagagtctctactgtctttttaagtgttcccagaaaagaaagctctcataatatagataatttatattgataagtgacttttagtaatctttctagtgtctttcatttcactcacctgggaatatggcaaagatcataaagagaaaaggaaaaaggtttctgagccaccgaaatatctttcatgaagtccatgtactttactggagatgttctcagacagtcatttggagcatatcgacttattttgtgaacaattttaacaaatatagctgtcatatttcttagattgttgcagattaaatgatagtaaatggtagtaaggtagaaaggtcaagctgctataagtgggcacagccagcagagctgattaccaatagcaaaggataaaagagaatgactctgttaccacagacactgatagtcaggatggtgaccctaagctatcaagagctggctaaattatgctcagtgaatttgacttaggaaaatggggtctgtacaagtagtagcccatggtggttatgagctcggttctgaattggagtacctggagttcccacttaccagctctgtaattctttaacaaaatgttgacctctctaaaccttagtttggttacccataaaatgtaaataattagagtacttatttcatagggtcattgtaaagagtaaatgagatattgtatgctaagcatttagctcaatcccaggcacatattaagcacgcaaaagaacaaaaacaaccaaagagttgtatttaagaaataaaacatgcaagcgggtcaggctaatttaaaagatttaaaaaaaaatgaatggggtgtggcaaattcatttgaatagtcagttataatgctatataaatgagatattactcttcatacactatgtttctacaaataatgaacaaaaactatgtattgttataacttttaaagtagtccctacagataagtttgcctagttttaggtcttcatctgaaagatagagtctgctaacagccttcagttctctcaactctgttcatgacctccaacagtatgactggccgtcaagtgccagagccacaggaaagtagaagtttcacattgctgaagccactcacccaggcaggatacagttctgtgtatcaaacacctatgtcctttcttcctccttccaataaaataaactgcccctcttagttatatgggatgtgaggaatataatggcatgccctcttgaaaaaccaactaaataaccaaataatgcagagaaaagactaaattactgcaagggaaattgatccatttctttattttttgtatacttttgggtgctaagaaggtgaccagctaatttggtcctctaagagtgataaggggtaaggggctgagtagatcatctacagacagagttatctgttcttgaactgggtaattgacattatttctgaaagtttcattttgtagtttaatcttttaggctagtgagtgagatattctgattttattgaagtagctatgaaagtaaacactaacctacattaagagttcaaaatacataaaaccagtgggatgtgtggaagttagacagccccaagataaaataaatacagtactgtatcatatacacttataaatgtgccttcaggaatattttcttttttttttaaatttattattattatactttaagttttagggtacatgtgcacaatgtgcaggttagctacatatgtatacatgtgccgtgctggtgcgttgcacccactaactcgtcatctagcatgaggtatatctcccaatgctatccctccccccaacccccatcccacaacagtccccagagtgtgatgttctccttcctgtgtccatgtgttctcattgttcaattcccacctatgagtgagaatatgcggtgtttggttttttgttcttgcgaatagtttactgagaatgatgatttccagtttcatccatgtctctacaaaggatgtgaactcatcattttttatggcttcatactattccatggtgtatatgtgccacattttcttaatccagtgtatcactgttggacatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttgtttggctgcataaatgtcttcttttgagaagtgtctcttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatgatgttgatgatgatgatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctgcacccagttggagcttcccagctgctttgtttacctaagcaagcctgggcaatggcgggcgcccctcccccagcctcgctgccgcctttcagtttgatctcagactgctgtgctagcaatcagcgagactctgtgggggtaggaccctccgagccatgtgtgggatataatctcctggtgctccgttttttaagccgattggaaaagcacagtatttgggtgggagtgacccgattttccaggtgccgtctgtcacccctttctttgactaggaaagggaactccctgaccccttgcgcttcccgagtgaggcaatgcctcgccctgcttcggctcgcgcacccactgacctgcgcccactgtctggcactccctagtgagatgaacctggtacctcagatggaaatgcagaaatcacccgtcctcttcatggctcacgctgggagctgtagaccggagctgttcctattcggccatcttggctcctacctcccatgaatattttcttaatctaaagataccaaagcactaaaaagagatgataaagcaaggtagaaggtgaaaagatactgaagtggctggggacagagataggaagtaatgaaaattctccaggccaaatgaaatatgtaaaaccaatatatttatagaatattacattttttacaaatatatactagtgcaatcttctgttgtccagctgatttatattattgctctattagcaagatccttttgtggttttaattatttgttaaatgcctacatgtacccagctctctgttgagcattggggaacagacaaaaaagattaagttgttcttcagggaactttataatctagctgaggagagcagacaaaacaattagaaaacatttcaatgtactagacttggagataaactttttttaaaagaaggaatgagtgaatatagtctgaagtcttcagatagggcttcaatggaggaaggacaagtgaaaagagctggtccttgcagaaggaacaagatcagaaaaaaagagcgtttcggtcagagggatagtagcagtgactaaggaagagagcaggacttcccacattgtgaccccaccccttccccaggaccttcctagtctggtcagtctttttttttgtctctcataataaatttcttcatttccactggctttttcctgtcaacctgcaaacgtgctcaagtctccctgatcctaagatcaaaacctgcaacatctttagcctttagttctatcctaccgtggtctactgataccctgttttctctttctgaaactttaaagtttgccttgacttccttacttgggacactttcctcagctgctgatagcctgccttcctcaacctcccctccacacacagctgcctttagtcaagtcttcagcaccttctcttcactgtcagatccagtgacttgttttttagttttcattggttgctttaagaaaccttctcttggatttattgattccttacgtttctgatcttctgtctctctaacatttcagtcccctttctatgcctactctttagtatattcattcatttgttaaacatttgttgaacctctgttaggtaccaggcacgagggaaatgaatgaatgaactcaagtatagtttctgccttcagtgacattgtgacagacatataatggataattaaaaattaaaattaaaatattatgtggtatttaggtattatgtggtaagcacgtggatggtggtttgacagaatgctgacagaagaaaaggactcaactcatcctgggataaggggataggggcttccagagaaggattcttaaaggaggtgacacttgagctaagtcttaaaagatgactaagagttaaccaagcataaggggagaggtttgtggagtgtggaaagccattttaggaagaggtagcagcgtgggcaaaggcaagagatgacacagcatgcatgctgtgatgttactgaaacaatatttaggatggagattagtggtggctggagaggtatttaggagctgggtcccagaggaccctttgtgccttgttaaggagcttgcctttaaattcttagggagcaaagagaccttgaatggtgtaagctttatattttacatctgtgagtggatctccattgcctttgcccatgttcattgcctttatttcatttcttcaacctaaaaattaacacattctaaaaagcacatttcacttcaaattagcagcagatttggctcattatgttataggtatattgggtataaattctcttttacattttctcacatacagtattgcttttcaatagtaataatctaacttggaaaagaaaagctgacattttatgtgcttcactttgcaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtggggaaaatggactttgaaacgttcaatattagaatgtagtttttctgttttcacatctaggttttatatccactgtgtcaaaatgtggactttgaaatacgatgtgaggccaatatgtacctttatttctctcttgatctcttccccctgccaaattaattaatgatctgactgacacgcacatttccaattcaaactggaatgtcatttaagacatttttgtactaatttaacatgtgctttactaaagagtacccaaatatagagttcaaagtaaccagtttttaaattgtgaatacctgattataaaaggcctatagattctgagtttcatagttccctgcatattactattctaccttaagctcacatttacattaatgagactatcacaggtagaaaagagatgttgagtaacaacaaaaaagttattatctaaatgcaaaaaaaccccaaaatgatgtttattatttacaggtacttcagagtaatatagcaagatgctattttcaggattaataaaaaagattcatttttaaatgaagttgatttgcagagcattcaacctaagcctcggtccttgtaagcctaatggagaactattccactaaactctaaataaataaaagcaaaaaaagagaatgatttaaacaactgaatcttttttttttttttttttttttttgagacagagtcttgctctgtcgtccaggctggagtgcagtggcgcgatttcggctcactgcaagctccacctcccaggttcacgccgttctcctgcgtcggcctcccgagtagctggtactacagacgcccgccatcacgcccagctaatttttttgtatttttagtagagacggggtttcaccgtgttagccaggttggtctcgatatcctgacgtcgtgatccgcccgcctaggcctcccagagtgctgggattacaggcgtgagccaccgcgaccgcccggccaaacaactgaatctttaaaaatgcccccaaggcatgcaggataaaggcatatttatctgtattttctaatcctacatttatttcttattttctttgattaatattggaaaatataaattctaatttttaaaacttacatgctgtaacatatacttacgcaagttgcaacatgtctgttaattcttcctgtttaatatcaatggtgtttaatacgtatggtaacattaattttaaaagcacaaaagcaattttaagattaaaatttgttttctatccacatatttttacccagtaaattctttccagagttgcaagtttgtgcactttttaggaagtttatgagaactccttgaccaaaagagttccaataggtaagctttgaaatattaatatatatgatacatcaaagcagtgatatatcataacatgtataattagtctacatataacactctgtctccaggctggagtgcagtagcgcgatcttggctcaactgccatctccgcctcccgggttcaagctattctcctgcctcagcctcccaagtagctgggactacaggcacacgctaccactcccagctaatgttttgtagttttagtagagacagggtttcaccatgttggccaggatggtctagatctcttgaccttgtgatccgcccaccttggcctcccaaagtgctgggattacaggtgtgagccaccatacccggccacaaatttatattttaaaagtttgtataacataaaatgtgtaaaaccgttaaataaaggaaatattaaaatcttttttgaagaaaacaaaattaatttttatacgtggaatatgtgtcccttcacgaagaatggtattttatataagtttaaggtaactttcaatgcaattttgttacaaagttacagaaagatgcaaaaaaaaaaaaaaaaaaaaaagaactaaagtgtccccagaatgaatgacctattagaatcaaccaatggtaaggtactttattgaannnnnnnnnnnnnnnnnnnnaaggtggtttcacaaaaagtgagaaaccggattataaaggagatatatacttcttttgtaaaagagaccaaaataaatctttataatagggagaaagagacccattccccaagaaaggttatcttataaatagtataaaggacaccttcaaaggcagtttggttccaaaagtcccaaaaaaacgcaaaataaaaaaaaaaaaaaaaaagacctaaaggtgtccccaagtatgaatgccctattaaaaatcacccaaatgttaaggtacttatttaaagaaaaattttttttttttcccacttttttgaaggcatattttaattgagcaccaggaaaaactacaaactgcatcacattagaaattaatctagtgctggccaggctcagtggctcatgcctgtaatctcagcactttgggaggccaaggcgtggggatcacgaggtcaggagatcgagaccgtcctggctaacacggtgaaaccccgtctctactaaaaatacaaaaaattagcctggcatggtggcgggcgcctgtagtcccagctactcagaaggctgaggcaggagaatggcgtgaacctgggaggcggagcttgcagtgagccgagattgtgccactgcactccggcctgggtgacagagggagactccgtctcacaaaaaaaaaaaattaatctagtgctttgtcaaaataccattgtaaatttttaacttctccacttccccaattctgtgggctgggatttcatttttaaaattggctaattattataaagaattttggttacctgactaatgttttcaaatttctgatatatatatatatatatatttcacccacacagggcaagtaggaaaacctcagttatgttttaaagcattaggttctataaaatcgtattttatagaaatcttggaaatgttgtctttctataaaaatagacaaatataatctcaaaatagtttcatttttacaattacataattctcaagaatcacttggtgataactattttagaattaattatcctttgtaagacagtttatcaactgatacattcatctgttactaacctaaatatttatttcatactgccttccgatttagtaatctttaaatttttttaatgaagaaaggtaggtaaatgagaggaaaggggtctggactagacattagaagacctaagttctgggcctggcttactccacagccataaggtgtttttgaattcctttttcttcaaaatctctgcctcagctggggtggggaagcagctttggggcaacatctaatttggggagggagacatggacacagtctgccattcagcataattctggtatcataacaatataataataaccccaattctctgtgggtctaggataaggttaattcgcttacattcttaaaggacatttagaggtaagttgggatagctgtggttgctggccagagggaaggaatttcctggtcttatctggaggctcatattggttctttccgaaggagtacgctaagagctcaggcttaggtgtcaaacagaccttaattcctctctcagttataactacttactataactaactattaccttgaaggtaatagttaacccctttagccacagtttctgcatctgtacaaggtggttaaagataattacctatttcatagttagaattaaatgagaaaatgcttagccaaagggctacatgtggctactgaggactagaaaaatggctagtatgtctgttaaactgaatttttaatattgaatttaaaatttataaactgacacttgattcagttattggaaaacttttagatatgtttggaaccacttgcaaattttatgtaatctaaatacagacatactagccattttcttaaattaattaatttttttgagacggagtttcactcttgttgcccagactggagttcaatggcgtgatctcggctcactgcaactgccacctctggggttcaagcaattctcctgcctcagcctcctgagtagctgggattacaggcatgcgccaccatgcccagctaattttgtatttttagcacggacgaggtttcgccatgttggtcaggctggtcttgaactcctgacctcaggtgttccaccctcctcagcctcccaaagtgctgggattacaggtgtgggccactgcacccggcccataccagccatttttctagtcctcagtagctggtggctcccattcagtctacatatagctggtggctcccatatttaacatggtaataacaattattattaatctaatatcaatgataacatcattatatcaatactaagaatactatattattaaataagtaaaatattaatatgttaatatggtaaattaaatatttattacattaaaatataaaatttattaatatttaaattaaaaggttaaaattttaaagatatttaaaaatctacctcttgaattcatattatctggtgtccgatacatttgaaggcctaggaaggtaaagcctgctttaaaatttttgactaactcagagaagaagcagttgtgaatttctcagtgtaagaatacttcgaagaaacccactgttgaaagacaattttttcaagagtaagaggctgttaggggagaaacattctttaaggtagctttttgggtgtgtacataagtagctgtttaactatggatgcctgtaagcacactactcactactaagaaaatatggctgtattttttggtccaccttagcttgataaattgtggaaggaattttagtgtaatataaattatgagtttttaggtcaagcatctgggcatagataaagataactaacaaaaggcaaagcaagtctctaatattaggttttatctggagaaaatgccttcagaagcttaattattttgagtgttttgagaatttttgaattatacttccatagatttaaaaaattattctagaatgcctgctaaattttatttgacattcatttatctgcatgtaagttatttccatgacgtattaagcatctcacaatgcactgatcaacatatttaatacttttatactaaatcttgtataaaatgttcaatttatgaatgtaaatgtatagtactatagatgcccaagaactattaatagtaaaaatgattaatttcctaggtttctatgatacaagtatttgtaaatagtttttcaatactaaattatattttattaaatagtttttcaatatgaattatacttccagaaatttttgttttcctaggtgaccagatctgattaaaacccatgctgagaatgatctctaaggcagttagaatgcagaagttgattagtaacaatagactgtgtagtctaacttatgaaaaaaaaaatctattagctaggatccttaaagcaacattagccacttgatgtgattaaaatgaagtctctgtaataaaatattgtcagtggattgaagattcttgtttggaaaatgtcccctttgccattacatttatatcccttaaatgttttgctacttctgtagcacagttttatgaattcgtattttcctcctggatagcctctaactttatgcacaaagcattactggagcataattattcagagtgtatttgagatttcactcacaggattatttcagataaatcccctatattgaatcttatgtgcctgctgtgttgatcgtttcaccagcatttaatagtgtattttctttttcaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtccttttcatttttcctatccagtgtgttgctgaccttggggaatatgtgattggatttatgggtcttggttagttgctgtgtatgtgtcttttgctttaaagggatgttacttctgctgctctctcctggaggaggtgaatgataacccacacagcccctaggccacagtgtttccagtctgactctgttttcaggtttccttctttgactctctctctctttttttatttttttcatgcaaaaggagctacccgtttgttttttgtattttctggattcatctctgtcatcattatttcctaacagtgcataactttgttgtgtcttttaaaacttcataatacccgagattacctcattttgttttgccttatatccggctaagattgttggttatttcatttttttttaatacttccttgggcctgttttgtttccttgcagcaatttctttgacctgttgaataggaaaatgtaatttgtattcccagttttgtagctttcctttctttctttcatgcctacacagcttgtcttatgaatcttttaattggagaaaataaaagtagtttttatctttcttcattagggctgtttttcttagatgtgttggtaatgacagaaattagtttatctgggttaaaaccacctcagatattgttggaatgtcaaatttcctagttgaaaattttcacttcatagataatttcatacttatcaaacagcactaaacaaagtaataaaatacttaatagtgttcagatgggtgttataatttgatcatatgcattgtggaaaatttatgctatgaaatgtttcttgacataaaactctttaaacaaaatgaagctttactttttgaaaagtatgttgtgagatttaaaaaatatatataaaaacaaaatctttttcatttgtcatagggcaaaaataatgtctgttattaatgataattcactgatatttttcacccctcatttgaattttgtcaattctaattccctgtgcaaacccctgtcccactgctccctacccacccccagccccaggagtttatttaaaattcccctgttcttaggaattctcaacttacatgaacaactatttttaggacttcagttcaggaatagaattacttggaccttattattatagattcagtcctttcacctgttgtggaaataggtgaaatcagtggtacctgaaaagagatgttggaaacataggttctagtctctctctgttaagtattatagtaagggtgataatagttgctcagcttactcataagaagcttatgaaaataacctgcaatggtgaaaataacaatgttataaacaaatccattttatacaaactcgacatgtgattaatggaaaacctaatagtcaatgacagattacatattttagccagcaattgtgcaatattccccaggccccacactcttagataagtgtagttcaaaccagatgatttatgattaaaaaaacccctacatttcctgccctcatggagttttctaatataaacacatttgccgagacagaggcagtggaatacgcacaagacactaaacacaaagcaggcatatttaatgtagtatggaaaaacaaatgacaaccccatatttacaggatattgacctgtttttctaaccccttcctctcaaagaaaacccttttccttaaagaaaggatgaaaggtttgcttgtttctaaacttgatttgaggtcctgcttaacataaaccctgaccttaaattcctgggtgaggcccatctcccatcccagatgtcaagtttagaaaccaaccttgaaagaatgaagaatttttctgttgtgttttcaaatagccaattctttgattaagataggtgctaccaaatgttgaggtttatgtacactgtggcttattctgccacagaattcactgtttagaaaatgttgatttgtagctcttctgcttctttcaggtgattaaaaggatcaagtg
